US007838658B2

(12) United States Patent
MacLachlan et al.

(10) Patent No.: US 7,838,658 B2
(45) Date of Patent: Nov. 23, 2010

(54) SIRNA SILENCING OF FILOVIRUS GENE EXPRESSION

(76) Inventors: Ian MacLachlan, 1544 Grant Street, Vancouver, BC (CA) V5L 2Y2; Vandana Sood, 955 Thurlow Street, Suite 303, Vancouver, BC (CA) V6E 1W5; Thomas W. Geisbert, 162 Quinn Lea Rd., Harpers Ferry, WV (US) 25425-5375; Lisa E. Hensley, 200 W. College Ter., Frederick, MD (US) 21701; Elliott Kagan, 4 Royal Oak Ct., Potomac, MD (US) 20854-2654

( * ) Notice: Subject to any disclaimer, the term of this patent is extended or adjusted under 35 U.S.C. 154(b) by 410 days.

(21) Appl. No.: 11/584,341

(22) Filed: Oct. 20, 2006

(65) Prior Publication Data

US 2007/0135370 A1 Jun. 14, 2007

Related U.S. Application Data

(60) Provisional application No. 60/729,476, filed on Oct. 20, 2005.

(51) Int. Cl.
*C07H 21/04* (2006.01)
*A61K 48/00* (2006.01)

(52) U.S. Cl. .................. 536/24.5; 536/24.31; 536/24.1; 435/6; 435/325; 435/375; 514/44

(58) Field of Classification Search ........................ None
See application file for complete search history.

(56) References Cited

U.S. PATENT DOCUMENTS

| 5,705,385 | A | 1/1998 | Bally et al. |
| 5,976,567 | A | 11/1999 | Wheeler et al. |
| 5,981,501 | A | 11/1999 | Wheeler et al. |
| 6,534,484 | B1 | 3/2003 | Wheeler et al. |
| 6,586,410 | B1 | 7/2003 | Wheeler et al. |
| 6,680,068 | B2 * | 1/2004 | Campbell et al. ............ 424/450 |
| 6,815,432 | B2 | 11/2004 | Wheeler et al. |
| 6,858,224 | B2 | 2/2005 | Wheeler et al. |
| 2003/0143732 | A1 * | 7/2003 | Fosnaugh et al. ............ 435/325 |
| 2004/0142892 | A1 | 7/2004 | Finn et al. |
| 2004/0253723 | A1 | 12/2004 | Tachas et al. |
| 2004/0259247 | A1 * | 12/2004 | Tuschl et al. ................ 435/375 |
| 2005/0064595 | A1 | 3/2005 | MacLachlan et al. |
| 2005/0282188 | A1 * | 12/2005 | Haeberli et al. ................ 435/6 |
| 2006/0008910 | A1 | 1/2006 | MacLachlan et al. |
| 2006/0205693 | A1 * | 9/2006 | Stein et al. ..................... 514/81 |
| 2007/0135372 | A1 | 6/2007 | MacLachlan et al. |

FOREIGN PATENT DOCUMENTS

| WO | WO 02/087541 A1 | 11/2002 |
| WO | WO 03/097805 A2 | 11/2003 |
| WO | WO 2004/065546 A2 | 8/2004 |
| WO | WO 2004/110499 A1 | 12/2004 |
| WO | WO 2005/007196 A2 | 1/2005 |
| WO | WO 2005/026372 A1 | 3/2005 |
| WO | WO 2005/120152 A2 | 12/2005 |
| WO | WO 2005/121348 A1 | 12/2005 |
| WO | WO 2006/074546 A1 | 7/2006 |
| WO | WO 2007/051303 A1 | 5/2007 |

OTHER PUBLICATIONS

Arpicco, S., et al., "Preparation and Characterization of Novel Cationic Lipids Developed for Gene Transfection," Proceed. Int'l Symp. Control. Rel. Bioact. Mater. (Controlled Release Society, Inc.), 1999, vol. 26, pp. 759-760.
Arpicco, S., et al., "Synthesis, characterization and transfection activity of new saturated and unsaturated cationic lipids," IL Farmaco, 2004, vol. 59, pp. 869-878.
Beale, G., et al., "Gene Silencing Nucleic Acids Designed by Scanning Arrays: Anti-EGFR Activity of siRNA, Ribozyme and DNA Enzymes Targeting a Single Hybridization-accessible Region using the Same Delivery System," Journal of Drug Targeting, 2003, vol. 11, No. 7, pp. 449-456.
Cevc, G., "How Membrane Chain-Melting Phase-Transition Temperature is Affected by the lipid Chain Asymmetry and Degree of Unsaturation: An Effective Chain-Length Model," Biochemistry, 1991, vol. 30, pp. 7186-7193.
Enterlein, Sven, et al., "VP35 Knockdown Inhibits Ebola Virus Amplification and Protects against Lethal Infection in Mice," Antimicrobial Agents and Chemotherapy, 2006, vol. 50, No. 3, pp. 984-993.
Feldmann, Heinz, et al., "Therapy and prophylaxis of Ebola virus infections," Current Opinion in Investigational Drugs, 2005, vol. 6, No. 8, pp. 823-830.
Fowler, Trent, et al., "Inhibition of Marburg virus protein expression and viral release by RNA interference," Journal of General Virology, 2005, vol. 86, pp. 1181-1188.
Geisbert, Thomas W., et al., "Postexposure Protection of Guinea Pigs against a Lethal Ebola Virus Challenge Is Conferred by RNA Interference," The Journal of Infectious Diseases, 2006, vol. 193, No. 12, pp. 1650-1657.
Jiang, L., et al., "Comparison of protein precipitation methods for sample preparation prior to proteomic analysis," Journal of Chromatography A, 2004, vol. 1023, pp. 317-320.
Keough, K., "Influence of chain unsaturation and chain position on thermotropism and intermolecular interactions in membranes," Biochem. Soc. Transactions, 1990, vol. 18, No. 5, pp. 835-837.
Paul, C., et al., "Effective expression of small interfering RNA in human cells," Nature Biotech., 2002, vol. 20, pp. 505-508.
Spagnou, S., et al., "Lipidic Carriers of siRNA: Differences in the Formulation, Cellular Uptake, and Delivery with Plasmid DNA," Biochemistry, 2004, vol. 43, pp. 13348-13356.

(Continued)

*Primary Examiner*—Kimberly Chong
(74) *Attorney, Agent, or Firm*—Townsend and Townsend and Crew LLP

(57) ABSTRACT

The present invention provides siRNA molecules that target Filovirus gene expression and methods of using such siRNA molecules to silence Filovirus gene expression. The present invention also provides nucleic acid-lipid particles that target Filovirus gene expression comprising an siRNA that silences Filovirus gene expression, a cationic lipid, and a non-cationic lipid.

45 Claims, 10 Drawing Sheets

OTHER PUBLICATIONS

Warfield, Kelly L., et al., "Gene-Specific Countermeasures against Ebola Virus Based on Antisense Phosphorodiamidate Morpholino Oligomers," PLoS Pathogens, 2006, vol. 2, No. 1, pp. 0005-0012.

Reynolds, A., et al., "Rational siRNA design for RNA interference," Nat. Biotech., 2004, vol. 22, No. 3, pp. 326-330.

* cited by examiner

SIRNA SILENCING OF FILOVIRUS GENE EXPRESSION

CROSS-REFERENCES TO RELATED APPLICATIONS

This application claims the benefit of U.S. Provisional Application No. 60/729,476, filed Oct. 20, 2005, the disclosure of which is hereby incorporated by reference in its entirety for all purposes.

REFERENCE TO A "SEQUENCE LISTING," A TABLE, OR A COMPUTER PROGRAM LISTING APPENDIX SUBMITTED ON A COMPACT DISK

The Sequence Listing written in file -56-1.APP, 7,880,704 bytes, machine format IBM-PC, MS-Windows operating system, created on Feb. 5, 2007 on duplicate copies of compact disc of the written form of the Sequence Listing, i.e., "Copy 1 of 3" and "Copy 2 of 3", and the sequence information recorded in computer readable form on compact disc , i.e., "Copy 3 of 3" for application Ser. No: 11/584,341, MacLachlan et al., siRNA SILENCING OF FILOVIRUS GENE EXPRESSION, is hereby incorporated by reference.

BACKGROUND OF THE INVENTION

Filoviruses (e.g., Ebola virus and Marburg virus) are among the most lethal and destructive viruses. They cause severe, often-fatal viral hemorrhagic fevers in humans and nonhuman primates (e.g., monkeys, gorillas, and chimpanzees). Filoviruses are of particular concern as possible biological weapons since they have the potential for aerosol dissemination and weaponization.

The incubation period for Filovirus infection ranges from 2 to 21 days. The onset of illness is abrupt and is characterized by high fever, headaches, joint and muscle aches, sore throat, fatigue, diarrhea, vomiting, and stomach pain. A rash, red eyes, hiccups and internal and external bleeding may be seen in some patients. Within one week of becoming infected with the virus, most patients experience chest pains and multiple organ failure, go into shock, and die. Some patients also experience blindness and extensive bleeding before dying.

Filoviridae are a family of RNA viruses. Two members of the Filoviridae family have been identified: Ebola virus and Marburg virus. There is one identified strain of Marburg virus and four identified subtypes (i.e., strains) of Ebola virus: Ebola-Zaire, Ebola-Sudan, Ebola-Ivory Coast (i.e., Ebola-Tai), and Ebola-Reston. The exact origin, locations, and natural habitat of Filoviridae unknown. However, on the basis of available evidence and the nature of similar viruses, it is postulated that Filoviridae are zoonotic (i.e., animal-borne) and are normally maintained in an animal host that is native to the African continent.

Because the natural reservoir of the virus is unknown, the manner in which the virus first appears in a human at the start of an outbreak has not been determined. It is hypothesized that the first patient becomes infected through contact with an infected animal. After the first case-patient in an outbreak setting is infected, the virus can be transmitted in several ways. People can be exposed to the virus from direct contact with the blood and/or secretions of an infected person. Thus, the virus is often spread through families and friends because they come in close contact with such secretions when caring for infected persons. People can also be exposed to the virus through contact with objects contaminated with infected secretions (e.g., needles or syringes). All Filoviridae species have also displayed the ability to be spread through airborne particles (i.e., via aerosol).

Prevention and treatment for Filovirus infection presents many challenges. Because the identity and location of the natural reservoir of the viruses are unknown, there are few effective preventative measures. There is currently no treatment for Filovirus infection. Patients receive supportive therapy, i.e., electrolyte and fluid balancing, oxygen, blood pressure maintenance, and treatment for any secondary infections.

Thus, there is a need for compositions and methods for treating and preventing filovirus infection, e.g., by specifically modulating filovirus gene expression. The present invention addresses these and other needs.

SUMMARY OF THE INVENTION

The present invention provides siRNA molecules that target Filovirus gene (e.g., L-pol, VP24, VP30, VP35, VP40, nucleoprotein (NP), and/or glycoprotein (GP)) expression and methods of using such siRNA molecules to silence Filovirus (e.g., Ebola virus or Marburg virus) gene expression.

In one aspect, the present invention provides an siRNA molecule comprising a double-stranded sequence of about 15 to about 60 nucleotides in length (e.g., about 15-60, 15-50, 15-40, 15-30, 15-25, or 19-25 nucleotides in length), wherein the siRNA molecule silences expression of a Filovirus gene such as L-pol, VP24, VP30, VP35, VP40, NP, and/or GP from Ebola virus or Marburg virus. In certain instances, the double-stranded sequence comprises a hairpin loop structure.

In some embodiments, the siRNA molecule has 3' overhangs of one, two, three, four, or more nucleotides on one or both sides of the double-stranded region. In other embodiments, the siRNA molecule lacks overhangs (i.e., have blunt ends). Preferably, the siRNA molecule has 3' overhangs of two nucleotides on each side of the double-stranded region. Examples of 3' overhangs include, but are not limited to, 3' deoxythymidine (dT) overhangs of one, two, three, four, or more nucleotides.

In certain instances, the siRNA molecule comprises at least one modified nucleotide in the sense and/or antisense of the sequence. As a non-limiting example, the siRNA molecule can be selectively modified at less than about 20% of the nucleotides in the sequence. Preferably, the modified siRNA contains at least one 2'OMe purine or pyrimidine nucleotide such as a 2'OMe-guanosine, 2'OMe-uridine, 2'OMe-adenosine, and/or 2'OMe-cytosine nucleotide. The modified siRNA molecule is notably less immunostimulatory than a corresponding unmodified siRNA sequence and is capable of silencing expression of the target Filovirus gene.

The siRNA molecule may comprise at least one, two, three, four, five, six, seven, eight, nine, ten, or more of the sequences set forth in Tables 1-15. In some embodiments, the siRNA molecule comprises at least one, two, three, four, five, six, seven, eight, nine, ten, or more of the sequences set forth in Tables 1-13. Preferably, the siRNA molecule comprises at least one, two, three, four, five, six, seven, eight, nine, ten, or more of the sequences set forth in Tables 1-2, such as, e.g., EK1, EK2, EK3, and/or EK4.

In some embodiments, the siRNA molecule described herein further comprises a carrier system, e.g., to deliver the siRNA molecule into a cell of a mammal. Non-limiting examples of carrier systems suitable for use in the present invention include nucleic acid-lipid particles, liposomes, micelles, virosomes, nucleic acid complexes, and mixtures thereof. In certain instances, the siRNA molecule is complexed with a lipid such as a cationic lipid to form a lipoplex. In certain other instances, the siRNA molecule is complexed with a polymer such as a cationic polymer (e.g., polyethylenimine (PEI)) to form a polyplex. The siRNA molecule may also be complexed with cyclodextrin or a polymer thereof. Preferably, the siRNA molecule is encapsulated in a nucleic acid-lipid particle.

The present invention also provides a pharmaceutical composition comprising a siRNA molecule described herein and a pharmaceutically acceptable carrier.

In another aspect, the present invention provides a nucleic acid-lipid particle that targets expression of a Filovirus gene such as L-pol, VP24, VP30, VP35, VP40, NP, and/or GP from Ebola virus or Marburg virus. The nucleic acid-lipid particle comprises an siRNA molecule described herein, a cationic lipid, and a non-cationic lipid. In certain instances, the nucleic acid-lipid particle further comprises a conjugated lipid that inhibits aggregation of particles. Preferably, the nucleic acid-lipid particle comprises an siRNA molecule described herein, a cationic lipid, a non-cationic lipid, and a conjugated lipid that inhibits aggregation of particles.

The cationic lipid may be, e.g., N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxypropylamine (DODMA), 1,2-DiLinoleyloxy-N,N-dimethylaminopropane (DLinDMA), 1,2-Dilinolenyloxy-N,N-dimethylaminopropane (DLendMA), or mixtures thereof. The cationic lipid may comprise from about 20 mol % to about 50 mol % or about 40 mol % of the total lipid present in the particle.

The non-cationic lipid may be an anionic lipid or a neutral lipid including, but not limited to, distearoylphosphatidylcholine (DSPC), dioleoylphosphatidylethanolamine (DOPE), palmitoyloleoyl-phosphatidylcholine (POPC), palmitoyloleoyl-phosphatidylethanolamine (POPE), palmitoyloleyol-phosphatidylglycerol (POPG), dipalmitoyl-phosphatidylethanolamine (DPPE), dimyristoyl-phosphatidylethanolamine (DMPE), distearoyl-phosphatidylethanolamine (DSPE), monomethyl-phosphatidylethanolamine, dimethylphosphatidylethanolamine, dielaidoyl-phosphatidylethanolamine (DEPE), stearoyloleoyl-phosphatidylethanolamine (SOPE), egg phosphatidylcholine (EPC), cholesterol, or mixtures thereof. The non-cationic lipid may comprise from about 5 mol % to about 90 mol % or about 20 mol % of the total lipid present in the particle.

The conjugated lipid that inhibits aggregation of particles may be a polyethyleneglycol (PEG)-lipid conjugate, a polyamide (ATTA)-lipid conjugate, a cationic-polymer-lipid conjugates (CPLs), or mixtures thereof. In one preferred embodiment, the nucleic acid-lipid particles comprise either a PEG-lipid conjugate or an ATTA-lipid conjugate. In certain embodiments, the PEG-lipid conjugate or ATTA-lipid conjugate is used together with a CPL. The conjugated lipid that inhibits aggregation of particles may comprise a polyethyleneglycol-lipid including, e.g., a PEG-diacylglycerol (DAG), a PEG dialkyloxypropyl (DAA), a PEG-phospholipid, a PEG-ceramide (Cer), or mixtures thereof. The PEG-DAA conjugate may be PEG-dilauryloxypropyl (C12), a PEG-dimyristyloxypropyl (C14), a PEG-dipalmityloxypropyl (C16), and a PEG-distearyloxypropyl (C18). In some embodiments, the conjugated lipid that inhibits aggregation of particles is a CPL that has the formula: A-W—Y, wherein A is a lipid moiety, W is a hydrophilic polymer, and Y is a polycationic moiety. W may be a polymer selected from the group consisting of polyethyleneglycol (PEG), polyamide, polylactic acid, polyglycolic acid, polylactic acid/polyglycolic acid copolymers, or combinations thereof, the polymer having a molecular weight of from about 250 to about 7000 daltons. In some embodiments, Y has at least 4 positive charges at a selected pH. In some embodiments, Y may be lysine, arginine, asparagine, glutamine, derivatives thereof, or combinations thereof. The conjugated lipid that prevents aggregation of particles may be from 0 mol % to about 20 mol % or about 2 mol % of the total lipid present in the particle.

In some embodiments, the nucleic acid-lipid particle further comprises cholesterol at, e.g., about 10 mol % to about 60 mol %, about 30 mol % to about 50 mol %, or about 48 mol % of the total lipid present in the particle.

In certain embodiments, the siRNA molecule in the nucleic acid-lipid particle is not substantially degraded after exposure of the particle to a nuclease at 37° C. for at least 20, 30, 45, or 60 minutes; or after incubation of the particle in serum at 37° C. for at least 30, 45, or 60 minutes.

In some embodiments, the siRNA molecule is fully encapsulated in the nucleic acid-lipid particle. In other embodiments, the siRNA molecule is complexed with the lipid portion of the particle.

The present invention further provides pharmaceutical compositions comprising the nucleic acid-lipid particles described herein and a pharmaceutically acceptable carrier.

In yet another aspect, the siRNA molecule described herein is used in methods for silencing expression of a Filovirus gene such as L-pol, VP24, VP30, VP35, VP40, NP, and/or GP from Ebola virus or Marburg virus. In particular, it is an object of the present invention to provide in vitro and in vivo methods for treatment of a disease or disorder in a mammal by down-regulating or silencing the transcription and/or translation of a target Filovirus gene of interest. In one embodiment, the present invention provides a method for introducing an siRNA that silences expression (e.g., mRNA and/or protein levels) of a Filovirus gene into a cell by contacting the cell with an siRNA molecule described herein. In another embodiment, the present invention provides a method for in vivo delivery of an siRNA that silences expression of a Filovirus gene by administering to a mammal an siRNA molecule described herein. Administration of the siRNA molecule can be by any route known in the art, such as, e.g., oral, intranasal, intravenous, intraperitoneal, intramuscular, intra-articular, intralesional, intratracheal, subcutaneous, or intradermal.

In these methods, the siRNA molecule is typically formulated with a carrier system, and the carrier system comprising the siRNA molecule is administered to a mammal requiring such treatment. Examples of carrier systems suitable for use in the present invention include, but are not limited to, nucleic acid-lipid particles, liposomes, micelles, virosomes, nucleic acid complexes (e.g., lipoplexes, polyplexes, etc.), and mixtures thereof. Alternatively, cells are removed from a mammal such as a human, the siRNA molecule is delivered in vitro, and the cells are then administered to the mammal, such as by injection. The siRNA molecule may comprise at least one, two, three, four, five, six, seven, eight, nine, ten, or more of the sequences set forth in Tables 1-15 (e.g., Tables 1-13). Preferably, the siRNA molecule comprises at least one, two, three, four, five, six, seven, eight, nine, ten, or more of the sequences set forth in Tables 1-2, e.g., EK1, EK2, EK3, and/or EK4.

In some embodiments, the siRNA molecule is in a nucleic acid-lipid particle comprising the siRNA molecule, a cationic lipid, and a non-cationic lipid. Preferably, the siRNA molecule is in a nucleic acid-lipid particle comprising the siRNA molecule, a cationic lipid, a non-cationic lipid, and a conjugated lipid that inhibits aggregation of particles. A therapeutically effective amount of the nucleic acid-lipid particle can be administered to the mammalian subject (e.g., a rodent such as a mouse or a primate such as a human, chimpanzee, or monkey). In certain instances, the mammalian subject has been exposed to a second mammal infected with a Filovirus prior to administration of the particles. In certain other instances, the mammalian subject has been exposed to a fomite contaminated with a Filovirus prior to administration of the particles.

In another embodiment, at least about 1%, 2%, 4%, 6%, 8%, or 10% of the total administered dose of the nucleic acid-lipid particles is present in plasma at about 1, 2, 4, 6, 8, 12, 16, 18, or 24 hours after administration. In a further embodiment, more than about 20%, 30%, or 40% or as much as about 60%, 70%, or 80% of the total administered dose of the nucleic acid-lipid particles is present in plasma at about 1, 4, 6, 8, 10, 12, 20, or 24 hours after administration. In one embodiment, the effect of an siRNA molecule (e.g., down-regulation of the target Filovirus sequence) at a site proximal or distal to the site of administration is detectable at about 12, 24, 48, 72, or 96 hours, or at about 6, 8, 10, 12, 14, 16, 18, 19, 20, 22, 24, 26, or 28 days after administration of the nucleic acid-lipid particles. In another embodiment, downregulation of expression of the target Filovirus sequence is detectable at about 12, 24, 48, 72, or 96 hours, or at about 6, 8, 10, 12, 14, 16, 18, 19, 20, 22, 24, 26, or 28 days after administration. In certain instances, downregulation of expression of a Filovirus gene sequence is detected by measuring Filovirus mRNA or protein levels in a biological sample from the mammal. In certain other instances, downregulation of expression of a Filovirus gene sequence is detected by measuring Filovirus load in a biological sample from the mammal. In some embodiments, downregulation of expression of a Filovirus gene sequence is detected by monitoring symptoms associated with Filovirus infection in the mammal.

The nucleic acid-lipid particles are suitable for use in intravenous nucleic acid delivery as they are stable in circulation, of a size required for pharmacodynamic behavior resulting in access to extravascular sites, and target cell populations. The present invention also provides pharmaceutically acceptable compositions comprising nucleic acid-lipid particles.

Other objects, features, and advantages of the present invention will be apparent to one of skill in the art from the following detailed description and figures.

DETAILED DESCRIPTION OF THE INVENTION

I. Introduction

The present invention is based on the discovery that silencing Filovirus gene expression is an effective means to treat Filovirus (e.g., Ebola virus or Marburg virus) infection. Accordingly, the present invention provides siRNA molecules comprising a double-stranded sequence of about 15 to about 60 nucleotides in length that silence expression of a Filovirus gene (e.g., L-pol, VP24, VP30, VP35, VP40, NP, and/or GP). The present invention also provides nucleic acid-lipid particles that target Filovirus gene expression comprising an siRNA that silences Filovirus gene expression, a cationic lipid, and a non-cationic lipid. In certain instances, the nucleic acid-lipid particles can further comprise a conjugated lipid that inhibits aggregation of particles. The present invention further provides methods of silencing Filovirus gene expression by administering the siRNA molecules described herein to a mammalian subject. In addition, the present invention provides methods of treating a subject who has been exposed to Filovirus or is exhibiting symptoms of Filovirus infection by administering the siRNA molecules described herein.

II. Definitions

Figure 1:
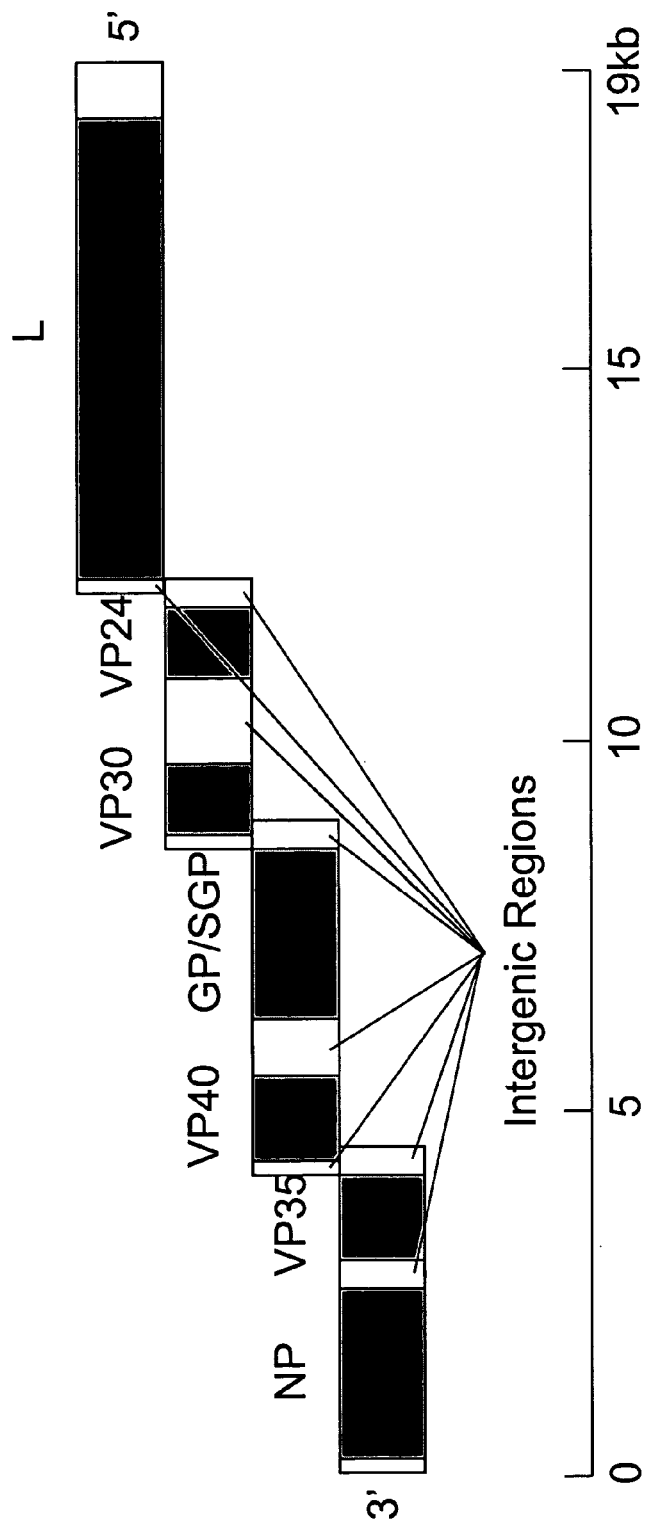
FIG. 1 illustrates the organization of the Ebola virus genome.

The term "Filovirus" or "Filoviridae" refers to single-stranded negative sense RNA viruses that typically infect primates. Filoviruses are able to multiply in virtually all cell types. The Filovirus antigens and virions are found primarily in fibroblasts and interstitium of an infected individual. There are two identified genera of Filoviruses: the Ebola viruses (four species) and the Marburg virus (Marburgvirus). The virions (viral particles) are characteristically shaped as long, cylindrical, filamentous particles which may be straight, curved, coiled, or found in a "6" or "U" shaped configuration. They are occasionally branched and the particles vary greatly in length, but the diameter (about 80 nm) is consistent. The filovirus genome comprises seven genes that encode 4 virion structural proteins (VP30, VP35, nucleoprotein, and a polymerase protein (L-pol)) and 3 membrane-associated proteins (VP40, glycoprotein (GP), and VP24). The GP gene is found fourth from the 3' end of the 7 linearly arranged genes. NP, VP30, VP35, and L-pol are required for viral replication and RNA translation. FIG. 1 shows the organization of the Ebola virus genome. Complete genome sequences for Ebola virus are set forth in, e.g., Genbank Accession Nos. NC_002549

(SEQ ID NO:1); AY769362; NC_006432; NC_004161; AY729654; AY354458; AY142960; AB050936; AF522874; AF499101; AF272001; and AF086833. Ebola virus VP24 sequences are set forth in, e.g., Genbank Accession Nos. U77385 and AY058897. Ebola virus L-pol sequences are set forth in, e.g., Genbank Accession No. X67110. Ebola virus VP40 sequences are set forth in, e.g., Genbank Accession No. AY058896. Ebola virus NP sequences are set forth in, e.g., Genbank Accession No. AY058895. Ebola virus GP sequences are set forth in, e.g., Genbank Accession No. AY058898; Sanchez et al., *Virus Res.,* 29: 215-240 (1993); Will et al., *J. Virol.,* 67: 1203-1210 (1993); Volchkov et al., *FEBS Lett.,* 305:181-184 (1992); and U.S. Pat. No. 6,713, 069. Additional Ebola virus sequences are set forth in, e.g., Genbank Accession Nos. L11365 and X61274. Complete genome sequences for Marburg virus are set forth in, e.g., Genbank Accession Nos. NC_001608 (SEQ ID NO:2); AY430365; AY430366; and AY358025. Marburg virus GP sequences are set forth in, e.g., Genbank Accession Nos. AF005734; AF005733; and AF005732. Marburg virus VP35 sequences are set forth in, e.g., Genbank Accession Nos. AF005731 and AF005730. Additional Marburg virus sequences are set forth in, e.g., Genbank Accession Nos. X64406; Z29337; AF005735; and Z12132.

The term "interfering RNA" or "RNAi" or "interfering RNA sequence" refers to double-stranded RNA (i.e., duplex RNA) that targets (i.e., silences, reduces, or inhibits) expression of a target gene (i.e., by mediating the degradation of mRNAs which are complementary to the sequence of the interfering RNA) when the interfering RNA is in the same cell as the target gene. Interfering RNA thus refers to the double-stranded RNA formed by two complementary strands or by a single, self-complementary strand. Interfering RNA typically has substantial or complete identity to the target gene. The sequence of the interfering RNA can correspond to the full length target gene, or a subsequence thereof.

Interfering RNA includes "small-interfering RNA" or "siRNA," i.e., interfering RNA of about 15-60, 15-50, 15-50, or 15-40 (duplex) nucleotides in length, more typically about 15-30, 15-25, or 19-25 (duplex) nucleotides in length, and is preferably about 20-24, 21-22, or 21-23 (duplex) nucleotides in length (e.g., each complementary sequence of the double-stranded siRNA is about 15-60, 15-50, 15-50, 15-40, 15-30, 15-25, or 19-25 nucleotides in length, preferably about 20-24, 21-22, or 21-23 nucleotides in length, and the double-stranded siRNA is about 15-60, 15-50, 15-50, 15-40, 15-30, 15-25, or 19-25 base pairs in length, preferably about 20-24, 21-22, or 21-23 base pairs in length). siRNA duplexes may comprise 3' overhangs of about 1 to about 4 nucleotides, preferably of about 2 to about 3 nucleotides and 5' phosphate termini. Examples of siRNA include, without limitation, a double-stranded polynucleotide molecule assembled from two separate oligonucleotides, wherein one strand is the sense strand and the other is the complementary antisense strand; a double-stranded polynucleotide molecule assembled from a single oligonucleotide, where the sense and antisense regions are linked by a nucleic acid-based or non-nucleic acid-based linker; a double-stranded polynucleotide molecule with a hairpin secondary structure having self-complementary sense and antisense regions; and a circular single-stranded polynucleotide molecule with two or more loop structures and a stem having self-complementary sense and antisense regions, where the circular polynucleotide can be processed in vivo or in vitro to generate an active double-stranded siRNA molecule.

The siRNA can be chemically synthesized or may be encoded by a plasmid (e.g., transcribed as sequences that automatically fold into duplexes with hairpin loops). siRNA can also be generated by cleavage of longer dsRNA (e.g., dsRNA greater than about 25 nucleotides in length) with the *E coli* RNase III or Dicer. These enzymes process the dsRNA into biologically active siRNA (see, e.g., Yang et al., *PNAS USA,* 99:9942-9947 (2002); Calegari et al., *PNAS USA,* 99:14236 (2002); Byrom et al., *Ambion TechNotes,* 10(1): 4-6 (2003); Kawasaki et al., *Nucleic Acids Res.,* 31: 981-987 (2003); Knight and Bass, *Science,* 293: 2269-2271 (2001); and Robertson et al., *J. Biol. Chem.,* 243: 82 (1968)). Preferably, dsRNA are at least 50 nucleotides to about 100, 200, 300, 400, or 500 nucleotides in length. A dsRNA may be as long as 1000, 1500, 2000, or 5000 nucleotides in length, or longer. The dsRNA can encode for an entire gene transcript or a partial gene transcript.

"Substantial identity" refers to a sequence that hybridizes to a reference sequence under stringent conditions, or to a sequence that has a specified percent identity over a specified region of a reference sequence.

The phrase "stringent hybridization conditions" refers to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, *Techniques in Biochemistry and Molecular Biology—Hybridization with Nucleic Probes*, "Overview of principles of hybridization and the strategy of nucleic acid assay"(1993). Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization.

Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C. For PCR, a temperature of about 36° C. is typical for low stringency amplification, although annealing temperatures may vary between about 32° C. and 48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90° C.-95° C. for 30 sec-2 min., an annealing phase lasting 30 sec.-2 min., and an extension phase of about 72° C. for 1-2 min. Protocols and guidelines for low and high stringency amplification reactions are provided, e.g., in Innis et al. (1990) *PCR Protocols, A Guide to Methods and Applications*, Academic Press, Inc. N.Y.).

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Those of ordinary skill will readily recognize that alternative hybridization and wash conditions can be utilized to provide conditions of similar stringency. Additional guidelines for determining hybridization parameters are provided in numerous references, e.g., Current Protocols in Molecular Biology, Ausubel, et al., eds.

The terms "substantially identical" or "substantial identity," in the context of two or more nucleic acids, refer to two or more sequences or subsequences that are the same or have a specified percentage of nucleotides that are the same (i.e., at least about 60%, preferably 65%, 70%, 75%, preferably 80%, 85%, 90%, or 95% identity over a specified region), when compared and aligned for maximum correspondence over a comparison window, or designated region as measured using one of the following sequence comparison algorithms or by manual alignment and visual inspection. This definition, when the context indicates, also refers analogously to the complement of a sequence. Preferably, the substantial identity exists over a region that is at least about 5, 10, 15, 20, 25, 30, 35, 40, 45, 50, 75, or 100 nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window," as used herein, includes reference to a segment of any one of a number of contiguous positions selected from the group consisting of from 20 to 600, usually about 50 to about 200, more usually about 100 to about 150, in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith and Waterman, *Adv. Appl. Math.,* 2:482 (1981), by the homology alignment algorithm of Needleman and Wunsch, *J. Mol. Biol.,* 48:443 (1970), by the search for similarity method of Pearson and Lipman, *Proc. Nat'l Acad. Sci. USA,* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology,* Ausubel et al., eds. (1995 supplement)).

A preferred example of algorithms that are suitable for determining percent sequence identity and sequence similarity are the BLAST and BLAST 2.0 algorithms, which are described in Altschul et al., *Nuc. Acids Res.,* 25:3389-3402 (1977) and Altschul et al., *J. Mol. Biol.,* 215:403-410 (1990), respectively. BLAST and BLAST 2.0 are used with the parameters described herein to determine percent sequence identity for the nucleic acids and proteins of the present invention. Software for performing BLAST analyses is publicly available through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, *Proc. Natl. Acad. Sci. USA* 89:10915 (1989)) alignments (B) of 50, expectation (E) of 10, M=5, N=−4, and a comparison of both strands.

The BLAST algorithm also performs a statistical analysis of the similarity between two sequences (see, e.g., Karlin and Altschul, *Proc. Nat'l. Acad. Sci., USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The phrase "inhibiting expression of a target gene" refers to the ability of an siRNA molecule of the present invention to silence, reduce, or inhibit expression of a target gene (e.g., a Filovirus gene). To examine the extent of gene silencing, a test sample (e.g., a biological sample from an organism of interest expressing the target gene or a sample of cells in culture expressing the target gene) is contacted with an siRNA that silences, reduces, or inhibits expression of the target gene. Expression of the target gene in the test sample is compared to expression of the target gene in a control sample that is not contacted with the siRNA. Control samples are assigned a value of 100%. Silencing, inhibition, or reduction of expression of a target gene is achieved when the value of test the test sample relative to the control sample is about 95%, 90%, 85%, 80%, 75%, 70%, 65%, 60%, 55%, 50%, 45%, 40%, 35%, 30%, 25%, 20%, or 10%. Suitable assays include, e.g., examination of protein or mRNA levels using techniques known to those of skill in the art such as dot blots, Northern blots, in situ hybridization, ELISA, immunoprecipitation, enzyme function, as well as phenotypic assays known to those of skill in the art.

The term "nucleic acid" or "polynucleotide" refers to a polymer containing at least two deoxyribonucleotides or ribonucleotides in either single- or double-stranded form and include DNA and RNA. DNA may be in the form of, e.g., antisense oligonucleotides, plasmid DNA, pre-condensed DNA, a PCR product, vectors (P1, PAC, BAC, YAC, artificial chromosomes), expression cassettes, chimeric sequences, chromosomal DNA, or derivatives and combinations of these groups. RNA may be in the form of siRNA, mRNA, rRNA, tRNA, vRNA, and combinations thereof. The term encompasses nucleic acids containing known nucleotide analogs or modified backbone residues or linkages which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2'-O-methyl ribonucleotides, and peptide-nucleic acids (PNAs). Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.*, 19:5081 (1991); Ohtsuka et al., *J. Biol. Chem.*, 260:2605-2608 (1985); Rossolini et al., *Mol. Cell. Probes*, 8:91-98 (1994)). "Nucleotides" contain a sugar deoxyribose (DNA) or ribose (RNA), a base, and a phosphate group. Nucleotides are linked together through the phosphate groups. "Bases" include purines and pyrimidines, which further include natural compounds adenine, thymine, guanine, cytosine, uracil, inosine, and natural analogs, and synthetic derivatives of purines and pyrimidines, which include, but are not limited to, modifications which place new reactive groups such as, but not limited to, amines, alcohols, thiols, carboxylates, and alkylhalides.

The term "gene" refers to a nucleic acid (e.g., DNA or RNA) sequence that comprises partial length or entire length coding sequences necessary for the production of a polypeptide or precursor (e.g., Ebola virus or Marburg virus L-pol, VP24, VP30, VP35, VP40, NP, or GP).

"Gene product," as used herein, refers to a product of a gene such as an RNA transcript.

An "effective amount" or "therapeutically effective amount" of an siRNA molecule is an amount sufficient to produce the desired effect, e.g., a decrease in the expression of a target sequence, in comparison to the normal expression level detected in the absence of the siRNA molecule.

The term "lipid" refers to a group of organic compounds that include, but are not limited to, esters of fatty acids and are characterized by being insoluble in water, but soluble in many organic solvents. They are usually divided into at least three classes: (1) "simple lipids" which include fats and oils as well as waxes; (2) "compound lipids" which include phospholipids and glycolipids; and (3) "derived lipids" such as steroids.

"Lipid vesicle" refers to any lipid composition that can be used to deliver a compound such as an siRNA including, but not limited to, liposomes, wherein an aqueous volume is encapsulated by an amphipathic lipid bilayer; or wherein the lipids coat an interior comprising a large molecular component, such as a plasmid comprising an interfering RNA sequence, with a reduced aqueous interior; or lipid aggregates or micelles, wherein the encapsulated component is contained within a relatively disordered lipid mixture. The term lipid vesicle encompasses any of a variety of lipid-based carrier systems including, without limitation, SPLPs, pSPLPs, SNALPs, liposomes, micelles, virosomes, lipid-nucleic acid complexes, and mixtures thereof.

As used herein, "lipid encapsulated" can refer to a lipid formulation that provides a compound such as an siRNA with full encapsulation, partial encapsulation, or both. In some embodiments, the nucleic acid is fully encapsulated in the lipid formulation (e.g., to form an SPLP, pSPLP, SNALP, or other nucleic acid-lipid particle).

As used herein, the term "SNALP" refers to a stable nucleic acid-lipid particle, including SPLP. A SNALP represents a vesicle of lipids coating a reduced aqueous interior comprising a nucleic acid (e.g., siRNA, ssDNA, dsDNA, ssRNA, micro RNA (miRNA), short hairpin RNA (shRNA), dsRNA, or a plasmid, including plasmids from which an interfering RNA is transcribed). As used herein, the term "SPLP" refers to a nucleic acid-lipid particle comprising a nucleic acid (e.g., a plasmid) encapsulated within a lipid vesicle. SNALPs and SPLPs typically contain a cationic lipid, a non-cationic lipid, and a lipid that prevents aggregation of the particle (e.g., a PEG-lipid conjugate). SNALPs and SPLPs are extremely useful for systemic applications, as they exhibit extended circulation lifetimes following intravenous (i.v.) injection, accumulate at distal sites (e.g., sites physically separated from the administration site) and can mediate expression of the transfected gene at these distal sites. SPLPs include "pSPLP," which comprise an encapsulated condensing agent-nucleic acid complex as set forth in PCT Publication No. WO 00/03683.

The nucleic acid-lipid particles of the present invention typically have a mean diameter of about 50 nm to about 150 nm, more typically about 60 nm to about 130 nm, more typically about 70 nm to about 110 nm, most typically about 70 to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; and WO 96/40964.

The term "vesicle-forming lipid" is intended to include any amphipathic lipid having a hydrophobic moiety and a polar head group, and which by itself can form spontaneously into bilayer vesicles in water, as exemplified by most phospholipids.

The term "vesicle-adopting lipid" is intended to include any amphipathic lipid that is stably incorporated into lipid bilayers in combination with other amphipathic lipids, with its hydrophobic moiety in contact with the interior, hydrophobic region of the bilayer membrane, and its polar head group moiety oriented toward the exterior, polar surface of the membrane. Vesicle-adopting lipids include lipids that on their own tend to adopt a nonlamellar phase, yet which are capable of assuming a bilayer structure in the presence of a bilayer-stabilizing component. A typical example is dioleoylphosphatidylethanolamine (DOPE). Bilayer stabilizing components include, but are not limited to, conjugated lipids that inhibit aggregation of nucleic acid-lipid particles, polyamide oligomers (e.g., ATTA-lipid derivatives), peptides, proteins, detergents, lipid-derivatives, PEG-lipid derivatives such as PEG coupled to dialkyloxypropyls, PEG coupled to diacylglycerols, PEG coupled to phosphatidyl-ethanolamines, PEG conjugated to ceramides (see, e.g., U.S. Pat. No. 5,885,613), cationic PEG lipids, and mixtures thereof. PEG can be conjugated directly to the lipid or may be linked to the lipid via a linker moiety. Any linker moiety suitable for coupling the PEG to a lipid can be used including, e.g., non-ester containing linker moieties and ester-containing linker moieties.

The term "amphipathic lipid" refers, in part, to any suitable material wherein the hydrophobic portion of the lipid material orients into a hydrophobic phase, while the hydrophilic portion orients toward the aqueous phase. Amphipathic lipids are usually the major component of a lipid vesicle. Hydrophilic characteristics derive from the presence of polar or charged groups such as carbohydrates, phosphate, carboxylic, sulfato, amino, sulfhydryl, nitro, hydroxyl, and other like groups. Hydrophobicity can be conferred by the inclusion of apolar groups that include, but are not limited to, long chain saturated and unsaturated aliphatic hydrocarbon groups and such groups substituted by one or more aromatic, cycloaliphatic, or heterocyclic group(s). Examples of amphipathic compounds include, but are not limited to, phospholipids, aminolipids and sphingolipids. Representative examples of phospholipids include, but are not limited to, phosphatidylcholine, phosphatidylethanolamine, phosphatidylserine, phosphatidylinositol, phosphatidic acid, palmitoyloleoyl phosphatidylcholine, lysophosphatidylcholine, lysophosphatidylethanolamine, dipalmitoylphosphatidylcholine, dioleoylphosphatidylcholine, distearoylphosphatidylcholine, and dilinoleoylphosphatidylcholine. Other compounds lacking in phosphorus, such as sphingolipid, glycosphingolipid families, diacylglycerols, and β-acyloxyacids, are also within the group designated as amphipathic lipids. Additionally, the amphipathic lipid described above can be mixed with other lipids including triglycerides and sterols.

The term "neutral lipid" refers to any of a number of lipid species that exist either in an uncharged or neutral zwitterionic form at a selected pH. At physiological pH, such lipids include, for example, diacylphosphatidylcholine, diacylphosphatidylethanolamine, ceramide, sphingomyelin, cephalin, cholesterol, cerebrosides, and diacylglycerols.

The term "non-cationic lipid" refers to any neutral lipid as described above as well as anionic lipids.

The term "anionic lipid" refers to any lipid that is negatively charged at physiological pH. These lipids include, but are not limited to, phosphatidylglycerols, cardiolipins, diacylphosphatidylserines, diacylphosphatidic acids, N-dodecanoyl phosphatidylethanolamines, N-succinyl phosphatidylethanolamines, N-glutarylphosphatidylethanolamines, lysylphosphatidylglycerols, palmitoyloleyolphosphatidylglycerol (POPG), and other anionic modifying groups joined to neutral lipids.

Various suitable cationic lipids may be used in the present invention, either alone or in combination with one or more other cationic lipid species or non-cationic lipid species.

The term "cationic lipid" refers to any of a number of lipid species that carry a net positive charge at a selected pH, such as physiological pH (e.g., pH of about 7.0). It has been surprisingly found that cationic lipids comprising alkyl chains with multiple sites of unsaturation, e.g., at least two or three sites of unsaturation, are particularly useful for forming nucleic acid-lipid particles with increased membrane fluidity. A number of cationic lipids and related analogs, which are also useful in the present invention, are described in U.S. Patent Publication No. 20060083780; U.S. Pat. Nos. 5,208,036; 5,264,618; 5,279,833; 5,283,185; 5,753,613; and 5,785,992; and PCT Publication No. WO 96/10390. Examples of cationic lipids include, but are not limited to, N,N-dioleyl-N,N-dimethylammonium chloride (DODAC), dioctadecyldimethylammonium (DODMA), distearyldimethylammonium (DSDMA), N-(1-(2,3-dioleyloxy)propyl)-N,N,N-trimethylammonium chloride (DOTMA), N,N-distearyl-N,N-dimethylammonium bromide (DDAB), N-(1-(2,3-dioleoyloxy)propyl)-N,N,N-trimethylammonium chloride (DOTAP), 3-(N—(N',N'-dimethylaminoethane)-carbamoyl)cholesterol (DC-Chol), N-(1,2-dimyristyloxyprop-3-yl)-N,N-dimethyl-N-hydroxyethyl ammonium bromide (DMRIE), 1,2-DiLinoleyloxy-N,N-dimethylaminopropane (DLinDMA), 1,2-Dilinolenyloxy-N,N-dimethylaminopropane (DLenDMA), and mixtures thereof. As a non-limiting example, cationic lipids that have a positive charge below physiological pH include, but are not limited to, DODAP, DODMA, and DMDMA. In some cases, the cationic lipids comprise a protonatable tertiary amine head group, $C_{1-8}$ alkyl chains, ether linkages between the head group and alkyl chains, and 0 to 3 double bonds. Such lipids include, e.g., DSDMA, DLinDMA, DLenDMA, and DODMA. The cationic lipids may also comprise ether linkages and pH titratable head groups. Such lipids include, e.g., DODMA.

The term "hydrophobic lipid" refers to compounds having apolar groups that include, but are not limited to, long chain saturated and unsaturated aliphatic hydrocarbon groups and such groups optionally substituted by one or more aromatic, cycloaliphatic, or heterocyclic group(s). Suitable examples include, but are not limited to, diacylglycerol, dialkylglycerol, N—N-dialkylamino, 1,2-diacyloxy-3-aminopropane, and 1,2-dialkyl-3-aminopropane.

The term "fusogenic" refers to the ability of a liposome, a SNALP, or other drug delivery system to fuse with membranes of a cell. The membranes can be either the plasma membrane or membranes surrounding organelles, e.g., endosome, nucleus, etc.

As used herein, the term "aqueous solution" refers to a composition comprising in whole, or in part, water.

As used herein, the term "organic lipid solution" refers to a composition comprising in whole, or in part, an organic solvent having a lipid.

"Distal site," as used herein, refers to a physically separated site, which is not limited to an adjacent capillary bed, but includes sites broadly distributed throughout an organism.

"Serum-stable" in relation to nucleic acid-lipid particles means that the particle is not significantly degraded after exposure to a serum or nuclease assay that would significantly degrade free DNA or RNA. Suitable assays include, for example, a standard serum assay, a DNAse assay, or an RNAse assay.

"Systemic delivery," as used herein, refers to delivery that leads to a broad biodistribution of a compound such as an siRNA within an organism. Some techniques of administration can lead to the systemic delivery of certain compounds, but not others. Systemic delivery means that a useful, preferably therapeutic, amount of a compound is exposed to most parts of the body. To obtain broad biodistribution generally requires a blood lifetime such that the compound is not rapidly degraded or cleared (such as by first pass organs (liver, lung, etc.) or by rapid, nonspecific cell binding) before reaching a disease site distal to the site of administration. Systemic delivery of nucleic acid-lipid particles can be by any means known in the art including, for example, intravenous, subcutaneous, and intraperitoneal. In some embodiments, systemic delivery of nucleic acid-lipid particles is by intravenous delivery.

"Local delivery," as used herein, refers to delivery of a compound such as an siRNA directly to a target site within an organism. For example, a compound can be locally delivered by direct injection into a disease site such as a tumor or other target site such as a site of inflammation or a target organ such as the liver, heart, pancreas, kidney, and the like.

The term "mammal" refers to any mammalian species such as a human, mouse, rat, dog, cat, hamster, guinea pig, rabbit, livestock, and the like.

"Fomite" as used herein refers to any inanimate object that when contaminated with a viable pathogen (e.g., a Filovirus) can transfer the pathogen to a host. Typical fomites include, e.g., hospital and clinic waiting and examination room surfaces (e.g., floors, walls, ceilings, curtains, carpets), needles, syringes, scalpels, catheters, brushes, stethoscopes, laryngoscopes, thermometers, tables, bedding, towels, eating utensils, and the like.

III. siRNAs

The present invention provides an interfering RNA that silences (e.g., partially or completely inhibits) expression of a gene of interest (i.e., a Filovirus gene). An interfering RNA can be provided in several forms. For example, an interfering RNA can be provided as one or more isolated small-interfering RNA (siRNA) duplexes, longer double-stranded RNA (dsRNA), or as siRNA or dsRNA transcribed from a transcriptional cassette in a DNA plasmid. The interfering RNA may also be chemically synthesized. The interfering RNA can be administered alone or co-administered (i.e., concurrently or consecutively) with conventional agents used to treat a Filovirus infection.

In one aspect, the interfering RNA is an siRNA molecule that is capable of silencing expression of a target sequence (e.g., RNA-dependent polymerase (L-pol); glycoprotein (GP); nucleoprotein (NP); viral proteins VP24, VP30, VP35, and VP40) from an Ebola virus or Marburg virus. Suitable siRNA sequences are set forth in, e.g., Tables 1-15, preferably Tables 1-13. Particularly preferred siRNA sequences are set forth in Tables 1-2 (e.g., Ebola L-pol siRNA sequences EK1, EK2, EK3, and/or EK4). For any of the sequences set forth in Tables 1-15, thymine (i.e., "T") can substituted with uracil (i.e., "U") and uracil can be substituted with thymine. In some embodiments, the siRNA molecules are about 15 to 60 nucleotides in length. The synthesized or transcribed siRNA can have 3' overhangs of about 1-4 nucleotides, preferably of about 2-3 nucleotides, and 5' phosphate termini. In some embodiments, the siRNA lacks terminal phosphates.

In certain embodiments, the siRNA molecules of the present invention (e.g., the siRNA sequences set forth in Tables 1-15) are chemically modified as described herein. In certain preferred embodiments, the siRNA molecules of the present invention (e.g., the siRNA sequences set forth in Tables 1-15) comprise less than about 20% modified nucleotides (see, U.S. Provisional Patent Application Nos. 60/711,494 and 60/817,933). The modified siRNA molecule is notably less immunostimulatory than a corresponding unmodified siRNA sequence and retains full RNAi activity against the target sequence. Preferably, the modified siRNA contains at least one 2'OMe purine or pyrimidine nucleotide such as a 2'OMe-guanosine, 2'OMe-uridine, 2'OMe-adenosine, and/or 2'OMe-cytosine nucleotide. The modified nucleotides can be present in one strand (i.e., sense or antisense) or both strands of the siRNA.

Importantly, siRNA molecules that are immunostimulatory can be modified to decrease their immunostimulatory properties without having a negative impact on RNAi activity. For example, an immunostimulatory siRNA can be modified by replacing one or more nucleotides in the sense and/or antisense strand with a modified nucleotide, thereby generating a modified siRNA with reduced immunostimulatory properties that is still capable of silencing expression of the target sequence. In preferred embodiments, one or more of the uridine and/or guanosine nucleotides are modified. Preferably, the modified nucleotide is a 2'OMe nucleotide such as a 2'OMe-guanosine, 2'OMe-uridine, and/or 2'OMe-adenosine nucleotide.

It is also preferred that the modified siRNA comprises less than about 20% modified nucleotides (e.g., less than about 20%, 19%, 18%, 17%, 16%, 15%, 14%, 13%, 12%, 11%, 10%, 9%, 8%, 7%, 6%, 5%, 4%, 3%, 2%, or 1% modified nucleotides) or between about 1%-20% modified nucleotides (e.g., between about 1%-20%, 2%-20%, 3%-20%, 4%-20%, 5%-20%, 6%-20%, 7%-20%, 8%-20%, 9%-20%, 10%-20%, 11%-20%, 12%-20%, 13%-20%, 14%-20%, 15-20%, 16%-20%, 17%-20%, 18%-20%, or 19%-20% modified nucleotides). However, when one or both strands of the siRNA are selectively modified at uridine and/or guanosine nucleotides, the resulting modified siRNA molecule can comprise less than about 25% modified nucleotides (e.g., less than about 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1% modified nucleotides) or between about 1%-25% modified nucleotides (e.g., between about 1%-25%, 2%-25%, 3%-25%, 4%-25%, 5%-25%, 6%-25%, 7%-25%, 8%-25%, 9%-25%, 10%-25%, 11%-25%, 12%-25%, 13%-25%, 14%-25%, 15-25%, 16%-25%, 17%-25%, 18%-25%, 19%-25%, 20%-25%, 21%-25%, 22%-25%, 23%-25%, or 24%-25% modified nucleotides).

A. Selection of siRNA Sequences

Suitable siRNA sequences can be identified using any means known in the art. Typically, the methods described in Elbashir et al., *Nature,* 411:494-498 (2001) and Elbashir et al., *EMBO J,* 20:6877-6888 (2001) are combined with rational design rules set forth in Reynolds et al., *Nature Biotech.,* 22(3):326-330 (2004).

Generally, the sequence within about 50 to about 100 nucleotides 3' of the AUG start codon of a transcript from the target gene of interest is scanned for dinucleotide sequences (e.g., AA, NA, CC, GG, or UU, wherein N=C, G, or U) (see, e.g., Elbashir et al., *EMBO J.* 20:6877-6888 (2001)). The nucleotides immediately 3' to the dinucleotide sequences are identified as potential siRNA target sequences. Typically, the 19, 21, 23, 25, 27, 29, 31, 33, 35, or more nucleotides immediately 3' to the dinucleotide sequences are identified as potential siRNA target sites. In some embodiments, the dinucleotide sequence is an AA or NA sequence and the 19 nucleotides immediately 3' to the AA or NA dinucleotide are identified as a potential siRNA target site. siRNA target sites are usually spaced at different positions along the length of the target gene. To further enhance silencing efficiency of the siRNA sequences, potential siRNA target sites may be analyzed to identify sites that do not contain regions of homology to other coding sequences, e.g., in the target cell or organism. For example, a suitable siRNA target site of about 21 base pairs typically will not have more than 16-17 contiguous base pairs of homology to coding sequences in the target cell or organism. If the siRNA sequences are to be expressed from an RNA Pol III promoter, siRNA target sequences lacking more than 4 contiguous A's or T's are selected.

Once a potential siRNA sequence has been identified, the sequence can be analyzed using a variety of criteria known in the art. For example, to enhance their silencing efficiency, the siRNA sequences may be analyzed by a rational design algorithm to identify sequences that have one or more of the following features: (1) G/C content of about 25% to about 60% G/C; (2) at least 3 A/Us at positions 15-19 of the sense strand; (3) no internal repeats; (4) an A at position 19 of the sense strand; (5) an A at position 3 of the sense strand; (6) a U at position 10 of the sense strand; (7) no G/C at position 19 of the sense strand; and (8) no G at position 13 of the sense strand. siRNA design tools that incorporate algorithms that assign suitable values of each of these features and are useful for selection of siRNA can be found at, e.g., http://boz094.ust.hk/RNAi/siRNA. One of skill in the art will appreciate that sequences with one or more of the foregoing characteristics may be selected for further analysis and testing as potential siRNA sequences. siRNA sequences complementary to the siRNA target sites may also be designed.

Additionally, potential siRNA target sequences with one or more of the following criteria can often be eliminated as siRNA: (1) sequences comprising a stretch of 4 or more of the same base in a row; (2) sequences comprising homopolymers of Gs (i.e., to reduce possible non-specific effects due to structural characteristics of these polymers; (3) sequences comprising triple base motifs (e.g., GGG, CCC, AAA, or TTT); (4) sequences comprising stretches of 7 or more G/Cs in a row; and (5) sequences comprising direct repeats of 4 or more bases within the candidates resulting in internal foldback structures. However, one of skill in the art will appreciate that sequences with one or more of the foregoing characteristics may still be selected for further analysis and testing as potential siRNA sequences.

In some embodiments, potential siRNA target sequences may be further analyzed based on siRNA duplex asymmetry as described in, e.g., Khvorova et al., Cell, 115:209-216 (2003); and Schwarz et al., Cell, 115:199-208 (2003). In other embodiments, potential siRNA target sequences may be further analyzed based on secondary structure at the mRNA target site as described in, e.g., Luo et al., Biophys. Res. Commun., 318:303-310 (2004). For example, mRNA secondary structure can be modeled using the Mfold algorithm (available at http://www.bioinfo.rpi.edu/applications/mfold/ma/forml.cgi) to select siRNA sequences which favor accessibility at the mRNA target site where less secondary structure in the form of base-pairing and stem-loops is present.

Once a potential siRNA sequence has been identified, the sequence can be analyzed for the presence of any immunostimulatory properties, e.g., using an in vitro cytokine assay or an in vivo animal model. Motifs in the sense and/or antisense strand of the siRNA sequence such as GU-rich motifs can also provide an indication of whether the sequence may be immunostimulatory. Once an siRNA molecule is found to be immunostimulatory, it can then be modified to decrease its immunostimulatory properties as described herein. As a non-limiting example, an siRNA sequence can be contacted with a mammalian responder cell under conditions such that the cell produces a detectable immune response to determine whether the siRNA is an immunostimulatory or a non-immunostimulatory siRNA. The mammalian responder cell may be from a naïve mammal (i.e., a mammal that has not previously been in contact with the gene product of the siRNA sequence). The mammalian responder cell may be, e.g., a peripheral blood mononuclear cell (PBMC), a macrophage, and the like. The detectable immune response may comprise production of a cytokine or growth factor such as, e.g., TNF-$\alpha$, TNF-$\beta$, IFN-$\alpha$, IFN-$\gamma$, IL-6, IL-12, or a combination thereof. An siRNA molecule identified as being immunostimulatory can then be modified to decrease its immunostimulatory properties by replacing at least one of the nucleotides on the sense and/or antisense strand with modified nucleotides. For example, less than about 20% of the nucleotides in the siRNA duplex can be replaced with modified nucleotides such as 2'OMe nucleotides. The modified siRNA can then be contacted with a mammalian responder cell as described above to confirm that its immunostimulatory properties have been reduced or abrogated.

Suitable in vitro assays for detecting an immune response include, but are not limited to, the double monoclonal antibody sandwich immunoassay technique of David et al. (U.S. Pat. No. 4,376,110); monoclonal-polyclonal antibody sandwich assays (Wide et al., in Kirkham and Hunter, eds., Radioimmunoassay Methods, E. and S. Livingstone, Edinburgh (1970)); the "Western blot" method of Gordon et al. (U.S. Pat. No. 4,452,901); immunoprecipitation of labeled ligand (Brown et al., J. Biol. Chem., 255:4980-4983 (1980)); enzyme-linked immunosorbent assays (ELISA) as described, for example, by Raines et al., J. Biol. Chem., 257:5154-5160 (1982); immunocytochemical techniques, including the use of fluorochromes (Brooks et al., Clin. Exp. Immunol., 39:477 (1980)); and neutralization of activity (Bowen-Pope et al., Proc. Natl. Acad. Sci. USA, 81:2396-2400 (1984)). In addition to the immunoassays described above, a number of other immunoassays are available, including those described in U.S. Pat. Nos. 3,817,827; 3,850,752; 3,901,654; 3,935,074; 3,984,533; 3,996,345; 4,034,074; and 4,098,876.

A non-limiting example of an in vivo model for detecting an immune response includes an in vivo mouse cytokine induction assay that can be performed as follows: (1) siRNA can be administered by standard intravenous injection in the lateral tail vein; (2) blood can be collected by cardiac puncture about 6 hours after administration and processed as plasma for cytokine analysis; and (3) cytokines can be quantified using sandwich ELISA kits according to the manufacturers' instructions (e.g., mouse and human IFN-$\alpha$ (PBL Biomedical; Piscataway, N.J.); human IL-6 and TNF-$\alpha$ (eBioscience; San Diego, Calif.); and mouse IL-6, TNF-$\alpha$, and IFN-$\gamma$ (BD Biosciences; San Diego, Calif.)).

Monoclonal antibodies that specifically bind cytokines and growth factors are commercially available from multiple sources and can be generated using methods known in the art (see, e.g., Kohler and Milstein, Nature, 256: 495-497 (1975); and Harlow and Lane, ANTIBODIES, A LABORATORY MANUAL, Cold Spring Harbor Publication, New York (1999)). Generation of monoclonal antibodies has been previously described and can be accomplished by any means known in the art (see, e.g., Buhring et al. in Hybridoma, Vol. 10, No. 1, pp. 77-78 (1991)). In some methods, the monoclonal antibody is labeled (e.g., with any composition detectable by spectroscopic, photochemical, biochemical, electrical, optical, chemical means, and the like) to facilitate detection.

B. Generating siRNA siRNA molecules can be provided in several forms including, e.g., as one or more isolated small-interfering RNA (siRNA) duplexes, as longer double-stranded RNA (dsRNA), or as siRNA or dsRNA transcribed from a transcriptional cassette in a DNA plasmid. The siRNA sequences may have overhangs (e.g., 3' or 5' overhangs as described in Elbashir et al., Genes Dev., 15:188 (2001) or Nykänen et al., Cell, 107: 309 (2001), or may lack overhangs (i.e., have blunt ends).

An RNA population can be used to provide long precursor RNAs, or long precursor RNAs that have substantial or complete identity to a selected target sequence can be used to make the siRNA. The RNAs can be isolated from cells or tissue, synthesized, and/or cloned according to methods well known to those of skill in the art. The RNA can be a mixed population (obtained from cells or tissue, transcribed from cDNA, subtracted, selected, etc.), or can represent a single target sequence. RNA can be naturally occurring (e.g., isolated from tissue or cell samples), synthesized in vitro (e.g., using T7 or SP6 polymerase and PCR products or a cloned cDNA), or chemically synthesized.

To form a long dsRNA, for synthetic RNAs, the complement is also transcribed in vitro and hybridized to form a dsRNA. If a naturally occuring RNA population is used, the RNA complements are also provided (e.g., to form dsRNA for digestion by E. coli RNAse III or Dicer), e.g., by transcribing cDNAs corresponding to the RNA population, or by using RNA polymerases. The precursor RNAs are then hybridized to form double stranded RNAs for digestion. The dsRNAs can be directly administered to a subject or can be digested in vitro prior to administration.

Alternatively, one or more DNA plasmids encoding one or more siRNA templates are used to provide siRNA. siRNA can be transcribed as sequences that automatically fold into duplexes with hairpin loops from DNA templates in plasmids having RNA polymerase III transcriptional units, for example, based on the naturally occurring transcription units for small nuclear RNA U6 or human RNase P RNA H1 (see, Brummelkamp et al., *Science*, 296:550 (2002); Donzé et al., *Nucleic Acids Res.*, 30:e46 (2002); Paddison et al., *Genes Dev.*, 16:948 (2002); Yu et al., *Proc. Natl. Acad. Sci. USA*, 99:6047 (2002); Lee et al., *Nat. Biotech.*, 20:500 (2002); Miyagishi et al., *Nat. Biotech.*, 20:497 (2002); Paul et al., *Nat. Biotech.*, 20:505 (2002); and Sui et al., *Proc. Natl. Acad. Sci. USA*, 99:5515 (2002)). Typically, a transcriptional unit or cassette will contain an RNA transcript promoter sequence, such as an H1-RNA or a U6 promoter, operably linked to a template for transcription of a desired siRNA sequence and a termination sequence, comprised of 2-3 uridine residues and a polythymidine (T5) sequence (polyadenylation signal) (Brummelkamp et al., supra). The selected promoter can provide for constitutive or inducible transcription. Compositions and methods for DNA-directed transcription of RNA interference molecules is described in detail in U.S. Pat. No. 6,573,099. The transcriptional unit is incorporated into a plasmid or DNA vector from which the interfering RNA is transcribed. Plasmids suitable for in vivo delivery of genetic material for therapeutic purposes are described in detail in U.S. Pat. Nos. 5,962,428 and 5,910,488. The selected plasmid can provide for transient or stable delivery of a target cell. It will be apparent to those of skill in the art that plasmids originally designed to express desired gene sequences can be modified to contain a transcriptional unit cassette for transcription of siRNA.

Methods for isolating RNA, synthesizing RNA, hybridizing nucleic acids, making and screening cDNA libraries, and performing PCR are well known in the art (see, e.g., Gubler and Hoffman, *Gene* 25:263-269 (1983); Sambrook et al., supra; Ausubel et al., supra), as are PCR methods (see, U.S. Pat. Nos. 4,683,195 and 4,683,202; *PCR Protocols: A Guide to Methods and Applications* (Innis et al., eds, 1990)). Expression libraries are also well known to those of skill in the art. Additional basic texts disclosing the general methods of use in this invention include Sambrook et al., *Molecular Cloning, A Laboratory Manual* (2nd ed. 1989); Kriegler, *Gene Transfer and Expression: A Laboratory Manual* (1990); and *Current Protocols in Molecular Biology* (Ausubel et al., eds., 1994).

Preferably, siRNA are chemically synthesized. The oligonucleotides that comprise the siRNA molecule can be synthesized using any of a variety of techniques known in the art, such as those described in Usman et al., *J. Am. Chem. Soc.*, 109:7845 (1987); Scaringe et al., *Nuc. Acids Res.*, 18:5433 (1990); Wincott et al., *Nuc. Acids Res.*, 23:2677-2684 (1995); and Wincott et al., *Methods Mol. Bio.*, 74:59 (1997). The synthesis of oligonucleotides makes use of common nucleic acid protecting and coupling groups, such as dimethoxytrityl at the 5'-end and phosphoramidites at the 3'-end. As a non-limiting example, small scale syntheses can be conducted on an Applied Biosystems synthesizer using a 0.2 µmol scale protocol with a 2.5 min. coupling step for 2'-O-methylated nucleotides. Alternatively, syntheses at the 0.2 µmol scale can be performed on a 96-well plate synthesizer from Protogene (Palo Alto, Calif.). However, a larger or smaller scale of synthesis is also within the scope of the present invention. Suitable reagents for oligonucleotide synthesis, methods for RNA deprotection, and methods for RNA purification are known to those of skill in the art.

The siRNA molecules can also be synthesized via a tandem synthesis technique, wherein both strands are synthesized as a single continuous oligonucleotide fragment or strand separated by a cleavable linker that is subsequently cleaved to provide separate fragments or strands that hybridize to form the siRNA duplex. The linker can be a polynucleotide linker or a non-nucleotide linker. The tandem synthesis of siRNA can be readily adapted to both multiwell/multiplate synthesis platforms as well as large scale synthesis platforms employing batch reactors, synthesis columns, and the like. Alternatively, the siRNA molecules can be assembled from two distinct oligonucleotides, wherein one oligonucleotide comprises the sense strand and the other comprises the antisense strand of the siRNA. For example, each strand can be synthesized separately and joined together by hybridization or ligation following synthesis and/or deprotection. In certain other instances, the siRNA molecules can be synthesized as a single continuous oligonucleotide fragment, where the self-complementary sense and antisense regions hybridize to form an siRNA duplex having hairpin secondary structure.

C. Modifying siRNA Sequences

In certain aspects, the siRNA molecules of the present invention (e.g., the siRNA sequences set forth in Tables 1-15) comprise a duplex having two strands and at least one modified nucleotide in the sense and/or antisense strand, wherein each strand is about 15 to about 60 nucleotides in length. In some embodiments, the siRNA molecules described herein comprise less than about 20% modified nucleotides (e.g., less than about 20%, 15%, 10%, or 5% modified nucleotides) or between about 1%-20% modified nucleotides (e.g., between about 1%-20%, 5%-20%, 10%-20%, or 15-20% modified nucleotides). Preferably, the modified siRNA contains less than about 20% or between about 1%-20% of 2'OMe purine and/or pyrimidine nucleotides such as a 2'OMe-guanosine, 2'OMe-uridine, 2'OMe-adenosine, and/or 2'OMe-cytosine nucleotide. In certain preferred embodiments, one or more of the uridine and/or guanosine nucleotides are modified in the siRNA sequence. Advantageously, the modified siRNA is less immunostimulatory than a corresponding unmodified siRNA sequence, but retains the capability of silencing the expression of a target sequence.

Examples of modified nucleotides suitable for use in the present invention include, but are not limited to, ribonucleotides having a 2'-O-methyl (2'OMe), 2'-deoxy-2'-fluoro, 2'-deoxy, 5-C-methyl, 2'-methoxyethyl, 4'-thio, 2'-amino, or 2'-C-allyl group. Modified nucleotides having a Northern conformation such as those described in, e.g., Saenger, *Principles of Nucleic Acid Structure*, Springer-Verlag Ed. (1984), are also suitable for use in the siRNA molecules of the present invention. Such modified nucleotides include, without limitation, locked nucleic acid (LNA) nucleotides (e.g., 2'-O, 4'-C-methylene-(D-ribofuranosyl) nucleotides), 2'-methoxyethoxy (MOE) nucleotides, 2'-methyl-thio-ethyl nucleotides, 2'-deoxy-2'-fluoro nucleotides, 2'-deoxy-2'-chloro nucleotides, and 2'-azido nucleotides. In certain instances, the siRNA molecule includes one or more G-clamp nucleotides. A G-clamp nucleotide refers to a modified cytosine analog wherein the modifications confer the ability to hydrogen bond both Watson-Crick and Hoogsteen faces of a complementary guanine nucleotide within a duplex (see, e.g., Lin et al., *J. Am. Chem. Soc.*, 120:8531-8532 (1998)). In addition, nucleotides having a nucleotide base analog such as, for example, C-phenyl, C-naphthyl, other aromatic derivatives, inosine, azole carboxamides, and nitroazole derivatives such as 3-nitropyrrole, 4-nitroindole, 5-nitroindole, and 6-nitroindole (see, e.g., Loakes, *Nucl. Acids Res.*, 29:2437-2447 (2001)) can be incorporated into the siRNA molecule.

In certain embodiments, the siRNA molecule can comprise one or more chemical modifications such as terminal cap moieties, phosphate backbone modifications, and the like. Examples of terminal cap moieties include, without limitation, inverted deoxy abasic residues, glyceryl modifications, 4',5'-methylene nucleotides, 1-(β-D-erythrofuranosyl) nucleotides, 4'-thio nucleotides, carbocyclic nucleotides, 1,5-anhydrohexitol nucleotides, L-nucleotides, α-nucleotides, modified base nucleotides, threo-pentofuranosyl nucleotides, acyclic 3',4'-seco nucleotides, acyclic 3,4-dihydroxybutyl nucleotides, acyclic 3,5-dihydroxypentyl nucleotides, 3'-3'-inverted nucleotide moieties, 3'-3'-inverted abasic moieties, 3'-2'-inverted nucleotide moieties, 3'-2'-inverted abasic moieties, 5'-5'-inverted nucleotide moieties, 5'-5'-inverted abasic moieties, 3'-5'-inverted deoxy abasic moieties, 5'-amino-alkyl phosphate, 1,3-diamino-2-propyl phosphate, 3-aminopropyl phosphate, 6-aminohexyl phosphate, 1,2-aminododecyl phosphate, hydroxypropyl phosphate, 1,4-butanediol phosphate, 3'-phosphoramidate, 5'-phosphoramidate, hexylphosphate, aminohexyl phosphate, 3'-phosphate, 5'-amino, 3'-phosphorothioate, 5'-phosphorothioate, phosphorodithioate, and bridging or non-bridging methylphosphonate or 5'-mercapto moieties (see, e.g., U.S. Pat. No. 5,998,203; Beaucage et al., *Tetrahedron*, 49:1925 (1993)). Non-limiting examples of phosphate backbone modifications (i.e., resulting in modified internucleotide linkages) include phosphorothioate, phosphorodithioate, methylphosphonate, phosphotriester, morpholino, amidate, carbamate, carboxymethyl, acetamidate, polyamide, sulfonate, sulfonamide, sulfamate, formacetal, thioformacetal, and alkylsilyl substitutions (see, e.g., Hunziker et al., *Nucleic Acid Analogues: Synthesis and Properties*, in *Modern Synthetic Methods*, VCH, 331-417 (1995); Mesmaeker et al., *Novel Backbone Replacements for Oligonucleotides*, in *Carbohydrate Modifications in Antisense Research*, ACS, 24-39 (1994)). Such chemical modifications can occur at the 5'-end and/or 3'-end of the sense strand, antisense strand, or both strands of the siRNA.

In some embodiments, the sense and/or antisense strand can comprise a 3'-terminal overhang having about 1 to about 4 (e.g., 1, 2, 3, or 4) 2'-deoxy ribonucleotides and/or any combination of modified and unmodified nucleotides. Additional examples of modified nucleotides and types of chemical modifications that can be introduced into the modified siRNA molecule are described, e.g., in UK Patent No. GB 2,397,818 B and U.S. Patent Publication Nos. 20040192626 and 20050282188.

The siRNA molecules described herein can optionally comprise one or more non-nucleotides in one or both strands of the siRNA. As used herein, the term "non-nucleotide" refers to any group or compound that can be incorporated into a nucleic acid chain in the place of one or more nucleotide units, including sugar and/or phosphate substitutions, and allows the remaining bases to exhibit their activity. The group or compound is abasic in that it does not contain a commonly recognized nucleotide base such as adenosine, guanine, cytosine, uracil, or thymine and therefore lacks a base at the 1'-position.

In other embodiments, chemical modification of the siRNA comprises attaching a conjugate to the siRNA molecule. The conjugate can be attached at the 5' and/or 3'-end of the sense and/or antisense strand of the siRNA via a covalent attachment such as, e.g., a biodegradable linker. The conjugate can also be attached to the siRNA, e.g., through a carbamate group or other linking group (see, e.g., U.S. Patent Publication Nos. 20050074771, 20050043219, and 20050158727). In certain instances, the conjugate is a molecule that facilitates the delivery of the siRNA into a cell. Examples of conjugate molecules suitable for attachment to an siRNA include, without limitation, steroids such as cholesterol, glycols such as polyethylene glycol (PEG), human serum albumin (HSA), fatty acids, carotenoids, terpenes, bile acids, folates (e.g., folic acid, folate analogs and derivatives thereof), sugars (e.g., galactose, galactosamine, N-acetyl galactosamine, glucose, mannose, fructose, fucose, etc.), phospholipids, peptides, ligands for cellular receptors capable of mediating cellular uptake, and combinations thereof (see, e.g., U.S. Patent Publication Nos. 20030130186, 20040110296, and 20040249178; U.S. Pat. No. 6,753,423). Other examples include the lipophilic moiety, vitamin, polymer, peptide, protein, nucleic acid, small molecule, oligosaccharide, carbohydrate cluster, intercalator, minor groove binder, cleaving agent, and cross-linking agent conjugate molecules described in U.S. Patent Publication Nos. 20050119470 and 20050107325. Yet other examples include the 2'-O-alkyl amine, 2'-O-alkoxyalkyl amine, polyamine, C5-cationic modified pyrimidine, cationic peptide, guanidinium group, amidininium group, cationic amino acid conjugate molecules described in U.S. Patent Publication No. 20050153337. Additional examples include the hydrophobic group, membrane active compound, cell penetrating compound, cell targeting signal, interaction modifier, and steric stabilizer conjugate molecules described in U.S. Patent Publication No. 20040167090. Further examples include the conjugate molecules described in U.S. Patent Publication No. 20050239739. The type of conjugate used and the extent of conjugation to the siRNA molecule can be evaluated for improved pharmacokinetic profiles, bioavailability, and/or stability of the siRNA. As such, one skilled in the art can screen siRNA molecules having various conjugates attached thereto to identify ones having improved properties using any of a variety of well-known in vitro cell culture or in vivo animal models.

IV. Carrier Systems Containing siRNA

In one aspect, the present invention provides carrier systems containing the siRNA molecules described herein. In some embodiments, the carrier system is a lipid-based carrier system such as a stabilized nucleic acid-lipid particle (e.g., SNALP or SPLP), cationic lipid or liposome nucleic acid complexes (i.e., lipoplexes), a liposome, a micelle, a virosome, or a mixture thereof. In other embodiments, the carrier system is a polymer-based carrier system such as a cationic polymer-nucleic acid complex (i.e., polyplex). In additional embodiments, the carrier system is a cyclodextrin-based carrier system such as a cyclodextrin polymer-nucleic acid complex. In further embodiments, the carrier system is a protein-based carrier system such as a cationic peptide-nucleic acid complex. Preferably, the carrier system is a stabilized nucleic acid-lipid particle such as a SNALP or SPLP. One skilled in the art will appreciate that the siRNA molecule of the present invention can also be delivered as a naked siRNA molecule.

A. Stabilized Nucleic Acid-Lipid Particles

The stabilized nucleic acid-lipid particles (SNALPs) of the present invention typically comprise an siRNA molecule that targets expression of a Filovirus gene (e.g., an Ebola virus or Marburg virus gene), a cationic lipid (e.g., a cationic lipid of Formula I or II), and a non-cationic lipid. The SNALPs can further comprise a bilayer stabilizing component (i.e., a conjugated lipid that inhibits aggregation of the particles). The SNALPs may comprise at least 1, 2, 3, 4, 5, 6, 7, 8, 9, 10, or more of the sequences set forth in Tables 1-15.

The SNALPs of the present invention typically have a mean diameter of about 50 nm to about 150 nm, more typically about 60 nm to about 130 nm, more typically about 70 nm to about 110 nm, most typically about 70 to about 90 nm, and are substantially nontoxic. In addition, the nucleic acids are resistant in aqueous solution to degradation with a nuclease when present in the nucleic acid-lipid particles. Nucleic acid-lipid particles and their method of preparation are disclosed in, e.g., U.S. Pat. Nos. 5,753,613; 5,785,992; 5,705,385; 5,976,567; 5,981,501; 6,110,745; and 6,320,017; and PCT Publication No. WO 96/40964.

1. Cationic Lipids

Any of a variety of cationic lipids may be used in the stabilized nucleic acid-lipid particles of the present invention, either alone or in combination with one or more other cationic lipid species or non-cationic lipid species.

Cationic lipids which are useful in the present invention can be any of a number of lipid species which carry a net positive charge at physiological pH. Such lipids include, but are not limited to, DODAC, DODMA, DSDMA, DOTMA, DDAB, DOTAP, DOSPA, DOGS, DC-Chol, DMRIE, and mixtures thereof. A number of these lipids and related analogs have been described in U.S. Patent Publication No. 20060083780; U.S. Pat. Nos. 5,208,036; 5,264,618; 5,279,833; 5,283,185; and 5,753,613; and 5,785,992; and PCT Publication No. WO 96/10390. Additionally, a number of commercial preparations of cationic lipids are available and can be used in the present invention. These include, for example, LIPOFECTIN® (commercially available cationic liposomes comprising DOTMA and DOPE, from GIBCO/BRL, Grand Island, N.Y., USA); LIPOFECTAMINE® (commercially available cationic liposomes comprising DOSPA and DOPE, from GIBCO/BRL); and TRANSFECTAM® (commercially available cationic liposomes comprising DOGS from Promega Corp., Madison, Wis., USA).

Furthermore, cationic lipids of Formula I having the following structures are useful in the present invention.

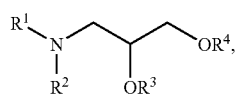

(I)

wherein $R^1$ and $R^2$ are independently selected and are H or $C_1$-$C_3$ alkyls, $R^3$ and $R^4$ are independently selected and are alkyl groups having from about 10 to about 20 carbon atoms, and at least one of $R^3$ and $R^4$ comprises at least two sites of unsaturation. In certain instances, $R^3$ and $R^4$ are both the same, i.e., $R^3$ and $R^4$ are both linoleyl (C18), etc. In certain other instances, $R^3$ and $R^4$ are different, i.e., $R^3$ is tetradectrienyl (C14) and $R^4$ is linoleyl (C18). In a preferred embodiment, the cationic lipid of Formula I is symmetrical, i.e., $R^3$ and $R^4$ are both the same. In another preferred embodiment, both $R^3$ and $R^4$ comprise at least two sites of unsaturation. In some embodiments, $R^3$ and $R^4$ are independently selected from dodecadienyl, tetradecadienyl, hexadecadienyl, linoleyl, and icosadienyl. In a preferred embodiment, $R^3$ and $R^4$ are both linoleyl. In some embodiments, $R^3$ and $R^4$ comprise at least three sites of unsaturation and are independently selected from, e.g., dodecatrienyl, tetradectrienyl, hexadectrienyl, linolenyl, and icosatrienyl. In a particularly preferred embodiments, the cationic lipid of Formula I is DLinDMA or DLenDMA.

Moreover, cationic lipids of Formula II having the following structures are useful in the present invention.

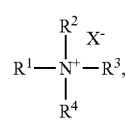

(II)

wherein $R^1$ and $R^2$ are independently selected and are H or $C_1$-$C_3$ alkyls, $R^3$ and $R^4$ are independently selected and are alkyl groups having from about 10 to about 20 carbon atoms, and at least one of $R^3$ and $R^4$ comprises at least two sites of unsaturation. In certain instances, $R^3$ and $R^4$ are both the same, i.e., $R^3$ and $R^4$ are both linoleyl (C18), etc. In certain other instances, $R^3$ and $R^4$ are different, i.e., $R^3$ is tetradectrienyl (C14) and $R^4$ is linoleyl (C18). In a preferred embodiment, the cationic lipids of the present invention are symmetrical, i.e., $R^3$ and $R^4$ are both the same. In another preferred embodiment, both $R^3$ and $R^4$ comprise at least two sites of unsaturation. In some embodiments, $R^3$ and $R^4$ are independently selected from dodecadienyl, tetradecadienyl, hexadecadienyl, linoleyl, and icosadienyl. In a preferred embodiment, $R^3$ and $R^4$ are both linoleyl. In some embodiments, $R^3$ and $R^4$ comprise at least three sites of unsaturation and are independently selected from, e.g., dodecatrienyl, tetradectrienyl, hexadectrienyl, linolenyl, and icosatrienyl.

The cationic lipid typically comprises from about 2 mol % to about 60 mol %, from about 5 mol % to about 50 mol %, from about 10 mol % to about 50 mol %, from about 20 mol % to about 50 mol %, from about 20 mol % to about 40 mol %, from about 30 mol % to about 40 mol %, or about 40 mol % of the total lipid present in the particle. It will be readily apparent to one of skill in the art that depending on the intended use of the particles, the proportions of the components can be varied and the delivery efficiency of a particular formulation can be measured using, e.g., an endosomal release parameter (ERP) assay. For example, for systemic delivery, the cationic lipid may comprise from about 5 mol % to about 15 mol % of the total lipid present in the particle, and for local or regional delivery, the cationic lipid may comprise from about 30 mol % to about 50 mol %, or about 40 mol % of the total lipid present in the particle.

2. Non-cationic Lipids

The non-cationic lipids used in the stabilized nucleic acid-lipid particles of the present invention can be any of a variety of neutral uncharged, zwitterionic, or anionic lipids capable of producing a stable complex. They are preferably neutral, although they can alternatively be positively or negatively charged. Examples of non-cationic lipids include, without limitation, phospholipid-related materials such as lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidic acid, cerebrosides, dicetylphosphate, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoylphosphatidylethanolamine (DOPE), palmitoyloleoyl-phosphatidylcholine (POPC), palmitoyloleoyl-phosphatidylethanolamine (POPE), palmitoyloleyol-phosphatidylglycerol (POPG), dioleoylphosphatidylethanolamine 4-(N-maleimidomethyl)-cyclohexane-1-carboxylate (DOPE-mal), dipalmitoyl-phosphatidylethanolamine (DPPE), dimyristoyl-phosphatidylethanolamine (DMPE), distearoyl-phosphatidylethanolamine (DSPE), monomethyl-phosphatidylethanolamine, dimethyl-phosphatidylethanolamine, dielaidoyl-phosphatidylethanolamine (DEPE), and stearoyloleoyl-phosphatidylethanolamine (SOPE). Non-cationic lipids or sterols such as cholesterol may also be present. Additional nonphosphorous containing lipids include, e.g., stearylamine, dodecylamine, hexadecylamine, acetyl palmitate, glycerolricinoleate, hexadecyl stereate, isopropyl myristate, amphoteric acrylic polymers, triethanolamine-lauryl sulfate, alkyl-aryl sulfate polyethyloxylated fatty acid amides, dioctadecyldimethyl ammonium bromide, ceramide, diacylphosphatidylcholine, diacylphosphatidylethanolamine, and the like. Other lipids such as lysophosphatidylcholine and lysophosphatidylethanolamine may be present. Non-cationic lipids also include polyethylene glycol-based polymers such as PEG 2000, PEG 5000, and polyethylene glycol conjugated to phospholipids or to ceramides (referred to as PEG-Cer), as described in U.S. patent application Ser. No. 08/316,429.

In preferred embodiments, the non-cationic lipids are diacylphosphatidylcholine (e.g., distearoylphosphatidylcholine, dioleoylphosphatidylcholine, dipalmitoylphosphatidylcholine, and dilinoleoylphosphatidylcholine), diacylphosphatidylethanolamine (e.g., dioleoylphosphatidylethanolamine and palmitoyloleoyl-phosphatidylethanolamine), ceramide, or sphingomyelin. The acyl groups in these lipids are preferably acyl groups derived from fatty acids having $C_{10}$-$C_{24}$ carbon chains. More preferably, the acyl groups are lauroyl, myristoyl, palmitoyl, stearoyl, or oleoyl. In particularly preferred embodiments, the non-cationic lipid includes one or more of cholesterol, DOPE, or ESM.

The non-cationic lipid typically comprises from about 5 mol % to about 90 mol %, from about 10 mol % to about 85 mol %, from about 20 mol % to about 80 mol %, or about 20 mol % of the total lipid present in the particle. The particles may further comprise cholesterol. If present, the cholesterol typically comprises from about 0 mol % to about 10 mol %, from about 2 mol % to about 10 mol %, from about 10 mol % to about 60 mol %, from about 12 mol % to about 58 mol %, from about 20 mol % to about 55 mol %, from about 30 mol % to about 50 mol %, or about 48 mol % of the total lipid present in the particle.

3. Bilayer Stabilizing Component

In addition to cationic and non-cationic lipids, the stabilized nucleic acid-lipid particles of the present invention can comprise a bilayer stabilizing component (BSC) such as an ATTA-lipid or a PEG-lipid such as PEG coupled to dialkyloxypropyls (PEG-DAA) as described in, e.g., PCT Publication No. WO 05/026372, PEG coupled to diacylglycerol (PEG-DAG) as described in, e.g., U.S. Patent Publication Nos. 20030077829 and 2005008689, PEG coupled to phospholipids such as phosphatidylethanolamine (PEG-PE), PEG conjugated to ceramides, or a mixture thereof (see, e.g., U.S. Pat. No. 5,885,613). In a preferred embodiment, the BSC is a conjugated lipid that prevents the aggregation of particles. Suitable conjugated lipids include, but are not limited to, PEG-lipid conjugates, ATTA-lipid conjugates, cationic-polymer-lipid conjugates (CPLs), and mixtures thereof. In another preferred embodiment, the particles comprise either a PEG-lipid conjugate or an ATTA-lipid conjugate together with a CPL.

PEG is a linear, water-soluble polymer of ethylene PEG repeating units with two terminal hydroxyl groups. PEGs are classified by their molecular weights; for example, PEG 2000 has an average molecular weight of about 2,000 daltons, and PEG 5000 has an average molecular weight of about 5,000 daltons. PEGs are commercially available from Sigma Chemical Co. and other companies and include, for example, the following: monomethoxypolyethylene glycol (MePEG-OH), monomethoxypolyethylene glycol-succinate (MePEG-S), monomethoxypolyethylene glycol-succinimidyl succinate (MePEG-S—NHS), monomethoxypolyethylene glycolamine (MePEG-NH$_2$), monomethoxypolyethylene glycol-tresylate (MePEG-TRES), and monomethoxypolyethylene glycol-imidazolyl-carbonyl (MePEG-IM). In addition, monomethoxypolyethyleneglycol-acetic acid (MePEG-CH$_2$COOH) is particularly useful for preparing the PEG-lipid conjugates including, e.g., PEG-DAA conjugates.

In a preferred embodiment, the PEG has an average molecular weight of from about 550 daltons to about 10,000 daltons, more preferably from about 750 daltons to about 5,000 daltons, more preferably from about 1,000 daltons to about 5,000 daltons, more preferably from about 1,500 daltons to about 3,000 daltons, and even more preferably about 2,000 daltons or about 750 daltons. The PEG can be optionally substituted by an alkyl, alkoxy, acyl, or aryl group. The PEG can be conjugated directly to the lipid or may be linked to the lipid via a linker moiety. Any linker moiety suitable for coupling the PEG to a lipid can be used including, e.g., non-ester containing linker moieties and ester-containing linker moieties. In a preferred embodiment, the linker moiety is a non-ester containing linker moiety. As used herein, the term "non-ester containing linker moiety" refers to a linker moiety that does not contain a carboxylic ester bond (—OC(O)—). Suitable non-ester containing linker moieties include, but are not limited to, amido (—C(O)NH—), amino (—NR—), carbonyl (—C(O)—), carbamate (—NHC(O)O—), urea (—NHC(O)NH—), disulphide (—S—S—), ether (—O—), succinyl (—(O)CCH$_2$CH$_2$C(O)—), succinamidyl (—NHC(O)CH$_2$CH$_2$C(O)NH—), ether, disulphide, as well as combinations thereof (such as a linker containing both a carbamate linker moiety and an amido linker moiety). In a preferred embodiment, a carbamate linker is used to couple the PEG to the lipid.

In other embodiments, an ester containing linker moiety is used to couple the PEG to the lipid. Suitable ester containing linker moieties include, e.g., carbonate (—OC(O)O—), succinoyl, phosphate esters (—O—(O)POH—O—), sulfonate esters, and combinations thereof.

Phosphatidylethanolamines having a variety of acyl chain groups of varying chain lengths and degrees of saturation can be conjugated to PEG to form the bilayer stabilizing component. Such phosphatidylethanolamines are commercially available, or can be isolated or synthesized using conventional techniques known to those of skilled in the art. Phosphatidylethanolamines containing saturated or unsaturated fatty acids with carbon chain lengths in the range of $C_{10}$ to $C_{20}$ are preferred. Phosphatidylethanolamines with mono- or diunsaturated fatty acids and mixtures of saturated and unsaturated fatty acids can also be used. Suitable phosphatidylethanolamines include, but are not limited to, dimyristoyl-phosphatidylethanolamine (DMPE), dipalmitoyl-phosphatidylethanolamine (DPPE), dioleoylphosphatidylethanolamine (DOPE), and distearoyl-phosphatidylethanolamine (DSPE).

The term "ATTA" or "polyamide" refers to, without limitation, compounds disclosed in U.S. Pat. Nos. 6,320,017 and 6,586,559. These compounds include a compound having the formula:

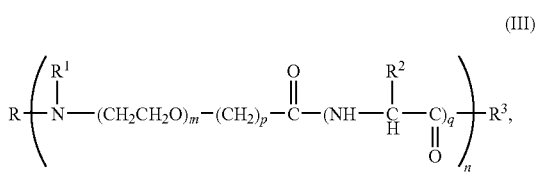

(III)

(VI)

wherein R is a member selected from the group consisting of hydrogen, alkyl and acyl; $R^1$ is a member selected from the group consisting of hydrogen and alkyl; or optionally, R and $R^1$ and the nitrogen to which they are bound form an azido moiety; $R^2$ is a member of the group selected from hydrogen, optionally substituted alkyl, optionally substituted aryl and a side chain of an amino acid; $R^3$ is a member selected from the group consisting of hydrogen, halogen, hydroxy, alkoxy, mercapto, hydrazino, amino and $NR^4R^5$, wherein $R^4$ and $R^5$ are independently hydrogen or alkyl; n is 4 to 80; m is 2 to 6; p is 1 to 4; and q is 0 or 1. It will be apparent to those of skill in the art that other polyamides can be used in the compounds of the present invention.

The term "diacylglycerol" refers to a compound having 2 fatty acyl chains, $R^1$ and $R^2$, both of which have independently between 2 and 30 carbons bonded to the 1- and 2-position of glycerol by ester linkages. The acyl groups can be saturated or have varying degrees of unsaturation. Suitable acyl groups include, but are not limited to, lauryl (C12), myristyl (C14), palmityl (C16), stearyl (C18), and icosyl (C20). In preferred embodiments, $R^1$ and $R^2$ are the same, i.e., $R^1$ and $R^2$ are both myristyl (i.e., dimyristyl), $R^1$ and $R^2$ are both stearyl (i.e., distearyl), etc. Diacylglycerols have the following general formula:

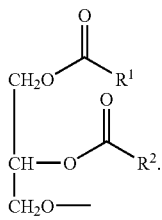

(IV)

The term "dialkyloxypropyl" refers to a compound having 2 alkyl chains, $R^1$ and $R^2$, both of which have independently between 2 and 30 carbons. The alkyl groups can be saturated or have varying degrees of unsaturation. Dialkyloxypropyls have the following general formula:

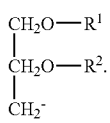

(V)

In a preferred embodiment, the PEG-lipid is a PEG-DAA conjugate having the following formula:

wherein $R^1$ and $R^2$ are independently selected and are long-chain alkyl groups having from about 10 to about 22 carbon atoms; PEG is a polyethyleneglycol; and L is a non-ester containing linker moiety or an ester containing linker moiety as described above. The long-chain alkyl groups can be saturated or unsaturated. Suitable alkyl groups include, but are not limited to, lauryl (C12), myristyl (C14), palmityl (C16), stearyl (C18), and icosyl (C20). In preferred embodiments, $R^1$ and $R^2$ are the same, i.e., $R^1$ and $R^2$ are both myristyl (i.e., dimyristyl), $R^1$ and $R^2$ are both stearyl (i.e., distearyl), etc.

In Formula VI above, the PEG has an average molecular weight ranging from about 550 daltons to about 10,000 daltons, more preferably from about 750 daltons to about 5,000 daltons, more preferably from about 1,000 daltons to about 5,000 daltons, more preferably from about 1,500 daltons to about 3,000 daltons, and even more preferably about 2,000 daltons or about 750 daltons. The PEG can be optionally substituted with alkyl, alkoxy, acyl, or aryl. In a preferred embodiment, the terminal hydroxyl group is substituted with a methoxy or methyl group.

In a preferred embodiment, "L" is a non-ester containing linker moiety. Suitable non-ester containing linkers include, but are not limited to, an amido linker moiety, an amino linker moiety, a carbonyl linker moiety, a carbamate linker moiety, a urea linker moiety, an ether linker moiety, a disulphide linker moiety, a succinamidyl linker moiety, and combinations thereof. In a preferred embodiment, the non-ester containing linker moiety is a carbamate linker moiety (i.e., a PEG-C-DAA conjugate). In another preferred embodiment, the non-ester containing linker moiety is an amido linker moiety (i.e., a PEG-A-DAA conjugate). In yet another preferred embodiment, the non-ester containing linker moiety is a succinamidyl linker moiety (i.e., a PEG-S-DAA conjugate).

The PEG-DAA conjugates are synthesized using standard techniques and reagents known to those of skill in the art. It will be recognized that the PEG-DAA conjugates will contain various amide, amine, ether, thio, carbamate, and urea linkages. Those of skill in the art will recognize that methods and reagents for forming these bonds are well known and readily available. See, e.g., March, ADVANCED ORGANIC CHEMISTRY (Wiley 1992), Larock, COMPREHENSIVE ORGANIC TRANSFORMATIONS (VCH 1989); and Fumiss, VOGEL'S TEXTBOOK OF PRACTICAL ORGANIC CHEMISTRY 5th ed. (Longman 1989). It will also be appreciated that any functional groups present may require protection and deprotection at different points in the synthesis of the PEG-DAA conjugates. Those of skill in the art will recognize that such techniques are well known. See, e.g., Green and Wuts, PROTECTIVE GROUPS IN ORGANIC SYNTHESIS (Wiley 1991).

Preferably, the PEG-DAA conjugate is a dilauryloxypropyl (C12)-PEG conjugate, dimyristyloxypropyl (C14)-PEG conjugate, a dipalmityloxypropyl (C16)-PEG conjugate, or a distearyloxypropyl (C18)-PEG conjugate. Those of skill in the art will readily appreciate that other dialkyloxypropyls can be used in the PEG-DAA conjugates of the present invention.

In addition to the foregoing, it will be readily apparent to those of skill in the art that other hydrophilic polymers can be used in place of PEG. Examples of suitable polymers that can be used in place of PEG include, but are not limited to, polyvinylpyrrolidone, polymethyloxazoline, polyethyloxazoline, polyhydroxypropyl methacrylamide, polymethacrylamide and polydimethylacrylamide, polylactic acid, polyglycolic acid, and derivatized celluloses such as hydroxymethylcellulose or hydroxyethylcellulose.

In addition to the foregoing components, the particles (e.g., SNALPs or SPLPs) of the present invention can further comprise cationic poly(ethylene glycol) (PEG) lipids or CPLs that have been designed for insertion into lipid bilayers to impart a positive charge (see, e.g., Chen et al., *Bioconj. Chem.*, 11:433-437 (2000)). Suitable SPLPs and SPLP-CPLs for use in the present invention, and methods of making and using SPLPs and SPLP-CPLs, are disclosed, e.g., in U.S. Pat. No. 6,852,334 and PCT Publication No. WO 00/62813. Cationic polymer lipids (CPLs) useful in the present invention have the following architectural features: (1) a lipid anchor, such as a hydrophobic lipid, for incorporating the CPLs into the lipid bilayer; (2) a hydrophilic spacer, such as a polyethylene glycol, for linking the lipid anchor to a cationic head group; and (3) a polycationic moiety, such as a naturally occurring amino acid, to produce a protonizable cationic head group.

Suitable CPLs include compounds of Formula VII:

A-W—Y      (VII), wherein A, W, and Y are as described below.

With reference to Formula VII, "A" is a lipid moiety such as an amphipathic lipid, a neutral lipid, or a hydrophobic lipid that acts as a lipid anchor. Suitable lipid examples include vesicle-forming lipids or vesicle adopting lipids and include, but are not limited to, diacylglycerolyls, dialkylglycerolyls, N—N-dialkylaminos, 1,2-diacyloxy-3-aminopropanesi, and 1,2-dialkyl-3-aminopropanes.

"W" is a polymer or an oligomer such as a hydrophilic polymer or oligomer. Preferably, the hydrophilic polymer is a biocompatible polymer that is nonimmunogenic or possesses low inherent immunogenicity. Alternatively, the hydrophilic polymer can be weakly antigenic if used with appropriate adjuvants. Suitable nonimmunogenic polymers include, but are not limited to, PEG, polyamides, polylactic acid, polyglycolic acid, polylactic acid/polyglycolic acid copolymers, and combinations thereof. In a preferred embodiment, the polymer has a molecular weight of from about 250 to about 7,000 daltons.

"Y" is a polycationic moiety. The term polycationic moiety refers to a compound, derivative, or functional group having a positive charge, preferably at least 2 positive charges at a selected pH, preferably physiological pH. Suitable polycationic moieties include basic amino acids and their derivatives such as arginine, asparagine, glutamine, lysine, and histidine; spermine; spermidine; cationic dendrimers; polyamines; polyamine sugars; and amino polysaccharides. The polycationic moieties can be linear, such as linear tetralysine, branched or dendrimeric in structure. Polycationic moieties have between about 2 to about 15 positive charges, preferably between about 2 to about 12 positive charges, and more preferably between about 2 to about 8 positive charges at selected pH values. The selection of which polycationic moiety to employ may be determined by the type of particle application which is desired.

The charges on the polycationic moieties can be either distributed around the entire particle moiety, or alternatively, they can be a discrete concentration of charge density in one particular area of the particle moiety e.g., a charge spike. If the charge density is distributed on the particle, the charge density can be equally distributed or unequally distributed. All variations of charge distribution of the polycationic moiety are encompassed by the present invention.

The lipid "A" and the nonimmunogenic polymer "W" can be attached by various methods and preferably by covalent attachment. Methods known to those of skill in the art can be used for the covalent attachment of "A" and "W." Suitable linkages include, but are not limited to, amide, amine, carboxyl, carbonate, carbamate, ester, and hydrazone linkages. It will be apparent to those skilled in the art that "A" and "W" must have complementary functional groups to effectuate the linkage. The reaction of these two groups, one on the lipid and the other on the polymer, will provide the desired linkage. For example, when the lipid is a diacylglycerol and the terminal hydroxyl is activated, for instance with NHS and DCC, to form an active ester, and is then reacted with a polymer which contains an amino group, such as with a polyamide (see, e.g., U.S. Pat. Nos. 6,320,017 and 6,586,559), an amide bond will form between the two groups.

In certain instances, the polycationic moiety can have a ligand attached, such as a targeting ligand or a chelating moiety for complexing calcium. Preferably, after the ligand is attached, the cationic moiety maintains a positive charge. In certain instances, the ligand that is attached has a positive charge. Suitable ligands include, but are not limited to, a compound or device with a reactive functional group and include lipids, amphipathic lipids, carrier compounds, bioaffinity compounds, biomaterials, biopolymers, biomedical devices, analytically detectable compounds, therapeutically active compounds, enzymes, peptides, proteins, antibodies, immune stimulators, radiolabels, fluorogens, biotin, drugs, haptens, DNA, RNA, polysaccharides, liposomes, virosomes, micelles, immunoglobulins, functional groups, other targeting moieties, or toxins.

The bilayer stabilizing component (e.g., PEG-lipid) typically comprises from about 0 mol % to about 20 mol %, from about 0.5 mol % to about 20 mol %, from about 1.5 mol % to about 18 mol %, from about 4 mol % to about 15 mol %, from about 5 mol % to about 12 mol %, or about 2 mol % of the total lipid present in the particle. One of ordinary skill in the art will appreciate that the concentration of the bilayer stabilizing component can be varied depending on the bilayer stabilizing component employed and the rate at which the nucleic acid-lipid particle is to become fusogenic.

By controlling the composition and concentration of the bilayer stabilizing component, one can control the rate at which the bilayer stabilizing component exchanges out of the nucleic acid-lipid particle and, in turn, the rate at which the nucleic acid-lipid particle becomes fusogenic. For instance, when a polyethyleneglycol-phosphatidylethanolamine conjugate or a polyethyleneglycol-ceramide conjugate is used as the bilayer stabilizing component, the rate at which the nucleic acid-lipid particle becomes fusogenic can be varied, for example, by varying the concentration of the bilayer stabilizing component, by varying the molecular weight of the polyethyleneglycol, or by varying the chain length and degree of saturation of the acyl chain groups on the phosphatidylethanolamine or the ceramide. In addition, other variables including, for example, pH, temperature, ionic strength, etc. can be used to vary and/or control the rate at which the nucleic acid-lipid particle becomes fusogenic. Other methods which can be used to control the rate at which the nucleic acid-lipid particle becomes fusogenic will become apparent to those of skill in the art upon reading this disclosure.

B. Additional Carrier Systems

Non-limiting examples of additional lipid-based carrier systems suitable for use in the present invention include lipoplexes (see, e.g., U.S. Patent Publication No. 20030203865; and Zhang et al., *J. Control Release*, 100:165-180 (2004)), pH-sensitive lipoplexes (see, e.g., U.S. Patent Publication No. 20020192275), reversibly masked lipoplexes (see, e.g., U.S. Patent Publication Nos. 20030180950), cationic lipid-based compositions (see, e.g., U.S. Pat. No. 6,756,054; and U.S. Patent Publication No. 20050234232), cationic liposomes (see, e.g., U.S. Patent Publication Nos. 20030229040, 20020160038, and 20020012998; U.S. Pat. No. 5,908,635; and PCT Publication No. WO 01/72283), anionic liposomes (see, e.g., U.S. Patent Publication No. 20030026831), pH-sensitive liposomes (see, e.g., U.S. Patent Publication No. 20020192274; and AU 2003210303), antibody-coated liposomes (see, e.g., U.S. Patent Publication No. 20030108597; and PCT Publication No. WO 00/50008), cell-type specific liposomes (see, e.g., U.S. Patent Publication No. 20030198664), liposomes containing nucleic acid and peptides (see, e.g., U.S. Pat. No. 6,207,456), liposomes containing lipids derivatized with releasable hydrophilic polymers (see, e.g., U.S. Patent Publication No. 20030031704), lipid-entrapped nucleic acid (see, e.g., PCT Publication Nos. WO 03/057190 and WO 03/059322), lipid-encapsulated nucleic acid (see, e.g., U.S. Patent Publication No. 20030129221; and U.S. Pat. No. 5,756,122), other liposomal compositions (see, e.g., U.S. Patent Publication Nos. 20030035829 and 20030072794; and U.S. Pat. No. 6,200,599), stabilized mixtures of liposomes and emulsions (see, e.g., EP1304160), emulsion compositions (see, e.g., U.S. Pat. No. 6,747,014), and nucleic acid micro-emulsions (see, e.g., U.S. Patent Publication No. 20050037086).

Examples of polymer-based carrier systems suitable for use in the present invention include, but are not limited to, cationic polymer-nucleic acid complexes (i.e., polyplexes). To form a polyplex, a nucleic acid (e.g., siRNA) is typically complexed with a cationic polymer having a linear, branched, star, or dendritic polymeric structure that condenses the nucleic acid into positively charged particles capable of interacting with anionic proteoglycans at the cell surface and entering cells by endocytosis. In some embodiments, the polyplex comprises nucleic acid (e.g., siRNA) complexed with a cationic polymer such as polyethylenimine (PEI) (see, e.g., U.S. Pat. No. 6,013,240; commercially available from Qbiogene, Inc. (Carlsbad, Calif.) as In vivo jetPEI™, a linear form of PEI), polypropylenimine (PPI), polyvinylpyrrolidone (PVP), poly-L-lysine (PLL), diethylaminoethyl (DEAE)-dextran, poly(β-amino ester) (PAE) polymers (see, e.g., Lynn et al., *J. Am. Chem. Soc.*, 123:8155-8156 (2001)), chitosan, polyamidoamine (PAMAM) dendrimers (see, e.g., Kukowska-Latallo et al., *Proc. Natl. Acad. Sci. USA*, 93:4897-4902 (1996)), porphyrin (see, e.g., U.S. Pat. No. 6,620,805), polyvinylether (see, e.g., U.S. Patent Publication No. 20040156909), polycyclic amidinium (see, e.g., U.S. Patent Publication No. 20030220289), other polymers comprising primary amine, imine, guanidine, and/or imidazole groups (see, e.g., U.S. Pat. No. 6,013,240; PCT Publication No. WO/9602655; PCT Publication No. WO95/21931; Zhang et al., *J. Control Release*, 100:165-180 (2004); and Tiera et al., *Curr. Gene Ther.*, 6:59-71 (2006)), and a mixture thereof. In other embodiments, the polyplex comprises cationic polymer-nucleic acid complexes as described in U.S. Patent Publication Nos. 20060211643, 20050222064, 20030125281, and 20030185890, and PCT Publication No. WO 03/066069; biodegradable poly(β-amino ester) polymer-nucleic acid complexes as described in U.S. Patent Publication No. 20040071654; microparticles containing polymeric matrices as described in U.S. Patent Publication No. 20040142475; other microparticle compositions as described in U.S. Patent Publication No. 20030157030; condensed nucleic acid complexes as described in U.S. Patent Publication No. 20050123600; and nanocapsule and microcapsule compositions as described in AU 2002358514 and PCT Publication No. WO 02/096551.

In certain instances, the siRNA molecule may be complexed with cyclodextrin or a polymer thereof. Non-limiting examples of cyclodextrin-based carrier systems include the cyclodextrin-modified polymer-nucleic acid complexes described in U.S. Patent Publication No. 20040087024; the linear cyclodextrin copolymer-nucleic acid complexes described in U.S. Pat. Nos. 6,509,323, 6,884,789, and 7,091,192; and the cyclodextrin polymer-complexing agent-nucleic acid complexes described in U.S. Pat. No. 7,018,609. In certain other instances, the siRNA molecule may be complexed with a peptide or polypeptide. An example of a protein-based carrier system includes, but is not limited to, the cationic oligopeptide-nucleic acid complex described in PCT Publication No. WO95/21931.

V. Preparation of Nucleic Acid-Lipid Particles

The serum-stable nucleic acid-lipid particles of the present invention, in which the siRNA described herein is encapsulated in a lipid bilayer and is protected from degradation, can be formed by any method known in the art including, but not limited to, a continuous mixing method, a direct dilution process, a detergent dialysis method, or a modification of a reverse-phase method which utilizes organic solvents to provide a single phase during mixing of the components.

In preferred embodiments, the cationic lipids are lipids of Formula I and II or combinations thereof. In other preferred embodiments, the non-cationic lipids are egg sphingomyelin (ESM), distearoylphosphatidylcholine (DSPC), dioleoylphosphatidylcholine (DOPC), 1-palmitoyl-2-oleoyl-phosphatidylcholine (POPC), monomethyl-phosphatidylethanolamine, dimethyl-phosphatidylethanolamine, 14:0 PE (1,2-dimyristoyl-phosphatidylethanolamine (DMPE)), 16:0 PE (1,2-dipalmitoyl-phosphatidylethanolamine (DPPE)), 18:0 PE (1,2-distearoyl-phosphatidylethanolamine (DSPE)), 18:1 PE (1,2-dioleoyl-phosphatidylethanolamine (DOPE)), 18:1 trans PE (1,2-dielaidoyl-phosphatidylethanolamine (DEPE)), 18:0-18:1 PE (1-stearoyl-2-oleoyl-phosphatidylethanolamine (SOPE)), 16:0-18:1 PE (1-palmitoyl-2-oleoyl-phosphatidylethanolamine (POPE)), polyethylene glycol-based polymers (e.g., PEG 2000, PEG 5000, PEG-modified diacylglycerols, or PEG-modified dialkyloxypropyls), cholesterol, or combinations thereof. In still other preferred embodiments, the organic solvents are methanol, chloroform, methylene chloride, ethanol, diethyl ether, or combinations thereof.

In a preferred embodiment, the present invention provides for nucleic acid-lipid particles produced via a continuous mixing method, e.g., process that includes providing an aqueous solution comprising a nucleic acid such as an siRNA in a first reservoir, providing an organic lipid solution in a second reservoir, and mixing the aqueous solution with the organic lipid solution such that the organic lipid solution mixes with the aqueous solution so as to substantially instantaneously produce a liposome encapsulating the nucleic acid (e.g., siRNA). This process and the apparatus for carrying this process are described in detail in U.S. Patent Publication No. 20040142025.

The action of continuously introducing lipid and buffer solutions into a mixing environment, such as in a mixing chamber, causes a continuous dilution of the lipid solution with the buffer solution, thereby producing a liposome substantially instantaneously upon mixing. As used herein, the phrase "continuously diluting a lipid solution with a buffer solution" (and variations) generally means that the lipid solution is diluted sufficiently rapidly in a hydration process with sufficient force to effectuate vesicle generation. By mixing the aqueous solution comprising a nucleic acid with the organic lipid solution, the organic lipid solution undergoes a continuous stepwise dilution in the presence of the buffer solution (i.e., aqueous solution) to produce a nucleic acid-lipid particle.

The serum-stable nucleic acid-lipid particles formed using the continuous mixing method typically have a size of from about 50 nm to about 150 nm, from about 60 nm to about 130 nm, from about 70 nm to about 110 nm, or from about 70 nm to about 90 nm. The particles thus formed do not aggregate and are optionally sized to achieve a uniform particle size.

In another embodiment, the present invention provides for nucleic acid-lipid particles produced via a direct dilution process that includes forming a liposome solution and immediately and directly introducing the liposome solution into a collection vessel containing a controlled amount of dilution buffer. In preferred aspects, the collection vessel includes one or more elements configured to stir the contents of the collection vessel to facilitate dilution. In one aspect, the amount of dilution buffer present in the collection vessel is substantially equal to the volume of liposome solution introduced thereto. As a non-limiting example, a liposome solution in 45% ethanol when introduced into the collection vessel containing an equal volume of ethanol will advantageously yield smaller particles in about 22.5%, about 20%, or about 15% ethanol.

In yet another embodiment, the present invention provides for nucleic acid-lipid particles produced via a direct dilution process in which a third reservoir containing dilution buffer is fluidly coupled to a second mixing region. In this embodiment, the liposome solution formed in a first mixing region is immediately and directly mixed with dilution buffer in the second mixing region. In preferred aspects, the second mixing region includes a T-connector arranged so that the liposome solution and the dilution buffer flows meet as opposing 180° flows; however, connectors providing shallower angles can be used, e.g., from about 27° to about 180°. A pump mechanism delivers a controllable flow of buffer to the second mixing region. In one aspect, the flow rate of dilution buffer provided to the second mixing region is controlled to be substantially equal to the flow rate of liposome solution introduced thereto from the first mixing region. This embodiment advantageously allows for more control of the flow of dilution buffer mixing with the liposome solution in the second mixing region, and therefore also the concentration of liposome solution in buffer throughout the second mixing process. Such control of the dilution buffer flow rate advantageously allows for small particle size formation at reduced concentrations.

These processes and the apparatuses for carrying out these direct dilution processes is described in detail in U.S. patent application Ser. No. 11/495,150.

The serum-stable nucleic acid-lipid particles formed using the direct dilution process typically have a size of from about 50 nm to about 150 nm, from about 60 nm to about 130 nm, from about 70 nm to about 110 nm, or from about 70 nm to about 90 nm. The particles thus formed do not aggregate and are optionally sized to achieve a uniform particle size.

In some embodiments, the particles are formed using detergent dialysis. Without intending to be bound by any particular mechanism of formation, a nucleic acid such as an siRNA is contacted with a detergent solution of cationic lipids to form a coated nucleic acid complex. These coated nucleic acids can aggregate and precipitate. However, the presence of a detergent reduces this aggregation and allows the coated nucleic acids to react with excess lipids (typically, non-cationic lipids) to form particles in which the nucleic acid is encapsulated in a lipid bilayer. Thus, the serum-stable nucleic acid-lipid particles can be prepared as follows:

(a) combining a nucleic acid with cationic lipids in a detergent solution to form a coated nucleic acid-lipid complex;

(b) contacting non-cationic lipids with the coated nucleic acid-lipid complex to form a detergent solution comprising a nucleic acid-lipid complex and non-cationic lipids; and (c) dialyzing the detergent solution of step (b) to provide a solution of serum-stable nucleic acid-lipid particles, wherein the nucleic acid is encapsulated in a lipid bilayer and the particles are serum-stable and have a size of from about 50 to about 150 nm.

An initial solution of coated nucleic acid-lipid complexes is formed by combining the nucleic acid with the cationic lipids in a detergent solution. In these embodiments, the detergent solution is preferably an aqueous solution of a neutral detergent having a critical micelle concentration of 15-300 mM, more preferably 20-50 mM. Examples of suitable detergents include, for example, N,N'-((octanoylimino)-bis-(trimethylene))-bis-(D-gluconamide) (BIGCHAP); BRIJ 35; Deoxy-BIGCHAP; dodecylpoly(ethylene glycol) ether; Tween 20; Tween 40; Tween 60; Tween 80; Tween 85; Mega 8; Mega 9; Zwittergent® 3-08; Zwittergent® 3-10; Triton X-405; hexyl-, heptyl-, octyl- and nonyl-β-D-glucopyranoside; and heptylthioglucopyranoside; with octyl β-D-glucopyranoside and Tween-20 being the most preferred. The concentration of detergent in the detergent solution is typically about 100 mM to about 2 M, preferably from about 200 mM to about 1.5 M.

The cationic lipids and nucleic acids will typically be combined to produce a charge ratio (+/−) of about 1:1 to about 20:1, in a ratio of about 1:1 to about 12:1, or in a ratio of about 2:1 to about 6:1. Additionally, the overall concentration of nucleic acid in solution will typically be from about 25 μg/mL to about 1 mg/mL, from about 25 μg/mL to about 200 μg/mL, or from about 50 μg/mL to about 100 μg/mL. The combination of nucleic acids and cationic lipids in detergent solution is kept, typically at room temperature, for a period of time which is sufficient for the coated complexes to form. Alternatively, the nucleic acids and cationic lipids can be combined in the detergent solution and warmed to temperatures of up to about 37° C., about 50° C., about 60° C., or about 70° C. For nucleic acids which are particularly sensitive to temperature, the coated complexes can be formed at lower temperatures, typically down to about 4° C.

In some embodiments, the nucleic acid to lipid ratios (mass/mass ratios) in a formed nucleic acid-lipid particle will range from about 0.01 to about 0.2, from about 0.03 to about 0.1, or from about 0.01 to about 0.08. The ratio of the starting materials also falls within this range. In other embodiments, the nucleic acid-lipid particle preparation uses about 400 μg nucleic acid per 10 mg total lipid or a nucleic acid to lipid ratio of about 0.01 to about 0.08 and, more preferably, about 0.04, which corresponds to 1.25 mg of total lipid per 50 μg of nucleic acid.

The detergent solution of the coated nucleic acid-lipid complexes is then contacted with non-cationic lipids to provide a detergent solution of nucleic acid-lipid complexes and non-cationic lipids. The non-cationic lipids which are useful in this step include, diacylphosphatidylcholine, diacylphosphatidylethanolamine, ceramide, sphingomyelin, cephalin, cardiolipin, and cerebrosides. In preferred embodiments, the non-cationic lipids are diacylphosphatidylcholine, diacylphosphatidylethanolamine, ceramide, or sphingomyelin. The acyl groups in these lipids are preferably acyl groups derived from fatty acids having $C_{10}$-$C_{24}$ carbon chains. More preferably, the acyl groups are lauroyl, myristoyl, palmitoyl, stearoyl, or oleoyl. In particularly preferred embodiments, the non-cationic lipids are DSPC, DOPE, POPC, egg phosphatidylcholine (EPC), cholesterol, or a mixture thereof. In the most preferred embodiments, the nucleic acid-lipid particles are fusogenic particles with enhanced properties in vivo and the non-cationic lipid is DSPC or DOPE. In addition, the nucleic acid-lipid particles of the present invention may further comprise cholesterol. In other preferred embodiments, the non-cationic lipids can further comprise polyethylene glycol-based polymers such as PEG 2,000, PEG 5,000, and PEG conjugated to a diacylglycerol, a ceramide, or a phospholipid, as described in, e.g., U.S. Pat. No. 5,820,873 and U.S. Patent Publication No. 20030077829. In further preferred embodiments, the non-cationic lipids can further comprise polyethylene glycol-based polymers such as PEG 2,000, PEG 5,000, and PEG conjugated to a dialkyloxypropyl.

The amount of non-cationic lipid which is used in the present methods is typically from about 2 to about 20 mg of total lipids to 50 μg of nucleic acid. Preferably, the amount of total lipid is from about 5 to about 10 mg per 50 μg of nucleic acid.

Following formation of the detergent solution of nucleic acid-lipid complexes and non-cationic lipids, the detergent is removed, preferably by dialysis. The removal of the detergent results in the formation of a lipid-bilayer which surrounds the nucleic acid providing serum-stable nucleic acid-lipid particles which have a size of from about 50 nm to about 150 nm, from about 60 nm to about 130 nm, from about 70 nm to about 110 nm, or from about 70 nm to about 90 nm. The particles thus formed do not aggregate and are optionally sized to achieve a uniform particle size.

The serum-stable nucleic acid-lipid particles can be sized by any of the methods available for sizing liposomes. The sizing may be conducted in order to achieve a desired size range and relatively narrow distribution of particle sizes.

Several techniques are available for sizing the particles to a desired size. One sizing method, used for liposomes and equally applicable to the present particles, is described in U.S. Pat. No. 4,737,323. Sonicating a particle suspension either by bath or probe sonication produces a progressive size reduction down to particles of less than about 50 nm in size. Homogenization is another method which relies on shearing energy to fragment larger particles into smaller ones. In a typical homogenization procedure, particles are recirculated through a standard emulsion homogenizer until selected particle sizes, typically between about 60 and about 80 nm, are observed. In both methods, the particle size distribution can be monitored by conventional laser-beam particle size discrimination, or QELS.

Extrusion of the particles through a small-pore polycarbonate membrane or an asymmetric ceramic membrane is also an effective method for reducing particle sizes to a relatively well-defined size distribution. Typically, the suspension is cycled through the membrane one or more times until the desired particle size distribution is achieved. The particles may be extruded through successively smaller-pore membranes, to achieve a gradual reduction in size.

In another group of embodiments, the serum-stable nucleic acid-lipid particles can be prepared as follows:

(a) preparing a mixture comprising cationic lipids and non-cationic lipids in an organic solvent;

(b) contacting an aqueous solution of nucleic acid with the mixture in step (a) to provide a clear single phase; and (c) removing the organic solvent to provide a suspension of nucleic acid-lipid particles, wherein the nucleic acid is encapsulated in a lipid bilayer and the particles are stable in serum and have a size of from about 50 to about 150 nm.

The nucleic acids (e.g., siRNA), cationic lipids, and non-cationic lipids which are useful in this group of embodiments are as described for the detergent dialysis methods above.

The selection of an organic solvent will typically involve consideration of solvent polarity and the ease with which the solvent can be removed at the later stages of particle formation. The organic solvent, which is also used as a solubilizing agent, is in an amount sufficient to provide a clear single phase mixture of nucleic acid and lipids. Suitable solvents include, but are not limited to, chloroform, dichloromethane, diethylether, cyclohexane, cyclopentane, benzene, toluene, methanol, or other aliphatic alcohols such as propanol, isopropanol, butanol, tert-butanol, iso-butanol, pentanol and hexanol. Combinations of two or more solvents may also be used in the present invention.

Contacting the nucleic acid with the organic solution of cationic and non-cationic lipids is accomplished by mixing together a first solution of nucleic acid, which is typically an aqueous solution, and a second organic solution of the lipids. One of skill in the art will understand that this mixing can take place by any number of methods, for example, by mechanical means such as by using vortex mixers.

After the nucleic acid has been contacted with the organic solution of lipids, the organic solvent is removed, thus forming an aqueous suspension of serum-stable nucleic acid-lipid particles. The methods used to remove the organic solvent will typically involve evaporation at reduced pressures or blowing a stream of inert gas (e.g., nitrogen or argon) across the mixture.

The serum-stable nucleic acid-lipid particles thus formed will typically be sized from about 50 nm to about 150 nm, from about 60 nm to about 130 nm, from about 70 nm to about 110 nm, or from about 70 nm to about 90 nm. To achieve further size reduction or homogeneity of size in the particles, sizing can be conducted as described above.

In other embodiments, the methods will further comprise adding non-lipid polycations which are useful to effect the delivery to cells using the present compositions. Examples of suitable non-lipid polycations include, but are limited to, hexadimethrine bromide (sold under the brand name POLYBRENE®, from Aldrich Chemical Co., Milwaukee, Wis., USA) or other salts of heaxadimethrine. Other suitable polycations include, for example, salts of poly-L-ornithine, poly-L-arginine, poly-L-lysine, poly-D-lysine, polyallylamine, and polyethyleneimine.

In certain embodiments, the formation of the nucleic acid-lipid particles can be carried out either in a mono-phase system (e.g., a Bligh and Dyer monophase or similar mixture of aqueous and organic solvents) or in a two-phase system with suitable mixing.

When formation of the complexes is carried out in a mono-phase system, the cationic lipids and nucleic acids are each dissolved in a volume of the mono-phase mixture. Combination of the two solutions provides a single mixture in which the complexes form. Alternatively, the complexes can form in two-phase mixtures in which the cationic lipids bind to the nucleic acid (which is present in the aqueous phase), and "pull" it into the organic phase.

In another embodiment, the serum-stable nucleic acid-lipid particles can be prepared as follows:

(a) contacting nucleic acids with a solution comprising non-cationic lipids and a detergent to form a nucleic acid-lipid mixture;

(b) contacting cationic lipids with the nucleic acid-lipid mixture to neutralize a portion of the negative charge of the nucleic acids and form a charge-neutralized mixture of nucleic acids and lipids; and (c) removing the detergent from the charge-neutralized mixture to provide the nucleic acid-lipid particles in which the nucleic acids are protected from degradation.

In one group of embodiments, the solution of non-cationic lipids and detergent is an aqueous solution. Contacting the nucleic acids with the solution of non-cationic lipids and detergent is typically accomplished by mixing together a first solution of nucleic acids and a second solution of the lipids and detergent. One of skill in the art will understand that this mixing can take place by any number of methods, for example, by mechanical means such as by using vortex mixers. Preferably, the nucleic acid solution is also a detergent solution. The amount of non-cationic lipid which is used in the present method is typically determined based on the amount of cationic lipid used, and is typically of from about 0.2 to about 5 times the amount of cationic lipid, preferably from about 0.5 to about 2 times the amount of cationic lipid used.

In some embodiments, the nucleic acids are precondensed as described in, e.g., U.S. patent application Ser. No. 09/744,103.

The nucleic acid-lipid mixture thus formed is contacted with cationic lipids to neutralize a portion of the negative charge which is associated with the nucleic acids (or other polyanionic materials) present. The amount of cationic lipids used will typically be sufficient to neutralize at least 50% of the negative charge of the nucleic acid. Preferably, the negative charge will be at least 70% neutralized, more preferably at least 90% neutralized. Cationic lipids which are useful in the present invention, include, for example, DLinDMA and DLenDMA. These lipids and related analogs are described in U.S. Patent Publication No. 20060083780.

Contacting the cationic lipids with the nucleic acid-lipid mixture can be accomplished by any of a number of techniques, preferably by mixing together a solution of the cationic lipid and a solution containing the nucleic acid-lipid mixture. Upon mixing the two solutions (or contacting in any other manner), a portion of the negative charge associated with the nucleic acid is neutralized. Nevertheless, the nucleic acid remains in an uncondensed state and acquires hydrophilic characteristics.

After the cationic lipids have been contacted with the nucleic acid-lipid mixture, the detergent (or combination of detergent and organic solvent) is removed, thus forming the nucleic acid-lipid particles. The methods used to remove the detergent will typically involve dialysis. When organic solvents are present, removal is typically accomplished by evaporation at reduced pressures or by blowing a stream of inert gas (e.g., nitrogen or argon) across the mixture.

The particles thus formed will typically be sized from about 50 nm to several microns, about 50 nm to about 150 nm, from about 60 nm to about 130 nm, from about 70 nm to about 110 nm, or from about 70 nm to about 90 nm. To achieve further size reduction or homogeneity of size in the particles, the nucleic acid-lipid particles can be sonicated, filtered, or subjected to other sizing techniques which are used in liposomal formulations and are known to those of skill in the art.

In other embodiments, the methods will further comprise adding non-lipid polycations which are useful to effect the lipofection of cells using the present compositions. Examples of suitable non-lipid polycations include, hexadimethrine bromide (sold under the brandname POLYBRENE®, from Aldrich Chemical Co., Milwaukee, Wis., USA) or other salts of hexadimethrine. Other suitable polycations include, for example, salts of poly-L-ornithine, poly-L-arginine, poly-L-lysine, poly-D-lysine, polyallylamine, and polyethyleneimine. Addition of these salts is preferably after the particles have been formed.

In another aspect, the serum-stable nucleic acid-lipid particles can be prepared as follows:

(a) contacting an amount of cationic lipids with nucleic acids in a solution; the solution comprising from about 15-35% water and about 65-85% organic solvent and the amount of cationic lipids being sufficient to produce a +/−charge ratio of from about 0.85 to about 2.0, to provide a hydrophobic nucleic acid-lipid complex;

(b) contacting the hydrophobic, nucleic acid-lipid complex in solution with non-cationic lipids, to provide a nucleic acid-lipid mixture; and (c) removing the organic solvents from the nucleic acid-lipid mixture to provide nucleic acid-lipid particles in which the nucleic acids are protected from degradation.

The nucleic acids (e.g., siRNA), non-cationic lipids, cationic lipids, and organic solvents which are useful in this aspect of the invention are the same as those described for the methods above which used detergents. In one group of embodiments, the solution of step (a) is a mono-phase. In another group of embodiments, the solution of step (a) is two-phase.

In preferred embodiments, the non-cationic lipids are ESM, DSPC, DOPC, POPC, monomethyl-phosphatidylethanolamine, dimethyl-phosphatidylethanolamine, DMPE, DPPE, DSPE, DOPE, DEPE, SOPE, POPE, PEG-based polymers (e.g., PEG 2000, PEG 5000, PEG-modified diacylglycerols, or PEG-modified dialkyloxypropyls), cholesterol, or combinations thereof. In still other preferred embodiments, the organic solvents are methanol, chloroform, methylene chloride, ethanol, diethyl ether or combinations thereof.

In one embodiment, the nucleic acid is an siRNA as described herein; the cationic lipid is DLindMA, DLenDMA, DODAC, DDAB, DOTMA, DOSPA, DMRIE, DOGS, or combinations thereof; the non-cationic lipid is ESM, DOPE, PEG-DAG, DSPC, DPPE, DMPE, monomethyl-phosphatidylethanolamine, dimethyl-phosphatidylethanolamine, DMPE, DPPE, DSPE, DOPE, DEPE, SOPE, POPE, cholesterol, or combinations thereof (e.g., DSPC and PEG-DAA); and the organic solvent is methanol, chloroform, methylene chloride, ethanol, diethyl ether or combinations thereof.

As above, contacting the nucleic acids with the cationic lipids is typically accomplished by mixing together a first solution of nucleic acids and a second solution of the lipids, preferably by mechanical means such as by using vortex mixers. The resulting mixture contains complexes as described above. These complexes are then converted to particles by the addition of non-cationic lipids and the removal of the organic solvent. The addition of the non-cationic lipids is typically accomplished by simply adding a solution of the non-cationic lipids to the mixture containing the complexes. A reverse addition can also be used. Subsequent removal of organic solvents can be accomplished by methods known to those of skill in the art and also described above.

The amount of non-cationic lipids which is used in this aspect of the invention is typically an amount of from about 0.2 to about 15 times the amount (on a mole basis) of cationic lipids which was used to provide the charge-neutralized nucleic acid-lipid complex. Preferably, the amount is from about 0.5 to about 9 times the amount of cationic lipids used.

In one embodiment, the nucleic acid-lipid particles preparing according to the above-described methods are either net charge neutral or carry an overall charge which provides the particles with greater gene lipofection activity. Preferably, the nucleic acid component of the particles is a nucleic acid which interferes with the production of an undesired protein. In other preferred embodiments, the non-cationic lipid may further comprise cholesterol.

A variety of general methods for making SNALP-CPLs (CPL-containing SNALPs) are discussed herein. Two general techniques include "post-insertion" technique, that is, insertion of a CPL into for example, a pre-formed SNALP, and the "standard" technique, wherein the CPL is included in the lipid mixture during for example, the SNALP formation steps. The post-insertion technique results in SNALPs having CPLs mainly in the external face of the SNALP bilayer membrane, whereas standard techniques provide SNALPs having CPLs on both internal and external faces. The method is especially useful for vesicles made from phospholipids (which can contain cholesterol) and also for vesicles containing PEG-lipids (such as PEG-DAAs and PEG-DAGs). Methods of making SNALP-CPL, are taught, for example, in U.S. Pat. Nos. 5,705,385; 6,586,410; 5,981,501; 6,534,484; and 6,852,334; U.S. Patent Publication No. 20020072121; and PCT Publication No. WO 00/62813.

VI. Kits

The present invention also provides nucleic acid-lipid particles in kit form. The kit may comprise a container which is compartmentalized for holding the various elements of the nucleic acid-lipid particles (e.g., the nucleic acids and the individual lipid components of the particles). In some embodiments, the kit may further comprise an endosomal membrane destabilizer (e.g., calcium ions). The kit typically contains the nucleic acid-lipid particle compositions of the present invention, preferably in dehydrated form, with instructions for their rehydration and administration. In certain instances, the particles and/or compositions comprising the particles may have a targeting moiety attached to the surface of the particle. Methods of attaching targeting moieties (e.g., antibodies, proteins) to lipids (such as those used in the present particles) are known to those of skill in the art.

VII. Administration of Nucleic Acid-Lipid Particles

Once formed, the serum-stable nucleic acid-lipid particles of the present invention are useful for the introduction of nucleic acids (i.e., siRNA that silences expression of a Filovirus gene) into cells. Accordingly, the present invention also provides methods for introducing a nucleic acid (e.g., siRNA and/or plasmid) into a cell. The methods are carried out in vitro or in vivo by first forming the particles as described above and then contacting the particles with the cells for a period of time sufficient for delivery of the nucleic acid to the cells to occur.

The nucleic acid-lipid particles of the present invention can be adsorbed to almost any cell type with which they are mixed or contacted. Once adsorbed, the particles can either be endocytosed by a portion of the cells, exchange lipids with cell membranes, or fuse with the cells. Transfer or incorporation of the nucleic acid portion of the particle can take place via any one of these pathways. In particular, when fusion takes place, the particle membrane is integrated into the cell membrane and the contents of the particle combine with the intracellular fluid.

The nucleic acid-lipid particles of the present invention can be administered either alone or in a mixture with a physiologically-acceptable carrier (such as physiological saline or phosphate buffer) selected in accordance with the route of administration and standard pharmaceutical practice. Generally, normal saline will be employed as the pharmaceutically acceptable carrier. Other suitable carriers include, e.g., water, buffered water, 0.4% saline, 0.3% glycine, and the like, including glycoproteins for enhanced stability, such as albumin, lipoprotein, globulin, etc.

The pharmaceutical carrier is generally added following particle formation. Thus, after the particle is formed, the particle can be diluted into pharmaceutically acceptable carriers such as normal saline.

The concentration of particles in the pharmaceutical formulations can vary widely, i.e., from less than about 0.05%, usually at or at least about 2-5% to as much as 10 to 30% by weight and will be selected primarily by fluid volumes, viscosities, etc., in accordance with the particular mode of administration selected. For example, the concentration may be increased to lower the fluid load associated with treatment. This may be particularly desirable in patients having atherosclerosis-associated congestive heart failure or severe hypertension. Alternatively, particles composed of irritating lipids may be diluted to low concentrations to lessen inflammation at the site of administration.

The pharmaceutical compositions of the present invention may be sterilized by conventional, well known sterilization techniques. Aqueous solutions can be packaged for use or filtered under aseptic conditions and lyophilized, the lyophilized preparation being combined with a sterile aqueous solution prior to administration. The compositions can contain pharmaceutically acceptable auxiliary substances as required to approximate physiological conditions, such as pH adjusting and buffering agents, tonicity adjusting agents and the like, for example, sodium acetate, sodium lactate, sodium chloride, potassium chloride, and calcium chloride. Additionally, the particle suspension may include lipid-protective agents which protect lipids against free-radical and lipid-peroxidative damages on storage. Lipophilic free-radical quenchers, such as alphatocopherol and water-soluble iron-specific chelators, such as ferrioxamine, are suitable.

The nucleic acid-lipid particles can be incorporated into a broad range of topical dosage forms including, but not limited to, gels, oils, emulsions, topical creams, pastes, ointments, lotions, foams, and the like.

A. In vivo administration

Systemic delivery for in vivo therapy, i.e., delivery of a therapeutic nucleic acid to a distal target cell via body systems such as the circulation, has been achieved using nucleic acid-lipid particles such as those disclosed in PCT Publication No. WO 96/40964 and U.S. Pat. Nos. 5,705,385; 5,976,567; 5,981,501; and 6,410,328. This latter format provides a fully encapsulated nucleic acid-lipid particle that protects the nucleic acid from nuclease degradation in serum, is nonimmunogenic, is small in size, and is suitable for repeat dosing.

For in vivo administration, administration can be in any manner known in the art, e.g., by injection, oral administration, inhalation (e.g., intransal or intratracheal), transdermal application, or rectal administration. Administration can be accomplished via single or divided doses. The pharmaceutical compositions can be administered parenterally, i.e., intraarticularly, intravenously, intraperitoneally, subcutaneously, or intramuscularly. In some embodiments, the pharmaceutical compositions are administered intravenously or intraperitoneally by a bolus injection (see, e.g., U.S. Pat. No. 5,286,634). Intracellular nucleic acid delivery has also been discussed in Straubringer et al., *Methods Enzymol.*, 101:512 (1983); Mannino et al., *Biotechniques*, 6:682 (1988); Nicolau et al., *Crit. Rev. Ther. Drug Carrier Syst.*, 6:239 (1989); and Behr, *Acc. Chem. Res.*, 26:274 (1993). Still other methods of administering lipid based therapeutics are described in, for example, U.S. Pat. Nos. 3,993,754; 4,145,410; 4,235,871; 4,224,179; 4,522,803; and 4,588,578. The lipid nucleic acid particles can be administered by direct injection at the site of disease or by injection at a site distal from the site of disease (see, e.g., Culver, HUMAN GENE THERAPY, MaryAnn Liebert, Inc., Publishers, New York. pp. 70-71(1994)).

The compositions of the present invention, either alone or in combination with other suitable components, can be made into aerosol formulations (i.e., they can be "nebulized") to be administered via inhalation (e.g., intranasally or intratracheally) (see, Brigham et al., *Am. J. Sci.*, 298:278 (1989)). Aerosol formulations can be placed into pressurized acceptable propellants, such as dichlorodifluoromethane, propane, nitrogen, and the like.

Formulations suitable for parenteral administration, such as, for example, by intraarticular (in the joints), intravenous, intramuscular, intradermal, intraperitoneal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. In the practice of this invention, compositions can be administered, for example, by intravenous infusion, orally, topically, intraperitoneally, intravesically, or intrathecally.

Formulations suitable for oral administration can consist of: (a) liquid solutions, such as an effective amount of the packaged nucleic acid suspended in diluents such as water, saline, or PEG 400; (b) capsules, sachets, or tablets, each containing a predetermined amount of the active ingredient, as liquids, solids, granules, or gelatin; (c) suspensions in an appropriate liquid; and (d) suitable emulsions. Tablet forms can include one or more of lactose, sucrose, mannitol, sorbitol, calcium phosphates, corn starch, potato starch, microcrystalline cellulose, gelatin, colloidal silicon dioxide, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, e.g., sucrose, as well as pastilles comprising the active ingredient in an inert base, such as gelatin and glycerin or sucrose and acacia emulsions, gels, and the like containing, in addition to the active ingredient, carriers known in the art.

Generally, when administered intravenously, the nucleic acid-lipid formulations are formulated with a suitable pharmaceutical carrier. Many pharmaceutically acceptable carriers may be employed in the compositions and methods of the present invention. Suitable formulations for use in the present invention are found, for example, in REMINGTON'S PHARMACEUTICAL SCIENCES, Mack Publishing Company, Philadelphia, Pa., 17th ed. (1985). A variety of aqueous carriers may be used, for example, water, buffered water, 0.4% saline, 0.3% glycine, and the like, and may include glycoproteins for enhanced stability, such as albumin, lipoprotein, globulin, etc. Generally, normal buffered saline (135-150 mM NaCl) will be employed as the pharmaceutically acceptable carrier, but other suitable carriers will suffice. These compositions can be sterilized by conventional liposomal sterilization techniques, such as filtration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc. These compositions can be sterilized using the techniques referred to above or, alternatively, they can be produced under sterile conditions. The resulting aqueous solutions may be packaged for use or filtered under aseptic conditions and lyophilized, the lyophilized preparation being combined with a sterile aqueous solution prior to administration.

When preparing pharmaceutical preparations of the nucleic acid-lipid particles of the invention, it is preferable to use quantities of the particles which have been purified to reduce or eliminate empty particles or particles with nucleic acid associated with the external surface.

The methods of the present invention may be practiced in a variety of hosts. Preferred hosts include mammalian species, such as avian (e.g., ducks), primates (e.g., humans and chimpanzees as well as other nonhuman primates), canines, felines, equines, bovines, ovines, caprines, rodents (e.g., rats and mice), lagomorphs, and swine.

The amount of particles administered will depend upon the ratio of nucleic acid to lipid, the particular nucleic acid used, the disease state being diagnosed, the age, weight, and condition of the patient, and the judgment of the clinician, but will generally be between about 0.01 and about 50 mg per kilogram of body weight, preferably between about 0.1 and about 5 mg/kg of body weight, or about $10^8$-$10^{10}$ particles per injection.

B. Cells for delivery of interfering RNA

The compositions and methods of the present invention are used to treat a wide variety of cell types, in vivo and in vitro. Suitable cells include, e.g., hematopoietic precursor (stem) cells, fibroblasts, keratinocytes, hepatocytes, endothelial cells, skeletal and smooth muscle cells, osteoblasts, neurons, quiescent lymphocytes, terminally differentiated cells, slow or noncycling primary cells, parenchymal cells, lymphoid cells, epithelial cells, bone cells, and the like.

In vivo delivery of nucleic acid-lipid particles encapsulating an interfering RNA is suited for targeting cells of any cell type. The methods and compositions can be employed with cells of a wide variety of vertebrates, including mammals, such as, e.g, canines, felines, equines, bovines, ovines, caprines, rodents (e.g., mice, rats, and guinea pigs), lagomorphs, swine, and primates (e.g. monkeys, chimpanzees, and humans).

To the extent that tissue culture of cells may be required, it is well known in the art. For example, Freshney, Culture of Animal Cells, a Manual of Basic Technique, 3rd Ed., Wiley-Liss, New York (1994), Kuchler et al., Biochemical Methods in Cell Culture and Virology, Dowden, Hutchinson and Ross, Inc. (1977), and the references cited therein provide a general guide to the culture of cells. Cultured cell systems often will be in the form of monolayers of cells, although cell suspensions are also used.

C. Detection of SNALPs

In some embodiments, the nucleic acid-lipid particles are detectable in the subject at about 8, 12, 24, 48, 60, 72, or 96 hours, or 6, 8, 10, 12, 14, 16, 18, 19, 22, 24, 25, or 28 days after administration of the particles. The presence of the particles can be detected in the cells, tissues, or other biological samples from the subject. The particles may be detected, e.g., by direct detection of the particles, detection of the interfering RNA sequence, detection of the target sequence of interest (i.e., by detecting expression or reduced expression of the Filovirus sequence of interest), detection of a compound modulated by a Filovirus protein (e.g., interferon), detection of viral load in the subject, or a combination thereof.

1. Detection of Particles

Nucleic acid-lipid particles can be detected using any methods known in the art. For example, a label can be coupled directly or indirectly to a component of the SNALP or other lipid-based carrier system using methods well known in the art. A wide variety of labels can be used, with the choice of label depending on sensitivity required, ease of conjugation with the SNALP component, stability requirements, and available instrumentation and disposal provisions. Suitable labels include, but are not limited to, spectral labels such as fluorescent dyes (e.g., fluorescein and derivatives, such as fluorescein isothiocyanate (FITC) and Oregon Green™; rhodamine and derivatives such Texas red, tetrarhodimine isothiocynate (TRITC), etc., digoxigenin, biotin, phycoerythrin, AMCA, CyDyes™, and the like; radiolabels such as $^3H$, $^{125}I$, $^{35}S$, $^{14}C$, $^{32}P$, $^{33}P$, etc.; enzymes such as horse radish peroxidase, alkaline phosphatase, etc.; spectral colorimetric labels such as colloidal gold or colored glass or plastic beads such as polystyrene, polypropylene, latex, etc. The label can be detected using any means known in the art.

2. Detection of Nucleic Acids

Nucleic acids (i.e., siRNA that silence expression of a Filovirus gene) are detected and quantified herein by any of a number of means well known to those of skill in the art. The detection of nucleic acids proceeds by well known methods such as Southern analysis, Northern analysis, gel electrophoresis, PCR, radiolabeling, scintillation counting, and affinity chromatography. Additional analytic biochemical methods such as spectrophotometry, radiography, electrophoresis, capillary electrophoresis, high performance liquid chromatography (HPLC), thin layer chromatography (TLC), and hyperdiffusion chromatography may also be employed.

The selection of a nucleic acid hybridization format is not critical. A variety of nucleic acid hybridization formats are known to those skilled in the art. For example, common formats include sandwich assays and competition or displacement assays. Hybridization techniques are generally described in, e.g., "Nucleic Acid Hybridization, A Practical Approach," Eds. Hames and Higgins, IRL Press (1985).

The sensitivity of the hybridization assays may be enhanced through use of a nucleic acid amplification system which multiplies the target nucleic acid being detected. In vitro amplification techniques suitable for amplifying sequences for use as molecular probes or for generating nucleic acid fragments for subsequent subcloning are known. Examples of techniques sufficient to direct persons of skill through such in vitro amplification methods, including the polymerase chain reaction (PCR) the ligase chain reaction (LCR), Qβ-replicase amplification and other RNA polymerase mediated techniques (e.g., NASBA®) are found in Sambrook et al., In *Molecular Cloning: A Laboratory Manual*, Cold Spring Harbor Laboratory Press (2000); and Ausubel et al., SHORT PROTOCOLS IN MOLECULAR BIOLOGY, eds., Current Protocols, Greene Publishing Associates, Inc. and John Wiley & Sons, Inc. (2002); as well as U.S. Pat. No. 4,683,202; PCR Protocols, A Guide to Methods and Applications (Innis et al. eds.) Academic Press Inc. San Diego, Calif. (1990); Arnheim & Levinson (Oct. 1, 1990), *C&EN*36; *The Journal Of NIH Research,* 3:81 (1991); Kwoh et al., *Proc. Natl. Acad. Sci. USA,* 86:1173 (1989); Guatelli et al., *Proc. Natl. Acad. Sci. USA,* 87:1874 (1990); Lomell et al., *J. Clin. Chem.,* 35:1826 (1989); Landegren et al., *Science,* 241:1077 (1988); Van Brunt, *Biotechnology,* 8:291 (1990); Wu and Wallace, *Gene,* 4:560 (1989); Barringer et al., *Gene,* 89:117 (1990); and Sooknanan and Malek, *Biotechnology,* 13:563 (1995). Improved methods of cloning in vitro amplified nucleic acids are described in U.S. Pat. No. 5,426,039. Other methods described in the art are the nucleic acid sequence based amplification (NASBA®, Cangene, Mississauga, Ontario) and Q Beta Replicase systems. These systems can be used to directly identify mutants where the PCR or LCR primers are designed to be extended or ligated only when a select sequence is present. Alternatively, the select sequences can be generally amplified using, for example, nonspecific PCR primers and the amplified target region later probed for a specific sequence indicative of a mutation.

Oligonucleotides for use as probes, e.g., in in vitro amplification methods, for use as gene probes, or as inhibitor components are typically synthesized chemically according to the solid phase phosphoramidite triester method described by Beaucage and Caruthers, *Tetrahedron Letts.,* 22(20):1859 1862 (1981), e.g., using an automated synthesizer, as described in Needham VanDevanter et al., *Nucleic Acids Res.,* 12:6159 (1984). Purification of oligonucleotides, where necessary, is typically performed by either native acrylamide gel electrophoresis or by anion exchange HPLC as described in Pearson and Regnier, *J. Chrom.,* 255:137 149 (1983). The sequence of the synthetic oligonucleotides can be verified using the chemical degradation method of Maxam and Gilbert (1980) in Grossman and Moldave (eds.) Academic Press, New York, *Methods in Enzymology,* 65:499.

An alternative means for determining the level of transcription is in situ hybridization. In situ hybridization assays are well known and are generally described in Angerer et al., *Methods Enzymol.,* 152:649 (1987). In an in situ hybridization assay cells are fixed to a solid support, typically a glass slide. If DNA is to be probed, the cells are denatured with heat or alkali. The cells are then contacted with a hybridization solution at a moderate temperature to permit annealing of specific probes that are labeled. The probes are preferably labeled with radioisotopes or fluorescent reporters.

D. Detection of an Immune Response

An immune response induced by the siRNA (i.e., siRNA that silences expression of a Filovirus gene) described herein can be long-lived and can be detected long after administration of the siRNA or nucleic acid-lipid particles containing the siRNA. An immune response to the siRNA can be detected by using immunoassays that detect the presence or absence of cytokines and growth factors e.g., produced by responder cells.

Suitable immunoassays include the double monoclonal antibody sandwich immunoassay technique of David et al. (U.S. Pat. No. 4,376,110); monoclonal-polyclonal antibody sandwich assays (Wide et al., in Kirkham and Hunter, eds., *Radioimmunoassay Methods*, E. and S. Livingstone, Edinburgh (1970)); the "Western blot" method of Gordon et al. (U.S. Pat. No. 4,452,901); immunoprecipitation of labeled ligand (Brown et al., *J. Biol. Chem.* 255:4980-4983 (1980)); enzyme-linked immunosorbent assays (ELISA) as described, for example, by Raines et al., *J. Biol. Chem.,* 257:5154-5160 (1982); immunocytochemical techniques, including the use of fluorochromes (Brooks et al., *Clin. Exp. Immunol.,* 39:477 (1980)); and neutralization of activity (Bowen-Pope et al., *Proc. Natl. Acad. Sci. USA,* 81:2396-2400 (1984)). In addition to the immunoassays described above, a number of other immunoassays are available, including those described in U.S. Pat. Nos. 3,817,827; 3,850,752; 3,901,654; 3,935,074; 3,984,533; 3,996,345; 4,034,074; and 4,098,876.

Monoclonal antibodies that specifically bind cytokines and growth factors (e.g., IL-6, IL-12, TNF-α, IFN-α, and IFN-γ can be generated using methods known in the art (see, e.g., Kohler and Milstein, *Nature,* 256: 495-497 (1975); and Harlow and Lane, ANTIBODIES, A LABORATORY MANUAL, Cold Spring Harbor Publication, New York (1999)). Generation of monoclonal antibodies has been previously described and can be accomplished by any means known in the art (see, e.g., Buhring et al., in Hybridoma, Vol. 10, No. 1, pp. 77-78 (1991)). For example, an animal such as a guinea pig or rat, preferably a mouse, is immunized with an immunogenic polypeptide, the antibody-producing cells, preferably splenic lymphocytes, are collected and fused to a stable, immortalized cell line, preferably a myeloma cell line, to produce hybridoma cells which are then isolated and cloned. See, e.g., U.S. Pat. No. 6,156,882. In some methods, the monoclonal antibody is labeled to facilitate detection.

E. Detection of Filovirus Load

Filovirus load can be detected using any means known in the art. Typically, filovirus load is detected in a biological sample from the subject. For example, viral load in the subject's blood can be detected by measuring Filovirus antigens using an immunoassay such as an ELISA (see, e.g., Meissner et al., *Virology*, 300:236-43 (2002); and Ksiazek et al., *J. Clin. Microbiol.*, 30:947-950 (1992)). Viral load can also be detected by amplifying Filovirus nucleic acids (see, e.g., Drosten et al., *J. Clin. Microbiol.*, 40: 2323-2330 (2002)) or by conventional plaque assay using monolayers of Vero or Vero E6 cells (see, e.g., Jahrling, Filoviruses and Arenaviruses, In *Manual of Clinical Microbiology*, Eds. Baron, Pfaller, Tenover, and Yolken, ASM Press, Washington, D.C. (1999)).

VIII. Examples

The present invention will be described in greater detail by way of the following examples. The following examples are offered for illustrative purposes, and are not intended to limit the present invention in any manner. Those of skill in the art will readily recognize a variety of noncritical parameters which can be changed or modified to yield essentially the same results.

Example 1

Materials and Methods siRNA: All siRNA used in these studies were chemically synthesized by Dharmacon Inc. (Chicago, Ill.) or Trilink Biotechnologies, Inc. (San Diego, Calif.) and received as desalted, pre-annealed duplexes.

Lipid Encapsulation of siRNA: Unless otherwise indicated, siRNAs were encapsulated into liposomes composed of the following lipids: synthetic cholesterol (Sigma; St. Louis, Mo.), the phospholipid DSPC (1,2-distearoyl-sn-glycero-3-phosphocholine; Avanti Polar Lipids; Alabaster, Ala.), the PEG-lipid PEG-cDMA (3-N-[(-Methoxy poly(ethylene glycol)2000)carbamoyl]-1,2-dimyrestyloxy-propylamine), and the cationic lipid DLinDMA (1,2-Dilinoleyloxy-3-(N,N-dimethyl)aminopropane) in the molar ratio 48:20:2:30. The resulting SNALPs were dialyzed in PBS and filter sterilized through a 0.2 μm filter prior to use. Particle sizes ranged from 71 to 84 nm and typically 90-95% of the siRNA was found to be encapsulated within the liposome. For vehicle controls, empty liposomes with identical lipid composition were formed in the absence of siRNA.

Cell culture studies: siRNAs (60 pmol) were transfected into Vero cells using Oligofectamine (Invitrogen; Carlsbad, Calif.) according to the manufacturer's instructions. At 0, 24, or 48 hours after transfection, cultures were infected with Ebola-Zaire at a MOI of 1.0. Culture fluids were collected at 24, 48, and 96 hours for determination of infectious Ebola-Zaire, and Vero cells were collected for immunofluorescence staining.

Polyplex treatment and Ebola challenge of guinea pigs: Strain 13 guinea pigs were bred at the U.S. Army Medical Research Institute of Infectious Diseases (USAMRIID). siRNAs (30 nmol ttal) were mixed with In vivo jetPEI® (Qbiogene, Inc.; Carlsbad, Calif.) according to the manufacturer's instructions at an N/P ratio of 5 at room temperature for 20 min. Guinea pigs were treated intravenously with 300 μl of the In vivo jetPEI® polyplexes, corresponding to 8 mg/kg siRNA, by retroorbital injection. Three hours after treatment, guinea pigs were challenged by subcutaneous injection with 1,000 plaque forming units (pfu) of guinea pig-adapted Ebola-Zaire. The guinea pigs received additional treatments of the In vivo jetPEI® polyplexes at 24, 48, and 96 hours after the Ebola-Zaire challenge. Blood was collected by cardiac puncture and processed as plasma for analysis of viremia.

SNALP treatment and Ebola challenge of guinea pigs: SNALP-formulated siRNAs were administered intravenously at a concentration of 1 mg/ml in PBS by retroorbital injection 1 hour after challenge of strain 13 guinea pigs by subcutaneous injection with 1000 pfu of guinea pig-adapted Ebola-Zaire. The guinea pigs received additional treatments of the SNALP-formulated siRNAs at 24, 48, 72, 96, 120, and 144 hours after the Ebola-Zaire challenge. Blood was collected by cardiac puncture and processed as plasma for analysis of viremia. Animals were carefully monitored for signs of disease and survival during the time course of the study.

In vivo cytokine induction: 6-8 week old CD1 ICR mice were obtained from Harlan (Indianapolis, Ind.) and subject to a three week quarantine and acclimation period prior to use. siRNA and lipid formulations were administered as a single intravenous injection in the lateral tail vein in 0.2 ml PBS. Injections were administered over a period of 3-5 seconds. Blood was collected by cardiac puncture 6 hours after administration and processed as plasma for cytokine analysis. Mouse IFN-α and IFN-β were quantified using sandwich ELISA kits (PBL Biomedical; Piscataway, N.J.).

Immunofluorescence Assay: Cells were fixed with 10% neutral-buffered formalin for 24 hours to inactivate infectious Ebola-Zaire. After fixation, cells were washed with copious amounts of PBS and processed for immunofluorescence staining for viral proteins. Briefly, cells were incubated in Ready to Use Proteinase K (Dako; Carpinteria, Calif.) at room temperature for 10 min. Cells were washed in PBS and blocked in normal goat serum (KPL Laboratories; Gaithursburg, Md.) for 20 min at room temperature. Viral antigen was detected by incubating cells in a mouse monoclonal antibody against the guinea pig-adapted Ebola-Zaire for 20 min at room temperature, rinsed in PBS, and incubated with an anti-mouse Alexa Flour® 488 conjugate (Invitrogen Corp.; Carlsbad, Calif.) for 20 min at room temperature. Nuclei were counterstained with DAPI to aid in visualization. Percentage of antigen-positive cells was determined by examining random fields for fluorescence.

Example 2

Selection of Candidate L-pol VP24 VP30 VP35 and NP siRNA

Candidate L-pol, VP24, VP30, VP35, and NP sequences were identified by scanning the sequence to identify AA dinucleotide motifs and the 19 nucleotides 3' of the motif. The following candidate sequences were eliminated: (1) sequences comprising a stretch of 4 or more of the same base in a row; (2) sequences comprising homopolymers of Gs; (3) sequences comprising triple base motifs (GGG, CCC, AAA, or TTT); (4) sequences comprising stretches of 7 or more G/Cs in a row; and (5) sequences comprising direct repeats of 4 or more bases resulting in internal fold-back structures.

Reynold's Rational Design criteria was then applied to the remaining candidate sequences to identify sequences with:
1. 30%-52% GC content;
2. At least 3 A/Us at positions 15-19 (sense);
3. Absence of internal repeats;
4. A at position 19 (sense);
5. A at position 3 (sense);
6. U at position 10 (sense);
7. No G/C at position 19 (sense); and
8. No G at position 13 (sense).

Next, the following criteria were removed to identify additional candidate sequences of interest: 30-52% GC; the requirement for a AA leader sequence; and triplet motifs. BLASTn was used to identify sequences that do not cross-hybridize in humans. The candidate sequences are shown in Tables 1-13. Additional siRNA sequences that target Ebola virus or Marburg virus gene expression are shown in Tables 14-15.

Lengthy table referenced here

US07838658-20101123-T00001

Please refer to the end of the specification for access instructions.

Lengthy table referenced here

US07838658-20101123-T00002

Please refer to the end of the specification for access instructions.

Lengthy table referenced here

US07838658-20101123-T00003

Please refer to the end of the specification for access instructions.

Lengthy table referenced here

US07838658-20101123-T00004

Please refer to the end of the specification for access instructions.

Lengthy table referenced here

US07838658-20101123-T00005

Please refer to the end of the specification for access instructions.

Lengthy table referenced here

US07838658-20101123-T00006

Please refer to the end of the specification for access instructions.

Lengthy table referenced here

US07838658-20101123-T00007

Please refer to the end of the specification for access instructions.

Lengthy table referenced here

US07838658-20101123-T00008

Please refer to the end of the specification for access instructions.

Lengthy table referenced here

US07838658-20101123-T00009

Please refer to the end of the specification for access instructions.

Lengthy table referenced here

US07838658-20101123-T00010

Please refer to the end of the specification for access instructions.

Lengthy table referenced here

US07838658-20101123-T00011

Please refer to the end of the specification for access instructions.

Lengthy table referenced here

US07838658-20101123-T00012

Please refer to the end of the specification for access instructions.

Lengthy table referenced here

US07838658-20101123-T00013

Please refer to the end of the specification for access instructions.

Lengthy table referenced here

US07838658-20101123-T00014

Please refer to the end of the specification for access instructions.

Lengthy table referenced here

US07838658-20101123-T00015

Please refer to the end of the specification for access instructions.

Example 3

Uptake Properties of siRNA

Cy3-labeled siRNA complexed with cationic lipid-containing liposomes was administered to mice intravenously through their tail vein. Cell nuclei were counterstained with DAPI. The siRNA was taken up by Kupfer cells and resident liver macrophages.

Example 4 siRNA Targeting Ebola L-pol Inhibits Ebola Virus Replication In Vitro

Figure 2:
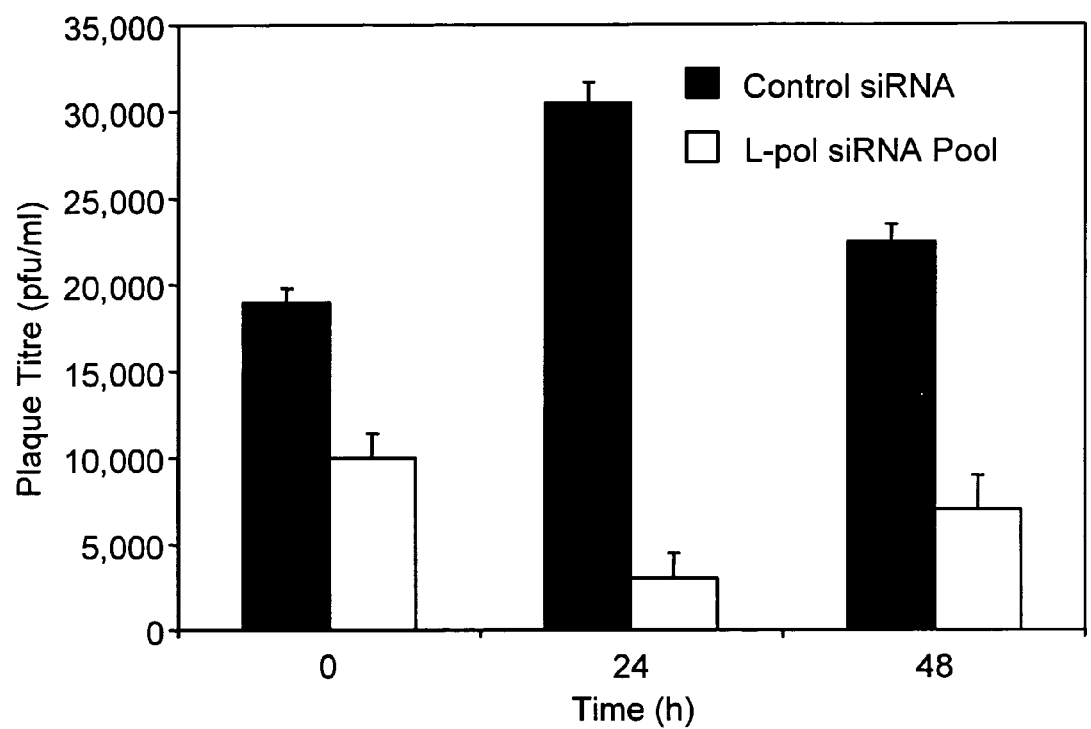
FIG. 2 illustrates data demonstrating that the production of Ebola virus progeny was inhibited in Vero cells transfected with siRNA targeting Ebola L-pol as determined by plaque assay.
Figure 3:
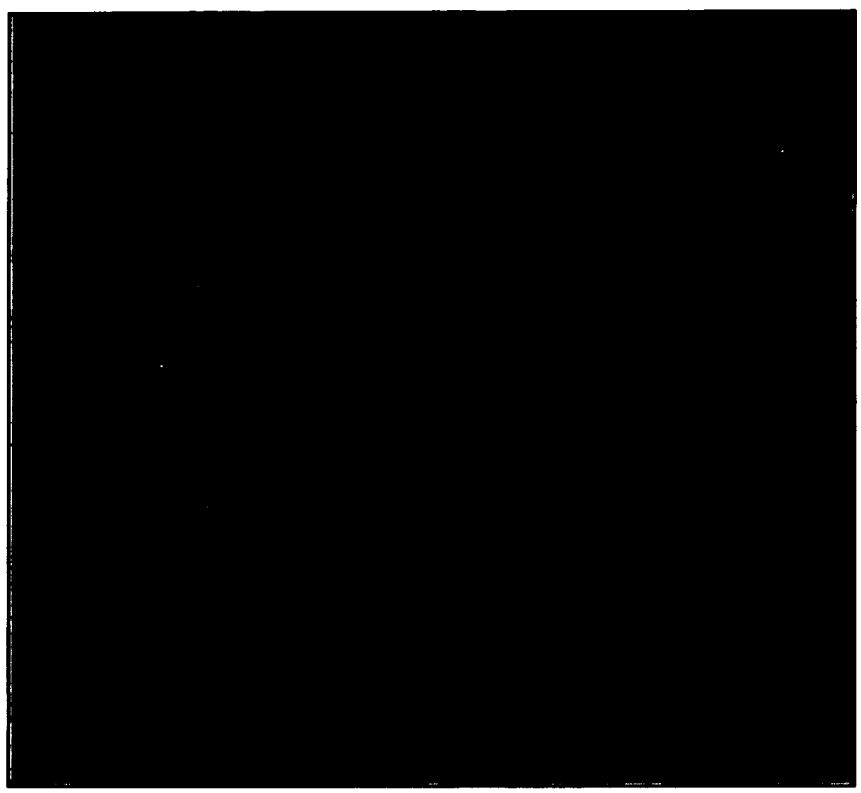
FIG. 3 illustrates data demonstrating that the production of Ebola virus progeny was inhibited in Vero cells transfected with siRNA targeting Ebola L-pol as determined by immunofluorescence antibody staining.
Figure 3:
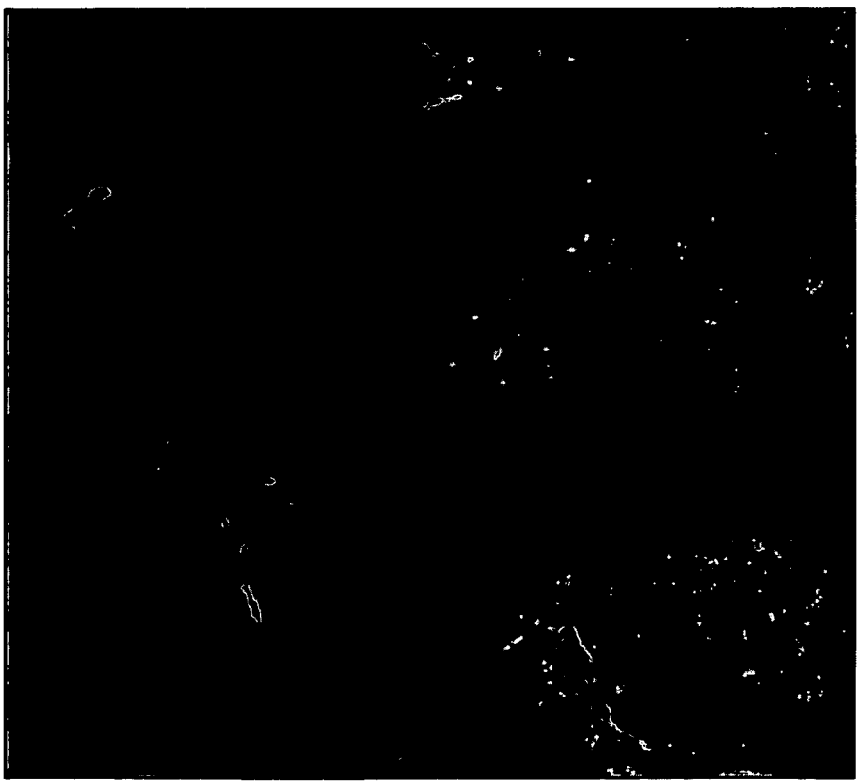

A pool of siRNAs targeting Ebola-Zaire L-pol was complexed with cationic-lipid containing liposomes to form lipoplexes and contacted with Vero cells. The siRNAs had the following sequences: EK1, EK2, EK3, and EK4 (see, Table 1). At various time points after transfection (0, 24, or 48 hours), the transfected cells were infected with Ebola-Zaire at an MOI of 1.0. Cells and culture fluids were harvested 24 hours later to determine virus production. FIG. 2 shows that the siRNA pool inhibited the production of infectious Ebola-Zaire by 2-fold to 10-fold, depending on when the transfected cells were infected. FIG. 3 shows that an 83±14% (P=0.006, Student's T-test) reduction in the number of cells expressing Ebola virus protein was demonstrated by immunofluorescence antibody staining. Individual testing of the four siRNAs targeting Ebola-Zaire L-pol yielded similar results. Thus, lipoplexes containing siRNA targeting Ebola-Zaire L-pol inhibited Ebola replication in vitro.

Example 5 siRNA Targeting Ebola L-pol Reduces Viral Load In Vivo

Figure 4:
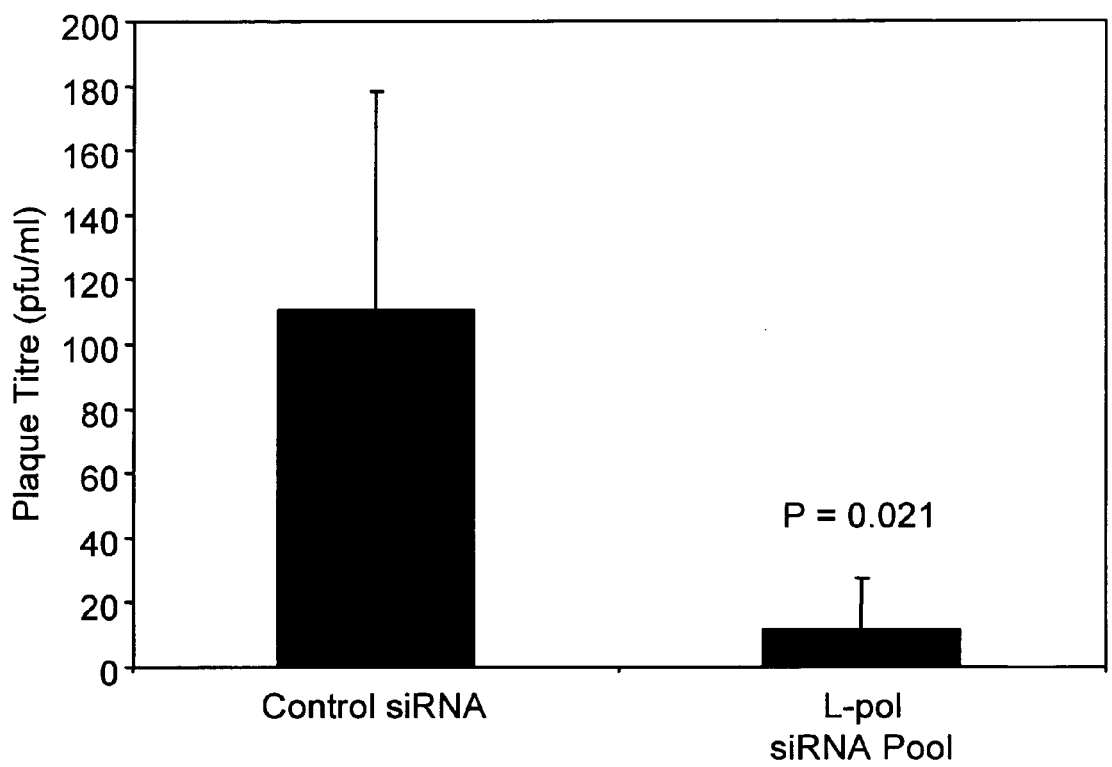
FIG. 4 illustrates data demonstrating that guinea pigs treated with siRNA targeting Ebola L-pol complexed with PEI had a reduced viral load in their plasma.

Guinea pigs were treated with either the pool of siRNAs targeting Ebola-Zaire L-pol (i.e., EK1, EK2, EK3, and EK4) (5 animals) or an irrelevant scrambled siRNA sequence (5 animals). The siRNAs were complexed with polyethylenimine (PEI) to form polyplexes and injected retroorbitally 3 hours before challenge with 1,000 pfu of Ebola-Zaire. Animals received equivalent doses of siRNAs (8 mg/kg) at 24, 48, and 96 hours after Ebola-Zaire challenge. FIG. 4 shows that a significant reduction in plasma viremia (P=0.021) was demonstrated at day 4 after Ebola-Zaire challenge in the animals receiving the pool of siRNAs targeting Ebola-Zaire L-pol compared to those given the control siRNA sequence. In fact, the L-pol siRNA pool reduced viral load by over 80%.

Example 6

Figure 5:
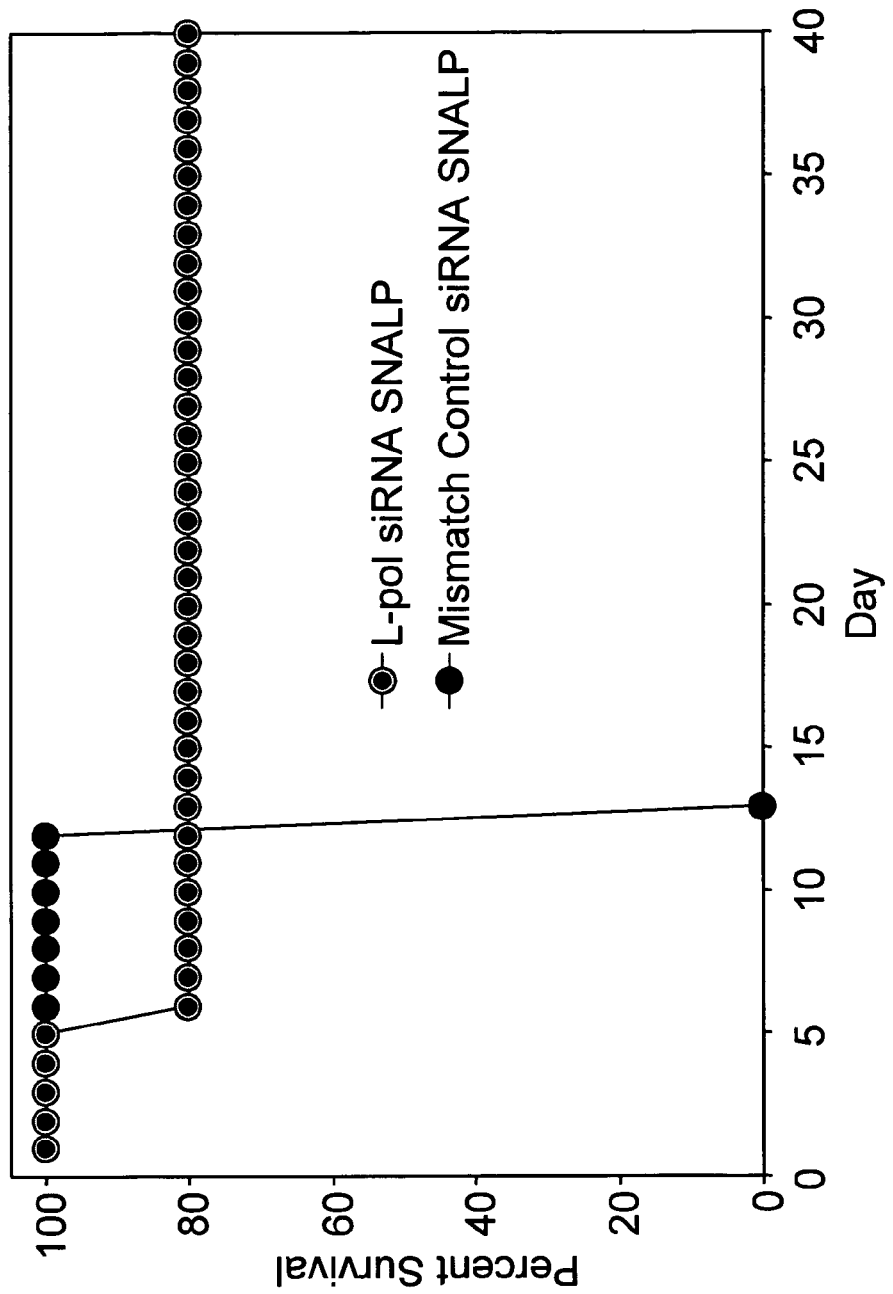
FIG. 5 illustrates data demonstrating that administration of 4 doses of SNALP encapsulating 1 mg/kg siRNA targeting Ebola L-pol protected guinea pigs challenged with a lethal dose of Ebola virus.

SNALP Encapsulating siRNA Targeting Ebola L-pol Protect from Ebola Challenge Guinea pigs were challenged with 1,000 pfu of infectious Ebola-Zaire. One hour following viral challenge, SNALP (DLinDMA:PEG-cDMA:DSPC:Chol in the molar ratio 30:2:20:48) encapsulating a cocktail of siRNA targeting Ebola-Zaire L-pol (i.e., EK1, EK2, EK3, and EK4) were administered to the guinea pigs retroorbitally once per day for 4 days at a dose of 1 mg siRNA per kg. FIG. 5 shows that 80% of the guinea pigs receiving SNALP encapsulating siRNA targeting Ebola-Zaire L-pol survived beyond 40 days, while none of the control animals survived past 14 days. Plasma viremia levels were not detected at day 7 in any of the animals treated with the L-pol siRNA pool, but ranged from about 3.5 to 4.5 log10 pfu/ml in the control animals.

Example 7

Figure 6:
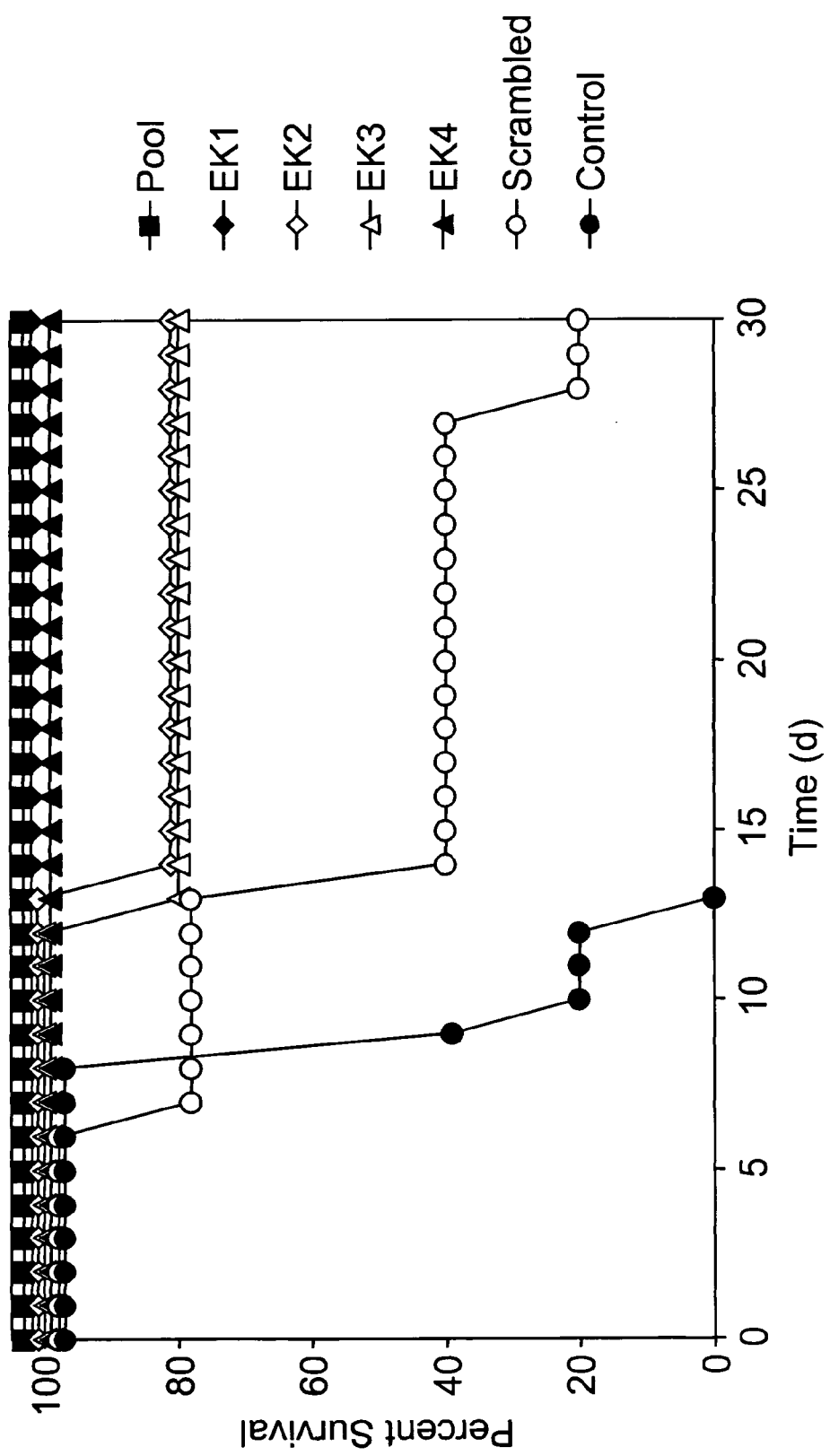
FIG. 6 illustrates data demonstrating that administration of 6 doses of SNALP encapsulating 0.75 mg/kg siRNA targeting Ebola L-pol protected guinea pigs challenged with a lethal dose of Ebola virus.

SNALP Encapsulating siRNA Targeting Ebola L-pol Protect from Ebola Challenge Guinea pigs were challenged with 1,000 pfu of infectious Ebola-Zaire. One hour following viral challenge, SNALP (DLinDMA:PEG-cDMA:DSPC:Chol in the molar ratio 30:2:20:48) encapsulating either individual siRNA targeting Ebola-Zaire L-pol (i.e., EK1, EK2, EK3, or EK4) or a pool of siRNA targeting Ebola-Zaire L-pol (i.e., EK1, EK2, EK3, and EK4) were administered once per day for 6 days to the guinea pigs retroorbitally at a dose of 0.75 mg siRNA per kg. PBS or SNALP encapsulating scrambled siRNA sequences was administered to control animals. FIG. 6 shows that 100% of the guinea pigs that received SNALP encapsulating EK1 or EK4 or the siRNA pool containing EK1, EK2, EK3, and EK4 survived beyond 30 days, 80% of the guinea pigs that received SNALP encapsulating EK2 or EK3 survived beyond 30 days, while none of the control animals that received PBS survived past 14 days and only 20% of the control animals that received scrambled siRNA survived past 30 days.

Example 8

Figure 7:
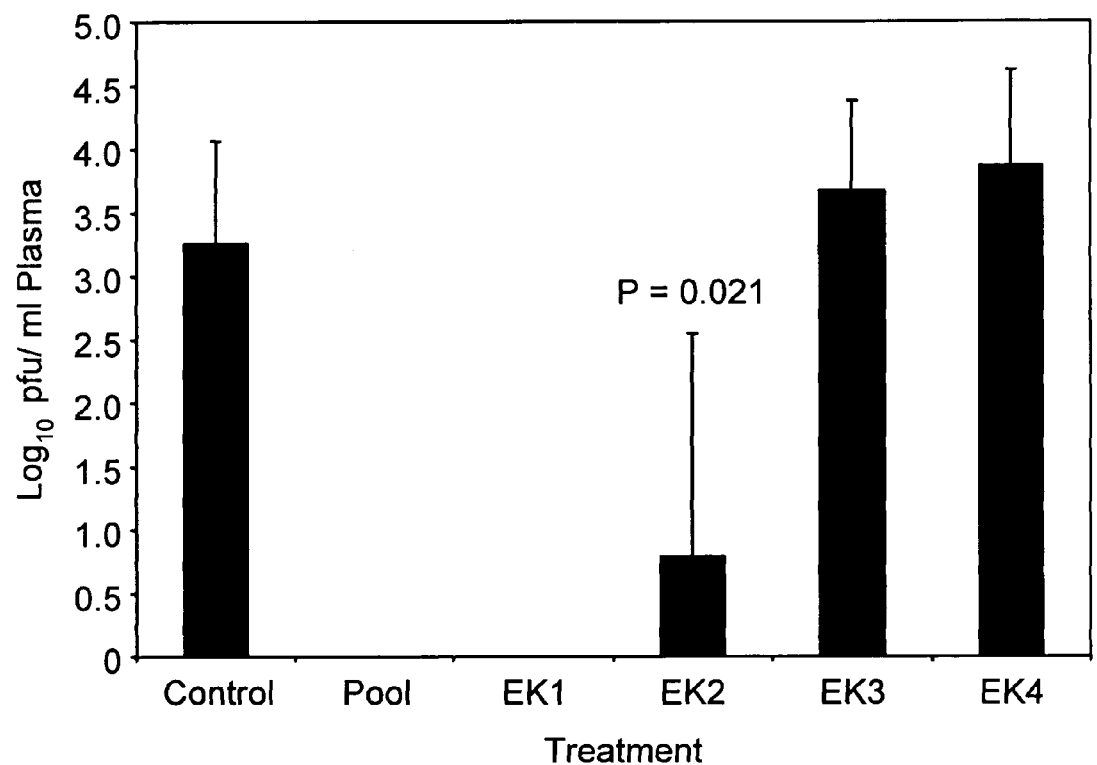
FIG. 7 illustrates data demonstrating that administration of 6 doses of SNALP encapsulating 0.75 mg/kg siRNA targeting Ebola L-pol inhibited Ebola viral replication in vivo.

SNALP Encapsulating siRNA Targeting Ebola L-pol Inhibit Ebola Virus Replication In Vivo Guinea pigs were challenged with 1,000 pfu of infectious Ebola-Zaire. One hour following viral challenge, SNALP (DLinDMA:PEG-cDMA:DSPC:Chol in the molar ratio 30:2:20:48) encapsulating either individual siRNA targeting Ebola-Zaire L-pol (i.e., EK1, EK2, EK3, or EK4) or a pool of siRNA targeting Ebola-Zaire L-pol (i.e., EK1, EK2, EK3, and EK4) were administered to the guinea pigs retroorbitally once a day for 6 days at a dose of 0.75 mg siRNA per kg. PBS or SNALP encapsulating scrambled siRNA sequences was administered to control animals. On day 7 following administration of SNALP, plasma viral load was measured. Guinea pigs that received SNALP encapsulating EK1 or the pool containing EK1, EK2, EK3, and EK4 exhibited no detectable viral load. Guinea pigs that received SNALP encapsulating EK2 exhibited a viral load 10 fold lower than that of control animals (P=0.021). The results are shown in FIG. 7.

Example 9

SNALP Encapsulating siRNA Targeting Ebola L-pol Protect from Ebola Challenge Mice were challenged with 1,000 pfu of infectious Ebola-Zaire. Following viral challenge, mice were administered intravenously through their tail vein one of the SNALP formulations shown in Table 16. Groups of 10 mice were administered: (1) SNALP encapsulating EK1 siRNA targeting Ebola-Zaire L-pol (SNALP 1, 3, 4, or 5 of Table 16); (2) PBS (virus only control); or (3) SNALP encapsulating a control β-galactosidase siRNA sequence (SNALP 2 of Table 16).

TABLE 16

Summary of the SNALP formulations used in this study.

| SNALP | siRNA | Lipid Composition | Nucleic Acid:Lipid Ratio (mg:mg) | Final siRNA Concentration (mg/ml) | SNALP Size[1] (nm) |
|---|---|---|---|---|---|
| 1 | EK1 | PEG-cDMA:DLinDMA:DSPC:Chol (2:30:20:48) | 1:12.8 (0.08) | 0.1 | 83 (0.15) |
| 2 | β-gal 478 | PEG-cDMA:DLinDMA:DSPC:Chol (2:30:20:48) | 1:12.8 (0.08) | 0.1 | 83 (0.15) |
| 3 | EK1 | PEG-cDMA:DLinDMA:DSPC:Chol (2:40:10:48) | 1:25 (0.04) | 0.1 | 83 (0.18) |
| 4 | EK1 | PEG-cDMA:DLinDMA:DSPC:Chol (2:40:10:48) | 1:25 (0.04) | 0.1 | 130 (0.14) |
| 5 | EK1 | PEG-cDMA:DLinDMA:DPPE (2:70:28) | 1:31 (0.03) | 0.1 | 119 (0.17) |

[1]The number in parentheses indicates the polydispersity value, which refers to an estimate of the width of the distribution of the particle size measurements.

Figure 8:
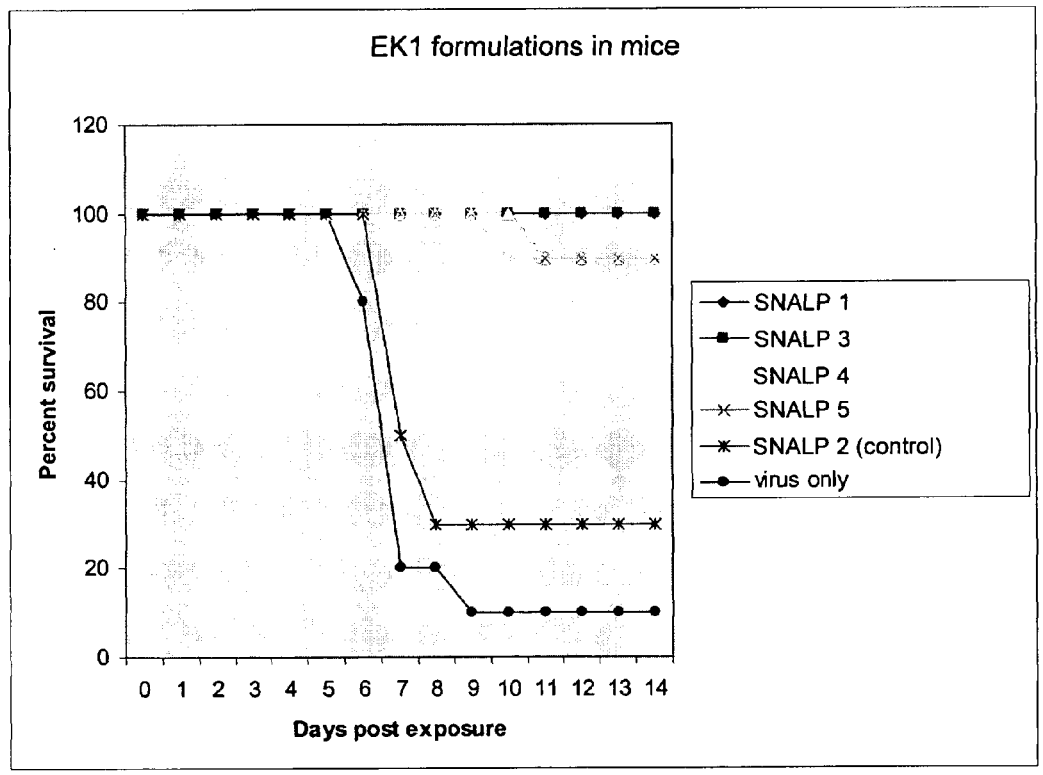
FIG. 8 illustrates data demonstrating that administration of SNALP encapsulating siRNA targeting Ebola L-pol protected mice challenged with a lethal dose of Ebola virus.

FIG. 8 shows that 100% of the mice that received SNALP 1 or 3 encapsulating EK1 siRNA survived the length of the 14 day study, 90% of the mice that received SNALP 4 or 5 encapsulating EK1 siRNA survived the length of the 14 day study, while only 10% of the control animals that received PBS and only 30% of the control animals that received β-galactosidase siRNA (SNALP 2) survived the length of the 14 day study.

Example 10

SNALP Encapsulating siRNA Targeting Ebola L-pol Have Immunostimulatory Effects

Figure 9:
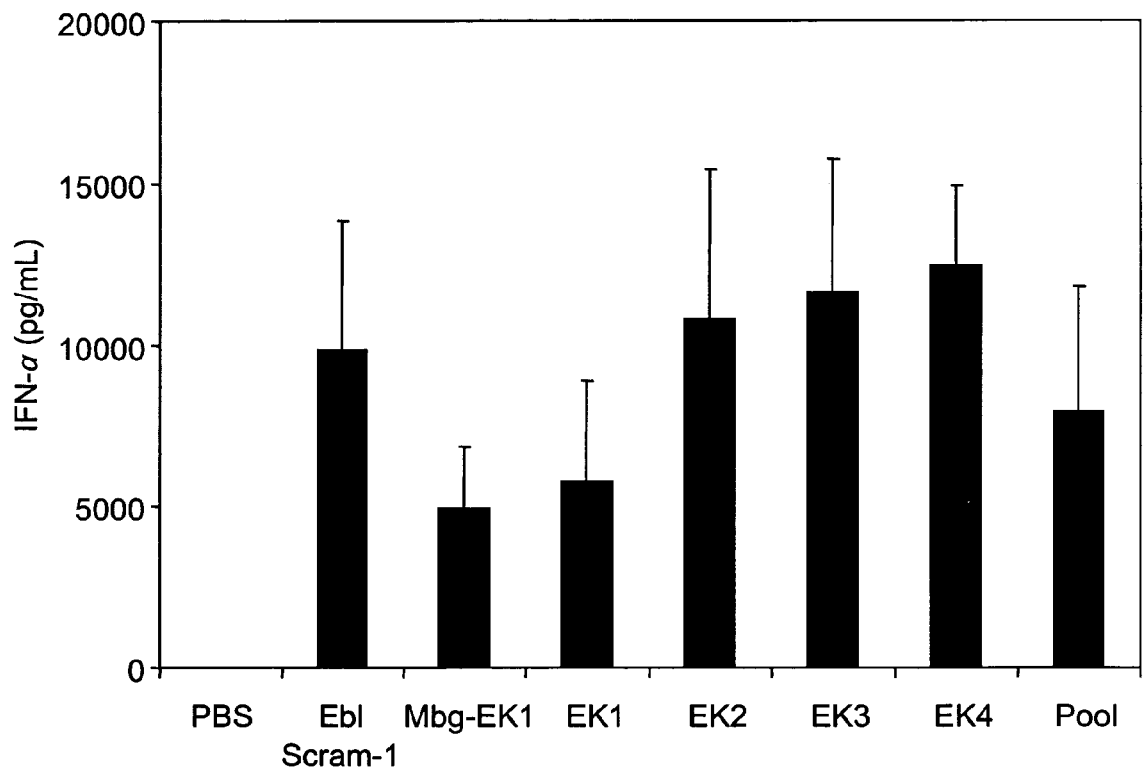
FIG. 9 illustrates data demonstrating that IFN-α was detected in the serum of mice following a single intravenous administration of SNALP encapsulating siRNA targeting Ebola L-pol or Marburg L-pol.
Figure 10:
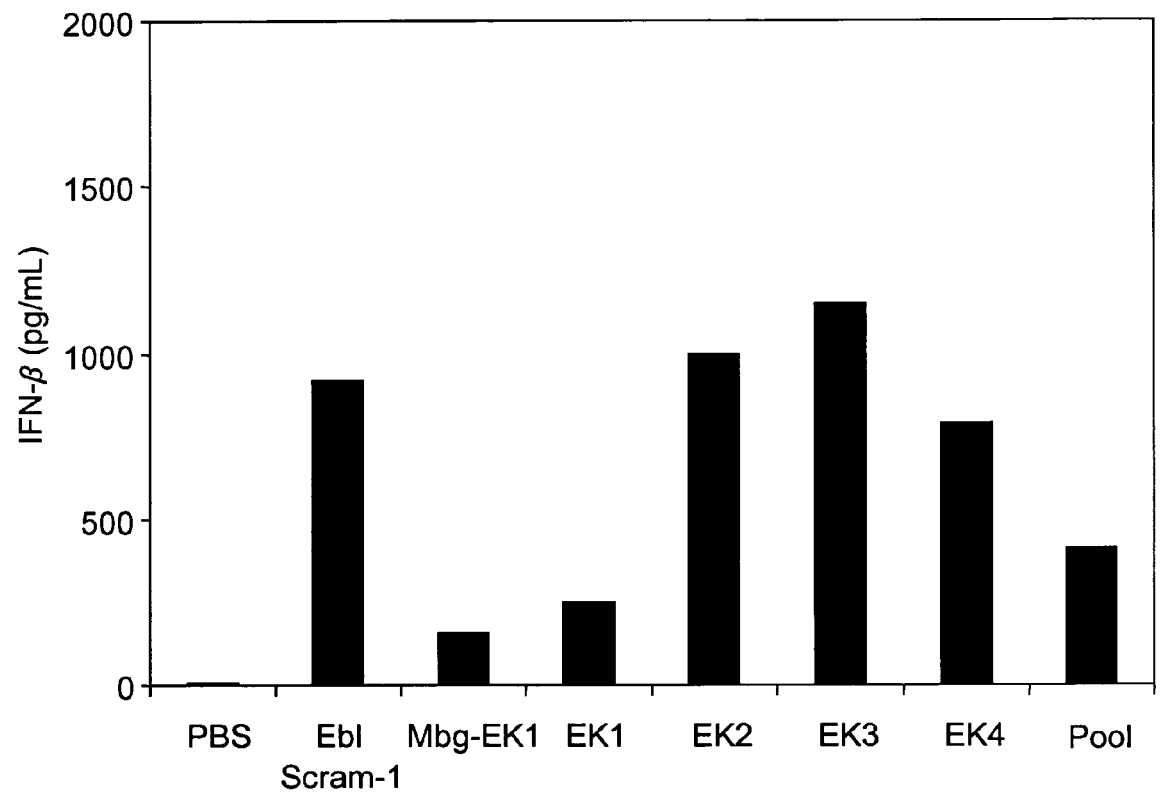
FIG. 10 illustrates data demonstrating that IFN-α was detected in the serum of mice following a single intravenous administration of SNALP encapsulating siRNA targeting Ebola L-pol or Marburg L-pol.

SNALP (DLinDMA:PEG-cDMA:DSPC:Chol in the molar ratio 30:2:20:48) encapsulating either individual siRNA targeting Ebola-Zaire L-pol (i.e., EK1, EK2, EK3, or EK4), a pool of siRNA targeting Ebola-Zaire L-pol (i.e., EK1, EK2, EK3, and EK4), or an siRNA targeting Marburg L-pol (i.e., Mbg-EK1) were administered to female Balb/C mice at 5 mg siRNA/kg. PBS or SNALP encapsulating scrambled siRNA sequences was administered to control animals. Plasma IFN-α and IFN-β were measured 6 hours after administration of the SNALP using methods described above. Mice produced IFN-α and IFN-β regardless of siRNA sequence. The results are shown in FIGS. 9 and 10.

It is to be understood that the above description is intended to be illustrative and not restrictive. Many embodiments will be apparent to those of skill in the art upon reading the above description. The scope of the invention should, therefore, be determined not with reference to the above description, but should instead be determined with reference to the appended claims, along with the full scope of equivalents to which such claims are entitled. The disclosures of all articles and references, including patent applications, patents, PCT publications, and Accession Nos. are incorporated herein by reference for all purposes.

LENGTHY TABLES

The patent contains a lengthy table section. A copy of the table is available in electronic form from the USPTO web site (http://seqdata.uspto.gov/?pageRequest=docDetail&DocID=US07838658B2). An electronic copy of the table will also be available from the USPTO upon request and payment of the fee set forth in 37 CFR 1.19(b)(3).

SEQUENCE LISTING (39125 sequences)

SEQ ID NO: 1 - DNA, 18959 bp, Ebola virus
  Zaire Ebola virus, strain Mayinga, complete genome
cggacacacaaaaagaaagaagaatttttaggatcttttgtgtgcgaataactatgaggaagattaataattttcctctcattgaaatttatatcggaatttaaattgaaattgttactgtaatcacacctggtttgtttcagagccacatcacaaagatagagaacaacctaggtctccgaagggagcaagggcatcagtgtgctcagttgaaaatcccttgtcaacacctaggtcttatcacatcacaagttccacctcagactctgcagggtgatccaacaaccttaatagaaacattattgttaaaggacagcattagttcacagtcaaacaagcaagattgagaattaaccttggttttgaacttgaacacttaggggattgaagattcaacaaccctaaagcttggggtaaaacattggaaatagttaaaagacaaattgctcggaatcacaaaattccgagtatggattctcgtcctcagaaaatctggatggcgccgagtctcactgaatctgacatggattaccacaagatcttgacagcaggtctgtccgttcaacaggggattgttcggcaaagagtcatcccagtgtatcaagtaaacaatcttgaagaaatttgccaacttatcatacaggcctttgaagcaggtgttgattttcaagagagtgcggacagtttccttctcatgctttgtcttcatcatgcgtaccagggagattacaaacttttcttggaaagtggcgcagtcaagtatttggaagggcacgggttccgttttgaagtcaagaagcgtgatggagtgaagcgccttgaggaattgctgccagcagtatctagtggaaaaaacattaagagaacacttgctgccatgccggaagaggagacaactgaagctaatgccggtcagtttctctcctttgcaagtctattccttccgaaattggtagtaggagaaaaggcttgccttgagaaggttcaaaggcaaattcaagtacatgcagagcaaggactgatacaatatccaacagcttggcaatcagtaggacacatgatggtgattttccgtttgatgcgaacaaattttctgatcaaatttctcctaatacaccaagggatgcacatggttgccgggcatgatgccaacgatgctgtgatttcaaattcagtggctcaagctcgtttttcaggcttattgattgtcaaaacagtacttgatcatatcctacaaaagacagaacgaggagttcgtctccatcctcttgcaaggaccgccaaggtaaaaaatgaggtgaactcctttaaggctgcactcagctccctggccaagcatggagagtatgctcctttcgcccgacttttgaacctttctggagtaaataatcttgagcatggtcttttccctcaactatcggcaattgcactcggagtcgccacagcacacgggagtaccctcgcaggagtaaatgttggagaacagtatcaacaactcagagaggctgccactgaggctgagaagcaactccaacaatatgcagagtctcgcgaacttgaccatcttggacttgatgatcaggaaaagaaaattcttatgaacttccatcagaaaaagaacgaaatcagcttccagcaaacaaacgctatggtaactctaagaaaagagcgcctggccaagctgacagaagctatcactgctgcgtcactgcccaaaacaagtggacattacgatgatgatgacgacattccctttccaggacccatcaatgatgacgacaatcctggccatcaagatgatgatccgactgactcacaggatacgaccattcccgatgtggtggttgatcccgatgatggaagctacggcgaataccagagttactcggaaaacggcatgaatgcaccagatgacttggtcctattcgatctagacgaggacgacgaggacactaagccagtgcctaatagatcgaccaagggtggacaacagaagaacagtcaaaagggccagcatatagagggcagacagacacaatccaggccaattcaaaatgtcccaggccctcacagaacaatccaccacgccagtgcgccactcacggacaatgacagaagaaatgaaccctccggctcaaccagccctcgcatgctgacaccaattaacgaagaggcagacccactggacgatgccgacgacgagacgtctagccttccgcccttggagtcagatgatgaagagcaggacagggacggaacttccaaccgcacacccactgtcgccccaccggctcccgtatacagagatcactctgaaaagaaagaactcccgcaagacgagcaacaagatcaggaccacactcaagaggccaggaaccaggacagtgacaacacccagtcagaacactcttttgaggagatgtatcgccacattctaagatcacaggggccatttgatgctgttttgtattatcatatgatgaaggatgagcctgtagttttcagtaccagtgatggcaaagagtacacgtatccagactcccttgaagaggaatatccaccatggctcactgaaaaagaggctatgaatgaagagaatagatttgttacattggatggtcaacaattttattggccggtgatgaatcacaagaataaattcatggcaatcctgcaacatcatcagtgaatgagcatggaacaatgggatgattcaaccgacaaatagctaacattaagtagtcaaggaacgaaaacaggaagaatttttgatgtctaaggtgtgaattattatcacaataaaagtgattcttatttttgaatttaaagctagcttattattactagccgtttttcaaagttcaatttgagtcttaatgcaaataggcgttaagccacagttatagccataattgtaactcaatattctaactagcgatttatctaaattaaattacattatgcttttataacttacctactagcctgcccaacatttacacgatcgttttataattaagaaaaaactaatgatgaagattaaaaccttcatcatccttacgtcaattgaattctctagcactcgaagcttattgtcttcaatgtaaaagaaaagctggtctaacaagatgacaactagaacaaagggcaggggccatactgcggccacgactcaaaacgacagaatgccaggccctgagctttcgggctggatctctgagcagctaatgaccggaagaattcctgtaagcgacatcttctgtgatattgagaacaatccaggattatgctacgcatcccaaatgcaacaaacgaagccaaacccgaagacgcgcaacagtcaaacccaaacggacccaatttgcaatcatagttttgaggaggtagtacaaacattggcttcattggctactgttgtgcaacaacaaaccatcgcatcagaatcattagaacaacgcattacgagtcttgagaatggtctaaagccagtttatgatatggcaaaaacaatctcctcattgaacagggtttgtgctgagatggttgcaaaatatgatcttctggtgatgacaaccggtcgggcaacagcaaccgctgcggcaactgaggcttattgggccgaacatggtcaaccaccacctggaccatcactttatgaagaaagtgcgattcggggtaagattgaatctagagatgagaccgtccctcaaagtgttagggaggcattcaacaatctaaacagtaccacttcactaactgaggaaaattttgggaaacctgacatttcggcaaaggatttgagaaacattatgtatgatcacttgcctggttttggaactgctttccaccaattagtacaagtgatttgtaaattgggaaaagatagcaactcattggacatcattcatgctgagttccaggccagcctggctgaaggagactctcctcaatgtgccctaattcaaattacaaaaagagttccaatcttccaagatgctgctccacctgtcatccacatccgctctcgaggtgacattccccgagcttgccagaaaagcttgcgtccagtcccaccatcgcccaagattgatcgaggttgggtatgtgtttttcagcttcaagatggtaaaacacttggactcaaaatttgagccaatctcccttccctccgaaagaggcgaataatagcagaggcttcaactgctgaactatagggtacgttacattaatgatacacttgtgagtatcagccctggataatataagtcaattaaacgaccaagataaaattgttcatatctcgctagcagcttaaaatataaatgtaataggagctatatctctgacagtattataatcaattgttattaagtaacccaaaccaaaagtgatgaagattaagaaaaacctacctcggctgagagagtgttttttcattaaccttcatcttgtaaacgttgagcaaaattgttaaaaatatgaggcgggttatattgcctactgctcctcctgaatatatggaggccatataccctgtcaggtcaaattcaacaattgctagaggtggcaacagcaatacaggcttcctgacaccggagtcagtcaatggggacactccatcgaatccactcaggccaattgccgatgacaccatcgaccatgccagccacacaccaggcagtgtgtcatcagcattcatccttgaagctatggtgaatgtcatatcgggccccaaagtgctaatgaagcaaattccaatttggcttcctctaggtgtcgctgatcaaaagacctacagctttgactcaactacggccgccatcatgcttgcttcatacactatcacccatttcggcaaggcaaccaatccacttgtcagagtcaatcggctgggtcctggaatcccggatcatcccctcaggctcctgcgaattggaaaccaggctttcctccaggagttcgttcttccgccagtccaactaccccagtatttcacctttgatttgacagcactcaaactgatcacccaaccactgcctgctgcaacatggaccgatgacactccaacaggatcaaatggagcgttgcgtccaggaatttcatttcatccaaaacttcgccccattcttttacccaacaaaagtgggaagaaggggaacagtgccgatctaacatctccggagaaaatccaagcaataatgacttcactccaggactttaagatcgttccaattgatccaaccaaaaatatcatgggaatcgaagtgccagaaactctggtccacaagctgaccggtaagaaggtgacttctaaaaatggacaaccaatcatccctgttcttttgccaaagtacattgggttggacccggtggctccaggagacctcaccatggtaatcacacaggattgtgacacgtgtcattctcctgcaagtcttccagctgtgattgagaagtaattgcaataattgactcagatccagttttatagaatcttctcagggatagtgataacatctatttagtaatccgtccattagaggagacacttttaattgatcaatatactaaaggtgctttacaccattgtcttttttctctcctaaatgtagaacttaacaaaagactcataatatacttgtttttaaaggattgattgatgaaagatcataactaataacattacaaataatcctactataatcaatacggtgattcaaatgttaatctttctcattgcacatactttttgcccttatcctcaaattgcctgcatgcttacatctgaggatagccagtgtgacttggattggaaatgtggagaaaaaatcgggacccatttctaggttgttcacaatccaagtacagacattgcccttctaattaagaaaaaatcggcgatgaagattaagccgacagtgagcgtaatcttcatctctcttagattatttgttttccagagtaggggtcgtcaggtccttttcaatcgtgtaaccaaaataaactccactagaaggatattgtggggcaacaacacaatgggcgttacaggaatattgcagttacctcgtgatcgattcaagaggacatcattctttctttgggtaattatccttttccaaagaacattttccatcccacttggagtcatccacaatagcacattacaggttagtgatgtcgacaaactagtttgtcgtgacaaactgtcatccacaaatcaattgagatcagttggactgaatctcgaagggaatggagtggcaactgacgtgccatctgcaactaaaagatggggcttcaggtccggtgtcccaccaaaggtggtcaattatgaagctggtgaatgggctgaaaactgctacaatcttgaaatcaaaaaacctgacgggagtgagtgtctaccagcagcgccagacgggattcggggcttcccccggtgccggtatgtgcacaaagtatcaggaacgggaccgtgtgccggagactttgccttccataaagagggtgctttcttcctgtatgatcgacttgcttccacagttatctaccgaggaacgactttcgctgaaggtgtcgttgcatttctgatactgccccaagctaagaaggacttcttcagctcacaccccttgagagagccggtcaatgcaacggaggacccgtctagtggctactattctaccacaattagatatcaggctaccggttttggaaccaatgagacagagtacttgttcgaggttgacaatttgacctacgtccaacttgaatcaagattcacaccacagtttctgctccagctgaatgagacaatatatacaagtgggaaaaggagcaataccacgggaaaactaatttggaaggtcaaccccgaaattgatacaacaatcggggagtgggccttctgggaaactaaaaaaacctcactagaaaaattcgcagtgaagagttgtctttcacagttgtatcaaacggagccaaaaacatcagtggtcagagtccggcgcgaacttcttccgacccagggaccaacacaacaactgaagaccacaaaatcatggcttcagaaaattcctctgcaatggttcaagtgcacagtcaaggaagggaagctgcagtgtcgcatctaacaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccacgaccgcagccggacccccaaaagcagagaacaccaacacgagcaagagcactgacttcctggaccccgccaccacaacaagtccccaaaaccacagcgagaccgctggcaacaacaacactcatcaccaagataccggagaagagagtgccagcagcgggaagctaggcttaattaccaatactattgctggagtcgcaggactgatcacaggcgggagaagaactcgaagagaagcaattgtcaatgctcaacccaaatgcaaccctaatttacattactggactactcaggatgaaggtgctgcaatcggactggcctggataccatatttcgggccagcagccgagggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcggcacatgccacattctgggaccggactgctgtatcgaaccacatgattggaccaagaacataacagacaaaattgatcagattattcatgattttgttgataaaacccttccggaccagggggacaatgacaattggtggacaggatggagacaatggataccggcaggtattggagttacaggcgttataattgcagttatcgctttattctgtatatgcaaatttgtcttttagtttttcttcagattgcttcatggaaaagctcagcctcaaatcaatgaaaccaggatttaattatatggattacttgaatctaagattacttgacaaatgataatataatacactggagctttaaacatagccaatgtgattctaactcctttaaactcacagttaatcataaacaaggtttgacatcaatctagttatctctttgagaatgataaacttgatgaagattaagaaaaaggtaatctttcgattatctttaatcttcatccttgattctacaatcatgacagttgtctttagtgacaagggaaagaagcctttttattaagttgtaataatcagatctgcgaaccggtagagtttagttgcaacctaacacacataaagcattggtcaaaaagtcaatagaaatttaaacagtgagtggagacaacttttaaatggaagcttcatatgagagaggacgcccacgagctgccagacagcattcaagggatggacacgaccaccatgttcgagcacgatcatcatccagagagaattatcgaggtgagtaccgtcaatcaaggagcgcctcacaagtgcgcgttcctactgtatttcataagaagagagttgaaccattaacagttcctccagcacctaaagacatatgtccgaccttgaaaaaaggatttttgtgtgacagtagtttttgcaaaaaagatcaccagttggagagtttaactgatagggaattactcctactaatcgcccgtaagacttgtggatcagtagaacaacaattaaatataactgcacccaaggactcgcgcttagcaaatccaacggctgatgatttccagcaagaggaaggtccaaaaattaccttgttgacactgatcaagacggcagaacactgggcgagacaagacatcagaaccatagaggattcaaaattaagagcattgttgactctatgtgctgtgatgacgaggaaattctcaaaatcccagctgagtcttttatgtgagacacacctaaggcgcgaggggcttgggcaagatcaggcagaacccgttctcgaagtatatcaacgattacacagtgataaaggaggcagttttgaagctgcactatggcaacaatgggaccgacaatccctaattatgtttatcactgcattcttgaatattgctctccagttaccgtgtgaaagttctgctgtcgttgtttcagggttaagaacattggttcctcaatcagataatgaggaagcttcaaccaacccggggacatgctcatggtctgatgagggtaccccttaataaggctgactaaaacactatataaccttctacttgatcacaatactccgtatacctatcatcatatatttaatcaagacgatatcctttaaaacttattcagtactataatcactctcgtttcaaattaataagatgtgcatgattgccctaatatatgaagaggtatgatacaaccctaacagtgatcaaagaaaatcataatctcgtatcgctcgtaatataacctgccaagcatacctcttgcacaaagtgattcttgtacacaaataatgttttactctacaggaggtagcaacgatccatcccatcaaaaaataagtatttcatgacttactaatgatctcttaaaatattaagaaaaactgacggaacataaattctttatgcttcaagctgtggaggaggtgtttggtattggctattgttatattacaatcaataacaagcttgtaaaaatattgttcttgtttcaagaggtagattgtgaccggaaatgctaaactaatgatgaagattaatgcggaggtctgataagaataaaccttattattcagattaggccccaagaggcattcttcatctccttttagcaaagtactatttcagggtagtccaattagtggcacgtcttttagctgtatatcagtcgcccctgagatacgccacaaaagtgtctctaagctaaattggtctgtacacatcccatacattgtattaggggcaataatatctaattgaacttagccgtttaaaatttagtgcataaatctgggctaacaccaccaggtcaactccattggctgaaaagaagcttacctacaacgaacatcactttgagcgccctcacaattaaaaaataggaacgtcgttccaacaatcgagcgcaaggtttcaaggttgaactgagagtgtctagacaacaaaatattgatactccagacaccaagcaagacctgagaaaaaaccatggctaaagctacgggacgatacaatctaatatcgcccaaaaaggacctggagaaaggggttgtcttaagcgacctctgtaacttcttagttagccaaactattcaggggtggaaggtttattgggctggtattgagtttgatgtgactcacaaaggaatggccctattgcatagactgaaaactaatgactttgcccctgcatggtcaatgacaaggaatctctttcctcatttatttcaaaatccgaattccacaattgaatcaccgctgtgggcattgagagtcatccttgcagcagggatacaggaccagctgattgaccagtctttgattgaacccttagcaggagcccttggtctgatctctgattggctgctaacaaccaacactaaccatttcaacatgcgaacacaacgtgtcaaggaacaattgagcctaaaaatgctgtcgttgattcgatccaatattctcaagtttattaacaaattggatgctctacatgtcgtgaactacaacggattgttgagcagtattgaaattggaactcaaaatcatacaatcatcataactcgaactaacatgggttttctggtggagctccaagaacccgacaaatcggcaatgaaccgcatgaagcctgggccggcgaaattttccctccttcatgagtccacactgaaagcatttacacaaggatcctcgacacgaatgcaaagtttgattcttgaatttaatagctctcttgctatctaactaaggtagaatacttcatattgagctaactcatatatgctgactcaatagttatcttgacatctctgctttcataatcagatatataagcataataaataaatactcatatttcttgataatttgtttaaccacagataaatcctcactgtaagccagcttccaagttgacacccttacaaaaaccaggactcagaatccctcaaacaagagattccaagacaacatcatagaattgctttattatatgaataagcattttatcaccagaaatcctatatactaaatggttaattgtaactgaacccgcaggtcacatgtgttaggtttcacagattctatatattactaactctatactcgtaattaacattagataagtagattaagaaaaaagcctgaggaagattaagaaaaactgcttattgggtctttccgtgttttagatgaagcagttgaaattcttcctcttgatattaaatggctacacaacatacccaatacccagacgctaggttatcatcaccaattgtattggaccaatgtgacctagtcactagagcttgcgggttatattcatcatactcccttaatccgcaactacgcaactgtaaactcccgaaacatatctaccgtttgaaatacgatgtaactgttaccaagttcttgagtgatgtaccagtggcgacattgcccatagatttcatagtcccagttcttctcaaggcactgtcaggcaatggattctgtcctgttgagccgcggtgccaacagttcttagatgaaatcattaagtacacaatgcaagatgctctcttcttgaaatattatctcaaaaatgtgggtgctcaagaagactgtgttgatgaacactttcaagagaaaatcttatcttcaattcagggcaatgaatttttacatcaaatgtttttctggtatgatctggctattttaactcgaaggggtagattaaatcgaggaaactctagatcaacatggtttgttcatgatgatttaatagacatcttaggctatggggactatgttttttggaagatcccaatttcaatgttaccactgaacacacaaggaatcccccatgctgctatggactggtatcaggcatcagtattcaaagaagcggttcaagggcatacacacattgtttctgtttctactgccgacgtcttgataatgtgcaaagatttaattacatgtcgattcaacacaactctaatctcaaaaatagcagagattgaggatccagtttgttctgattatcccaattttaagattgtgtctatgctttaccagagcggagattacttactctccatattagggtctgatgggtataaaattattaagttcctcgaaccattgtgcttggccaaaattcaattatgctcaaagtacactgagaggaagggccgattcttaacacaaatgcatttagctgtaaatcacaccctagaagaaattacagaaatgcgtgcactaaagccttcacaggctcaaaagatccgtgaattccatagaacattgataaggctggagatgacgccacaacaactttgtgagctattttccattcaaaaacactgggggcatcctgtgctacatagtgaaacagcaatccaaaaagttaaaaaacatgctacggtgctaaaagcattacgccctatagtgattttcgagacatactgtgtttttaaatatagtattgccaaacattattttgatagtcaaggatcttggtacagtgttacttcagataggaatctaacaccgggtcttaattcttatatcaaaagaaatcaattccctccgttgccaatgattaaagaactactatgggaattttaccaccttgaccaccctccacttttctcaaccaaaattattagtgacttaagtatttttataaaagacagagctaccgcagtagaaaggacatgctgggatgcagtattcgagcctaatgttctaggatataatccacctcacaaatttagtactaaacgtgtaccggaacaatttttagagcaagaaaacttttctattgagaatgttctttcctacgcacaaaaactcgagtatctactaccacaatatcggaacttttctttctcattgaaagagaaagagttgaatgtaggtagaaccttcggaaaattgccttatccgactcgcaatgttcaaacactttgtgaagctctgttagctgatggtcttgctaaagcatttcctagcaatatgatggtagttacggaacgtgagcaaaaagaaagcttattgcatcaagcatcatggcaccacacaagtgatgattttggtgaacatgccacagttagagggagtagctttgtaactgatttagagaaatacaatcttgcatttagatatgagtttacagcaccttttatagaatattgcaaccgttgctatggtgttaagaatgtttttaattggatgcattatacaatcccacagtgttatatgcatgtcagtgattattataatccaccacataacctcacactggagaatcgagacaacccccccgaagggcctagttcatacaggggtcatatgggagggattgaaggactgcaacaaaaactctggacaagtatttcatgtgctcaaatttctttagttgaaattaagactggttttaagttacgctcagctgtgatgggtgacaatcagtgcattactgttttatcagtcttccccttagagactgacgcagacgagcaggaacagagcgccgaagacaatgcagcgagggtggccgccagcctagcaaaagttacaagtgcctgtggaatctttttaaaacctgatgaaacatttgtacattcaggttttatctattttggaaaaaaacaatatttgaatggggtccaattgcctcagtcccttaaaacggctacaagaatggcaccattgtctgatgcaatttttgatgatcttcaagggaccctggctagtataggcactgcttttgagcgatccatctctgagacacgacatatctttccttgcaggataaccgcagctttccatacgtttttttcggtgagaatcttgcaatatcatcatctcgggttcaataaaggttttgaccttggacagttaacactcggcaaacctctggatttcggaacaatatcattggcactagcggtaccgcaggtgcttggagggttatccttcttgaatcctgagaaatgtttctaccggaatctaggagatccagttacctcaggcttattccagttaaaaacttatctccgaatgattgagatggatgatttattcttacctttaattgcgaagaaccctgggaactgcactgccattgactttgtgctaaatcctagcggattaaatgtccctgggtcgcaagacttaacttcatttctgcgccagattgtacgcaggaccatcaccctaagtgcgaaaaacaaacttattaataccttatttcatgcgtcagctgacttcgaagacgaaatggtttgtaaatggctattatcatcaactcctgttatgagtcgttttgcggccgatatcttttcacgcacgccgagcgggaagcgattgcaaattctaggatacctggaaggaacacgcacattattagcctctaagatcatcaacaataatacagagacaccggttttggacagactgaggaaaataacattgcaaaggtggagcctatggtttagttatcttgatcattgtgataatatcctggcggaggctttaacccaaataacttgcacagttgatttagcacagattctgagggaatattcatgggctcatattttagagggaagacctcttattggagccacactcccatgtatgattgagcaattcaaagtgttttggctgaaaccctacgaacaatgtccgcagtgttcaaatgcaaagcaaccaggtgggaaaccattcgtgtcagtggcagtcaagaaacatattgttagtgcatggccgaacgcatcccgaataagctggactatcggggatggaatcccatacattggatcaaggacagaagataagataggacaacctgctattaaaccaaaatgtccttccgcagccttaagagaggccattgaattggcgtcccgtttaacatgggtaactcaaggcagttcgaacagtgacttgctaataaaaccatttttggaagcacgagtaaatttaagtgttcaagaaatacttcaaatgaccccttcacattactcaggaaatattgttcacaggtacaacgatcaatacagtcctcattctttcatggccaatcgtatgagtaattcagcaacgcgattgattgtttctacaaacactttaggtgagttttcaggaggtggccagtctgcacgcgacagcaatattattttccagaatgttataaattatgcagttgcactgttcgatattaaatttagaaacactgaggctacagatatccaatataatcgtgctcaccttcatctaactaagtgttgcacccgggaagtaccagctcagtatttaacatacacatctacattggatttagatttaacaagataccgagaaaacgaattgatttatgacagtaatcctctaaaaggaggactcaattgcaatatctcattcgataatccatttttccaaggtaaacggctgaacattatagaagatgatcttattcgactgcctcacttatctggatgggagctagccaagaccatcatgcaatcaattatttcagatagcaacaattcatctacagacccaattagcagtggagaaacaagatcattcactacccatttcttaacttatcccaagataggacttctgtacagttttggggcctttgtaagttattatcttggcaatacaattcttcggactaagaaattaacacttgacaattttttatattacttaactactcaaattcataatctaccacatcgctcattgcgaatacttaagccaacattcaaacatgcaagcgttatgtcacggttaatgagtattgatcctcatttttctatttacataggcggtgctgcaggtgacagaggactctcagatgcggccaggttatttttgagaacgtccatttcatcttttcttacatttgtaaaagaatggataattaatcgcggaacaattgtccctttatggatagtatatccgctagagggtcaaaacccaacacctgtgaataattttctctatcagatcgtagaactgctggtgcatgattcatcaagacaacaggcttttaaaactaccataagtgatcatgtacatcctcacgacaatcttgtttacacatgtaagagtacagccagcaatttcttccatgcatcattggcgtactggaggagcagacacagaaacagcaaccgaaaatacttggcaagagactcttcaactggatcaagcacaaacaacagtgatggtcatattgagagaagtcaagaacaaaccaccagagatccacatgatggcactgaacggaatctagtcctacaaatgagccatgaaataaaaagaacgacaattccacaagaaaacacgcaccagggtccgtcgttccagtcctttctaagtgactctgcttgtggtacagcaaatccaaaactaaatttcgatcgatcgagacacaatgtgaaatttcaggatcataactcggcatccaagagggaaggtcatcaaataatctcacaccgtctagtcctacctttctttacattatctcaagggacacgccaattaacgtcatccaatgagtcacaaacccaagacgagatatcaaagtacttacggcaattgagatccgtcattgataccacagtttattgtagatttaccggtatagtctcgtccatgcattacaaacttgatgaggtcctttgggaaatagagagtttcaagtcggctgtgacgctagcagagggagaaggtgctggtgccttactattgattcagaaataccaagttaagaccttatttttcaacacgctagctactgagtccagtatagagtcagaaatagtatcaggaatgactactcctaggatgcttctacctgttatgtcaaaattccataatgaccaaattgagattattcttaacaactcagcaagccaaataacagacataacaaatcctacttggtttaaagaccaaagagcaaggctacctaagcaagtcgaggttataaccatggatgcagagacaacagagaatataaacagatcgaaattgtacgaagctgtatataaattgatcttacaccatattgatcctagcgtattgaaagcagtggtccttaaagtctttctaagtgatactgagggtatgttatggctaaatgataatttagccccgttttttgccactggttatttaattaagccaataacgtcaagtgctagatctagtgagtggtatctttgtctgacgaacttcttatcaactacacgtaagatgccacaccaaaaccatctcagttgtaaacaggtaatacttacggcattgcaactgcaaattcaacgaagcccatactggctaagtcatttaactcagtatgctgactgtgagttacatttaagttatatccgccttggttttccatcattagagaaagtactataccacaggtataacctcgtcgattcaaaaagaggtccactagtctctatcactcagcacttagcacatcttagagcagagattcgagaattaactaatgattataatcaacagcgacaaagtcggactcaaacatatcactttattcgtactgcaaaaggacgaatcacaaaactagtcaatgattatttaaaattctttcttattgtgcaagcattaaaacataatgggacatggcaagctgagtttaagaaattaccagagttgattagtgtgtgcaataggttctaccatattagagattgcaattgtgaagaacgtttcttagttcaaaccttatatttacatagaatgcaggattctgaagttaagcttatcgaaaggctgacagggcttctgagtttatttccggatggtctctacaggtttgattgaattaccgtgcatagtatcctgatacttgcaaaggttggttattaacatacagattataaaaaactcataaattgctctcatacatcatattgatctaatctcaataaacaactatttaaataacgaaaggagtccctatattatatactatatttagcctctctccctgcgtgataatcaaaaaattcacaatgcagcatgtgtgacatattactgccgcaatgaatttaacgcaacataataaactctgcactctttataattaagctttaacgaaaggtctgggctcatattgttattgatataataatgttgtatcaatatcctgtcagatggaatagtgttttggttgataacacaacttcttaaaacaaaattgatctttaagattaagttttttataattatcattactttaatttgtcgttttaaaaacggtgatagccttaatctttgtgtaaaataagagattaggtgtaataaccttaacatttttgtctagtaagctactatttcatacagaatgataaaattaaaagaaaaggcaggactgtaaaatcagaaataccttctttacaatatagcagactagataataatcttcgtgttaatgataattaagacattgaccacgctcatcagaaggctcgccagaataaacgttgcaaaaaggattcctggaaaaatggtcgcacacaaaaatttaaaaataaatctatttcttcttttttgtgtgtcca

SEQ ID NO: 2 - DNA, 19112 bp, Marburg virus
  Lake Victoria Marburg virus, strain Popp, complete genome
gacacacaaaaacaagagatgatgattttgtgtatcatataaataaagaagaatattaacattgacattgagacttgtcagtctgttaatattcttgaaaagatggatttacatagcttgttagagttgggtacaaaacccactgcccctcatgttcgtaataagaaggtgatattatttgacacaaatcatcaggttagtatctgtaatcagataatagatgcaataaactcagggattgatcttggagatcttctagaagggggtttgctgacgttgtgtgttgaacattactataattccgataaagataaattcaacacaagtcctatcgcaaaatacttgcgtgatgcgggctatgagtttgatgtcgtcaagaatgcagatgcaacccgctttctggatgtgattcctaacgaacctcattacagtcctttaattttggcccttaagacattggaaagtactgaatctcagagggggagaattgggctctttttgtcattttgcagtctttttctcccgaaacttgttgtcggagatcgggctagtatcgaaaaggctttaagacaagtaacagtacatcaagaacaggggatcgtcacataccctaatcactggcttactacaggccatatgaaagtaatttttgggattttgaggtctagctttatcttaaaatttgtgttaattcatcaaggagtaaatttggtgacaggtcatgatgcctatgacagtatcattagtaattcagtaggtcaaactagattctcaggacttcttattgtgaaaacagttcttgagttcatcttgcaaaaaactgattcaggggtgacactacatcctttggtgcggacctccaaagtaaaaaatgaagttgctagtttcaagcaggcgttgagcaacctagcccgacatggagaatacgcaccgttcgcacgggttctgaatttatcagggattaacaacctcgaacatggactctatcctcagctttcggcgattgcgctgggtgttgcaacagcacacggcagtacattggctggtgtcaatgttggcgaacagtatcaacagctacgagaggcggcacatgatgcggaaataaaactacaaaggcgacatgaacatcaggaaattcaagctattgcagaggatgatgaggagaggaagatattagaacaattccaccttcagaaaactgaaatcacacacagtcagacactagccgtcctcagccagaaacgagaaaaattagctcgtcttgctgcagaaattgaaaacaatattgtggaagatcagggatttaaacaatcacagaatcaggtgtcacagtcgtttttgaatgaccctacacctgtggaagtaacggttcaagccaggcccataaatcgaccaactgctctgcctcccccagttgacaacaaaattgagcacgaatctacagaagatagctcttcttcaagcagctttgttgatcttaatgatccatttgcgctgctgaatgaggacgaagacactcttgacgacagtgtcatgatcccgagcacaacatcgagagaatttcaagggattccagcaccaccaagacaatctcaggacctcaacaacagccaaggaaagcaggaagatgaatcaacaaatccgattaagaaacagtttctgagatatcaagaactgcctccggttcaagaggatgatgaatcggaatacacaaccgactctcaggagagtatcgaccaaccaggatctgacaatgaacaaggagttgatcttccacctcctccattgtacgctcaggaaaaaaggcaagatccaatacagcacccagcagtaagctctcaggatccctttggcagtattggtgatgtaaatggtgatatcttagaacccataagatcaccttcttcaccatctgctcctcaggaagacacaagggcaagagaagcctatgaattgtcgcctgatttcacaaattatgaggacaatcagcagaattggccacaaagagtggtgacaaagaagggtaggactttcctttatcctaatgatcttctgcagacaaatcctccagaatcacttataacagccctcgtagaggaataccaaaatcctgtctcagctaaggagctccaagcagattggcccgacatgtcatttgatgaaaggagacatgttgctatgaacttgtagtccagataacacagcacggttacctacttatctactttgatccgattcgtcctcagatcacagtaatcaaatttatttgaatattcaaactactttttaggatcctattacttgttactattgtgtgagacaacataagctatcaaataacaatcacgggcaagaaccgggcatactatggtgatgcgagggcattattcagtgctacaaattcttttttcaattgctataatgatacaactacgaacctccatacatttgccgcaatactgtaatcaacactgctgtatctctccttcaagccatctgatttaacttaataaacatgacttgattcagagagtgtgctgaaaatgttattgattgagcttctcaaatggtgcactatcctactgttttgctcagcctagtatactgtaacatataagtggactctccacttctcttctcgagtattccctataagtgatttacttgatagaatgtcaagtccactggtttggagtttccttactctaatgattgtaataattaactgttggcttagatgataacagatacgaggttatataattactcatagtataaagtataattcttgcctctgtttcttctgttttctctttcctttgtaatatgccaattaagaaaaactaaaaatcgaagaatattaaaggttttctttaatattcagaaaaggttttttattctcttctttctttttgcaaacatattgaaataataattttcacaatgtgggactcatcatatatgcaacaagtcagtgaggggttgatgactggaaaagttcccatagatcaagtgtttggtgccaatccctcagagaagttacacaagagaaggaaaccaaaaggcacagttggactacaatgcagcccttgtctaatgtcaaaggcgacaagcactgatgatattgtttgggaccaactgatcgtgaagaaaacactagctgatctacttataccgataaataggcagatatcggacattcaaagcactctaaacgaagtaacaacaagagtccatgaaattgagcggcaattacatgagataaccccagtgttaaaaatgggaaggacactggaagcaatttccaaggggatgtcagaaatgttagccaaatacgaccacctcgtaatttcaactggaagaaccactgcaccagctgctgcctttgatgcttacttaaatgagcatggtgtccctcccccccaacctgcgattttcaaagatcttggggttgctcaacaagcttgtagtaaggggaccatggttaaaaatgaaacaacagatgcagccgacaagatgtcgaaagttcttgaactcagtgaggagacgttctccaagccaaatctttcagctaaggatttagcccttttgttgtttacccatctacccggcaacaacactccattccatatcctagctcaagtcctttcaaaaattgcttacaagtcaggaaagtccggagcatttttggatgcatttcaccagattctaagtgaaggagagaatgctcaggcagcattgactcgactaagcagaacatttgatgctttcctcggagtagttcctccagtgataagagtcaaaaacttccaaacagtccctcgcccatgtcaaaaaagtcttcgggctgttcctcccaacccaacaattgacaaaggatgggtctgtgtttattcatctgagcaaggtgagacacgggccctgaaaatctaattctcattgttaacagttgcagggggagtgatctttccgagttgatacaaagacactaaacatttcaaaagcatatatgtgggcaaaacgtgactagaccatcttaatagaagtagtaatttatttctgtcttaagtgtgattttcaccttgaaagagttaaatggtgatagattaatccttgaagtaacttttttatatattatagaggaactaatattactaacaaaaggggtctacctaacaggtatgactgagtgatcagtatattttataaaccaagcaattgacttctcactttttaagaatcaactaacaacatagaaaacatatttatccttgtgtaattctcggcttagttggaattaacttttgttgcaattcaagacgcttattcatagtagattatatgattttttataagtttaagatatcttaaattatacccacaagagatactgttttaattaagaaaaactatgaagaacattaagaagatctttctctcgtagtgttcttttactggaaggagtatcccaatctcagcttgttgaattaattgttacttaagtcattctttttaaaattaattcacacaaggtagtttgggtttatatctagaacaaattttaatatggccagttccagcaattacaacacatacatgcaatacttgaacccccctccttatgctgatcacggtgcaaaccagttgatcccggcggatcagctatcaaatcagcagggtataactccaaattatgtgggtgacttaaacctagatgatcagttcaaagggaatgtctgccatgctttcactttagaggcaataattgacatatctgcgtataatgaaccaacagtcaaaggtgttccagcatggctgcctctcgggattatgagcaattttgaatatcctttagctcatactgtggctgcgttgctcacaggcagctatacaatcacccaatttactcataatgggcaaaaattcgtccgtgtaaatcgactcggtacaggaatcccagcacacccactcagaatgttgcgtgaaggaaatcaagcttttattcagaatatggtgatccccagaaatttttccactaatcaattcacctacaatctcactaacttagtattgagtgtgcaaaagcttcctgatgatgcctggcgcccatccaaggacaaattaattgggaacaccatgcatcccgcagtctccatacacccgaatttgccacccattgttctaccaacagtcaagaagcaggcttatcgtcagcataaaaatcccaacaatggaccactgctggccatatctggcatccttcaccaactgagggtcgagaaagtcccagagaagacaagcctgtttaggatttcacttcctgccgatatgttctcagtaaaagaaggtatgatgaagaaaaggggagaaaattccccggtggtttattttcaagcacctgagaacttccctttgaatggcttcaacaacagacaagttgtactagcgtatgcgaatccaacgctcagtgccgtttgaaataatgctcaaatgagacaggagtccatctgcataagaagcatggcctaaatgggtgtctgttaagttctcacaagattagtttgtattgatttcaataatgctttaaccttacattgctgctttaaatggttaattaagctgatcagcttgcaagatgtaatctcttttgggtcatcagatctataatgggtttactagattatataaaagaaatagtaatgttttataaacaattcttgcttagttttactttgatttactaacatatatcattgtgcccttcattgctaagtaaactcaactgatgatgatattccttctgaaatagtaagaaaaactaatgaagaacattaattgccgggtaagagtgattaagttctttaaatttgaccaaagtaatgttttgttagtgaatacattcttatattgcttgattaaaaacaagaaattatcctaacatgaagaccacatgtctctttatcagtcttatcttaatccaagggataaaaactctccctattttagagatagctagtaacaatcaaccccaaaatgtggattcggtatgctccggaactctccagaagacagaagatgtccatctgatgggattcacactgagtgggcaaaaagttgctgattcccctttggaggcatccaagcgatgggctttcaggacaggtgtacctcccaagaatgttgagtatacagaaggggaggaagccaaaacatgctacaatataagtgtaacggatccctctggaaaatccttgctgttggatcctcctaccaacatccgtgactatcctaaatgcaaaactatccatcatattcaaggtcaaaaccctcatgcgcaagggatcgccctccatttgtggggagcatttttcctgtatgatcgcattgcctccacaacaatgtaccgaggcagagtcttcactgaagggaacatagcagctatgattgtcaataagacagtgcacaaaatgattttctcgaggcaaggacaggggtaccgtcacatgaatctgacttctactaataaatattggacaagtaacaatggaacacaaacgaatgacactggatgcttcggtgctcttcaagaatacaactccacgaagaatcaaacatgtgctccgtccaaaataccctcaccactgcccacagcccgtccagagatcaaacccacaagcaccccaactgatgccaccacactcaacaccacagacccaaacaatgatgatgaggacctcataacatccggttcagggtccggagaacaggaaccctatacaacttcagatgcggtcactaagcaagggctttcatcaacaatgccacccactccctcaccacaaccaagcacgccacagcaagaaggaaacaacacagaccattcccaaggtactgtgactgaacccaacaaaaccaacacaacggcacaaccgtccatgcccccccacaacaccactgcaatctctactaacaacacctccaagaacaacttcagcaccctctctgtatcactacaaaacaccaccaattacgacacacagagcacagccactgaaaatgaacaaaccagtgccccctcgaaaacaaccctgcctccaacaggaaatcttaccacagcaaagagcactaacaacacgaaaggccccaccacaacggcaccaaatatgacaaatgggcatttaaccagtccctcccccacccccaacccgaccacacaacatcttgtatatttcagaaagaaacgaagtatcctctggagggaaggcgacatgtttccttttctggacgggttaataaatgctccaattgattttgatccagttccaaatacaaagacgatctttgatgaatcttctagttctggtgcttcggctgaggaagatcaacatgcctcccccaatatcagtttaactttatcctattttcctaatataaatgaaaacactgcctactctggagaaaatgagaacgattgtgatgcagagttaagaatttggagcgttcaggaggatgacctggcagcagggctcagttggataccgttttttggccctggaatcgaaggactttatactgctggtttaattaaaaaccaaaacaatttggtctgcaggttgaggcgtctagccaatcaaactgccaaatccttggaactcttattaagagtcacaaccgaggaaaggacattttccttaattaatagacatgccattgactttctactcacaaggtggggaggaacatgcaaagtgcttggacctgattgttgcattggaatagaagacttgtccaggaatatttcggaacaaattgaccaaatcaaaaaagatgaacaaaaagaggggactggttggggtctaggtggtaaatggtggacatccgactggggtgttcttactaacttgggcattttgctactattatccatagctgtcttgattgctctatcctgtatttgtcgtatctttaccaaatatatcgggtaatattaagtgtgtattgattaaagctttaggacaattgctactgagcccttcttctaatctactgaaatcaacttgggagatttttaagaagctgataatttaatgtgaatcagtagtttacgtattgttgattgttatggtttgatattcaattgttatcatagtcaagagtaaccttttctatttgatgcattaatgttttaaactacctcttaagcttttgtggatggtttcaatatgtgcgtagaggttaatttaaagagatttcttgttgcacagttttttgtattacttacttgggcttgaagacatagttaagactggccgaaaatgctctccagtcaactccattccccctcagaagagacgtgccgttcaaagagtcttgatttataactaaccattgtaagaattaatttactctttccgttatacttatctacattaattccttgaatgtccagcatcattaacgacttgtcttaattcaatcttttggatgcaaaccataaggaaaaatgagccactttccctctactctgaactaaggaaatttctcttatcagcctaaaatctgatccgttaggtcatgggcccttcataatctgtttgagcatgaatgttgatcaaatgaccaaataatagtgcatttgtatagattcaattatcctttattaagaaaaagatagacagaacacaaagaattgataaaatattactttgatcaattttgcgaggaattataaaaatcttgagggacaaattattgtaacgtagagtcgaagaacattaagtgttctttgttagaattattcatccaagttgttttgagtatactcgcttcaatacaacttcccttcatatttgattcaagatttaaaatgcaacaaccccgtggaaggagtcgaactcgcaaccaccaaaccgcatcatctatatatcatgaaactcagttgccctccaaacctcactacaccaatcatcatccacgtgcaagatcgatgagctcaacccgcagtagtgcagaaagcagtcccaccaatcatattccccgtgctcgaccacccccaacattcaacttatcgaaaccccctcctcctccaaaagacatgtgtaggaacatgaaaattggattgccgtgcactgatcccacttgtaatagagatcatgaccttgataatctaacaaatcgtgaacttttgctattgatggcccgaaaaatgctccccaatacagacaagacttttagaagtctgcaggattgtgggtcaccgtctctttctaaagggctctcaaaagataaacaggagcaaacgaaagatgtgttgaccttggaaaatctaggacacattctgaactacctccacagatcagatattgggaaattggatgagacatcactccgtgcagcattaagtttgacgtgcgctggaattcgaaagacgaatagatccttgatcaacaccatgaccgaattacacattaaccatgaaaatctcccgcaagaccaaaacggtgttatcaaacagacatatacaggtattcaccttgacaaaggaggtcaattcgaagccgccttatggcaaggttgggataagagatcgatatctttattcgtacaagcagctttatatgtaatgaacaatatcccttgtgaatcatcaaccagtgtgcaagcctcatacgatcattttattcttcctcaaagtcaaagtaaaggacaatgattattgtttgaaagttgacaatcaaatcactttcagtttttagtttcaactcttattgcgagacttgaacacaattctactaacttcaataagtgaccccaaattcaagtttactgaagactacgacgataataatcaccaattcattgtaaattactcgattaaaatattcttaagctatcttaaacttgatgatgcagctctgtttcacctttctgttgatttcaatgttacagctatatctaagtgtctaattaacaacttgtacctctaaggaaaatcatgaagaacattaagaaaaaggatgttcttatttttcaactaaacttgcatatcctttgttgatacccttgagagacaacttttgacactagatcacggatcaagcatatttcattcaaacaccccaaattttcaatcatacacataataaccattttagtagcgttacctttcaatacaatctaggtgattgtgaaaagacttccaaacatggcagaattatcaacgcgttacaacttgcctgcaaatgttacggaaaaaagcataaatcttgaccttaattccacagcacgatggataaaagaacccagtgttgggggctggacagtgaagtggggaaactttgttttccacataccaaatactgggatggcattgttgcatcatttaaagtctaacttcgttgttccagagtggcaacaaacaaggaatctattctcccacctctttaaaaacccaaagtcaacaattatagaaccgttcttggctttgaggatcttgcttggagttgctttgaaggatcaagaattacagcaatcattaattcctggatttagatctattgttcatatgctttcagaatggttgctcctagaggtaacgtcggcaatccatattagccccaatctgttgggaatctatttgacctcagacatgtttaagattctgatggcaggtgtgaaaaatttctttaataagatgttcactcttcatgttgtaaatgaccacggaaaacccagcagtattgaaataaagttaactggacaacagatcattatcactcgtgttaatatggggtttctagtggaagtcaggaggattgatattgaaccttgttgtggtgagacagtcctctcagaatcagttgtttttgggctagtggctgaggcagttctaagagaacacagtcaaatggagaagggccaacccctcgatctgacacaatacatgaacagcaaaattgctatataagtggcttaaattagcatggatattcatagtttaaccacataataatgttggaggcacagtacattatagttaattatcctgtataacaaagaatatacctaccctgatttatatttactggtataaaatagtggtatcatcttattaaatagttgtcatataacaggctgttcctataatctgattgtgagattataaacttgtagaattaccgtggatcacaactgttgcatatcttccaaaatatatcttttgcaagcgatgtgtgcttgaatacgtcgatataatacatactaataacgattgattaagaaaaaccaatgatggatattaaatatccatcaagcaggtgtcgcagaataccaggggtttcatatgctgccatatttactaaatcttacataggattatatcattctcttcgatacacgttatatctttagcaaagtaatgaaaatagccttgtcatgttagacgccagttatccatcttaagtgaatcctttcttcaatatgcagcatccaactcaatatcctgatgcaaggttgtcctcccctataatcctagaccagtgtgacttattagccagaagtttagggttgtatagtcattattcacataatccgaaattgcgtaattgtaggattccacatcatatttaccgtttaaggaattcgacagcattaaaaacatttcttcagaactgttcaatactcaccgtcccttttcattcaatctgggatcatattttaacttccattcaatatgatgcaattaatcatgttgatgattttaaatacctattgccctctgagctagtcaagtatgcaaattgggacaacgagttcttgaaggcatatcttaataagatcttaggacttgaccatgtttttccagcttctgcaaggtcacaatgggaggatttttctcctaaggaaaatccttattattgggggatgctgttactcgtgcatttatctcaacttgccaggaggataaaaggacaaagagggtcattaagaagtaactggaagtttataggaacagatttagagctgtttggaatagcagattttattatttttaaagttccagtaaaaacaataatccgaaatgctgtaagcttacaagcttcaaaaccagggttaagagtatggtaccgtgaccaaaacttgaccccttatctatgcgatgatgagtttattgtaagcgtcgctagttatgaatgttttatcatgattaaagacgtcttcattgagaggtataacacgtgggaaatatgtgcccgcgcctggctcgaagacagtgatggagctgattatctccctcttgatgtgttaggtgagttatacaaccagggagatcaaattattgccatgtacttggaagacggtttcaaattgatcaaacacttggaacccttgtgtgtcagctgtatacaaacacatggcatctttacaccaggaaaatactggttccaatcacagaggattgagtcatattatgaggagctctgtagtctcaattggaaatttaaaatttcaggcaataaagctgagtgtgctcaaaactttattaaaactataattcaggggaaattgactcctcaacaatactgtgaattattctctctacaaaagcattggggtcaccccgttttatacattgatgttgcactagataaggttaaaaaacatgcgcaatctgtaaaaatcttaaaacctaaagtcatgtttgaaactttttgtgttttcaaatttatagtagcaaagaatcattatcattctcaaggatcatggtataaaaccacaatggatttgcatttaactccatatcttagacaacatattgtgtcaaattcatttccgtcacaagccgaaatttatcagcatctttgggagtggtatttcgtggagcatgaacctcttttctcaactaaaataataagtgatttaagtatttttataaaagacagggctactgctgtgaaccaggagtgttgggacagtgttttcgatagaagtgtattagggtataaccctcctgttagatttcagtcaaagagagtgccagagcaatttttgggccaagcagacttttccttgaatcaaatattggattttgctgaaaagttagaatatttggctccttcttataggaatttttccttctcattaaaagaaaaagagttgaatataggaagaacttttgggaaattaccatatcgtgtcagaaatgtccaaacactcgcagaagccttgctagcagatggactagcaaaagcattccctagcaacatgatggttgttactgagagggaacagaaagaagcattattgcatcaggcttcttggcaccacaattcagcaagcataggggaaaacgctatagtaaggggtgcaagttttgttactgatcttgagaaatacaaccttgccttccgatatgaatttacacgacatttcatagactactgtaatcgatgttatggtgtgaagaatttattcgattggatgcactttttaataccactatgttatatgcatgtcagtgatttttatagcccaccacattgcgtaacagaagataaccgaaataacccaccggattgtgctaatgcttatcattatcacttagggggtatagagggacttcaacagaaattgtggacatgtatatcatgtgcccagatcacccttgtagagttaaaaactaaattaaaattaaaatccagtgttatgggtgataatcaatgtataacaactctaagtctttttccaattgatgctcccgacgattatcaagagaacgaagctgaattaaatgcggcacgagttgctgtcgaattagctattactacgggttatgatggtatatttttgaagcctgaagaaacatttgtccattcagggttcatttattttggtaaaaagcaatacctcaacggtgttcaactgccacaatcattgaaaacaatggcaagatgtggacccttatctgactctatttttgatgatcttcaaggttccctggccagtattggtacatcctttgagagaggaacaagtgagacacggcacatttttccgagtcgttggatagcttcatttcattcaatgttagcaataaatttattaaatcagaatcaccttgggtttcccctagggttcagtattgatatttcttgtttcaaaaagcctcttaccttttcggaaaaattaattgctcttataacgccccaagttctaggagggttatcatttttgaatccggagaaattgttctaccggaacataagtgatccgctcacttcgggtctatttcaacttaagaatgcattagaatttcttgaaaaggaagaattattctatatcttgattgctaaaaaacctggtttagcagatgcctcagatttcgtcatgaatccattaggcttaaatgtaccaggatcaagggaaataataacgttccttagacaaacagttcgtgaaaatatcacgatcacgtcacaaaatagaataataaattccctttttcacataggttctgatttagaggaccaaagggtgtgtgagtggcttttatcatcaaaccccgtaatgagtcgatttgctgctgacatcttttcaagaacgcctagtggaaaacggcttcaggtcttaggctatctggaaggaacaagaacattactagcttctcggacaataagtttaactacagaagggacaatgttgatgaaattaagggaattaacaagaaaccgatggaaaagctggttttcttatattgatgcattggacgatgatttatctgagtccttagaaaaattcacatgtactgttgatatagctaatttcttgagggcatattcatggctcgacgtcttaaaagggaaaaggctaattggtgccacattgccatgtttactagagcaatttaaggtaaagtggattaatttgtctgaggatttaagggaacaatttaatatgtcttcagaatcagaatcaactataaatttattgccgtatgactgcaaggaactgcgacttggaagaagcaatgacacagagttaaactatgtcagttgtgctctcgaccggaaagttgtccagaaacatccctctgttaatcgtctggcttggacaataggaaatcgagcaccgtatataggatcacggacagaagacaagatcggttatcctcccttaagagtaaattgtccatcagcggcacttaaagaagccattgagatggtttctagattgttgtgggtgactcaaggcactgcagaccgagaaaaattgcttattcctctcctcaattcgagggtaaatctggactatcagacagtgcttaactttttacctacacactactcaggcaacatagttcatagatataatgaccaatatggacaacattcctttatggcaaacaggatgagtaatacatctacacgtgcaattatatcaactaacacactgggcaaatatgctggggggggtcaagctgctgttgatagtaatataatcttccaaaatactatcaatttaggagtggcagttttagatattgcattatctcttgctaaattgtcgtcagcatcaaatgtcactttccgtttgatgttaaataagtgctgcacgcggcatgtgccatctgaatacctattttttgataaacctttagatgtggatttgaacaagtatatggacaatgagttagtttatgacaatgaccctctttgcagtgggattaaagggagattaggcagagtatcccgatcaacactctcgttgagtttgaatgtcagtgacattggttcttatgactttccaactattgctgcatggacactaggagaaactatagtcggaagcattttttctgatgagtcttctcaaagtacagatccaataagttcaggttgcacaaaaactttcgtcacacatttccttgtgtatccagttgagagtattttttatgcattcggggctaacttaatagtagaaagtttaagtctaagtaggatcaaatcaattaagaacctctcagatttgacattccttatatcatccacaatcaggaatttatcacatagatcacttcggattcttcaatctaccttccgacatgaattggtactcacccgactagcccaccacataccgttaatttctttaatgttagggggttctgcaggagagaaaagttcatcagatgctgttcggctatttcttacagcaagttaccagaatttcatcaacaacttcagttgtttgatgaaaaagggccagtcatcactaccggtttggctttactttcctagtgaagggcaacaattaaaacctatattaaaaatcttacagagattatcagacttgttatcacctgacaaagttcaaaagcatcaaatcttagctgacacctgttgtccaattgacagcttttgggtctatccaagcaagtccacaaggactaaccactattatgcaagccttaattattggagagacaaagctaataaggtcaagaatactcctttttcgcatttgataaattgttcatttcttgaactttcttcacacaccagttcggtctcttctaatcaacaagtgaccaattcgaaatatattgttcatccagagaatatccctgaaataaatgcaagaaccaaattaatagattatggatcaacagctctacaggggatggatatcaagatgccactctcggagcaaaatctggttggaaattgtcgaccatcaaagggcattagattcaaggacaatccaaaaacaacaaaacatgaccagggatttgtggggaaggactcttcaccgcgaccaatgtcccctgaagacaacatgcagactcctgcatacatacatagttcccccccatatcaaacccttacaaaatcaccagatgtacatgaggactttgatgcctcgaaggtaatcttaaattctgaaataaataaccttaaccttacggattgtacgcttaatacaaagtcattgacaactcctaccgggacagaaatcttaggtataagtccgttcagatcctctagatattcatcaacttccagggaacggtctcgactatctagagaacaagcttcatatttgtatgttgattgcagtaatattccctctatctctctagacccgggttttcagaatatgtctgatcagaatcaagttcaaatgttaatcaatacctacaaacgtgatttacatgcttgttttgatagcaatcaattctgtcggtttacaggggtagtctcatcaatgcattacaagctttatgatctcttgcctccaggtgaattgagaaaggcaatttgcttggccgaaggagaaggaagtggtgctcggttacttttgaagtggaagaagacggattatttatttttcaacactttggctacggattcacagcaagaagcagagattttaagtggccgggtaataccgagaatgttatataacatagataggttaaatgctttgcttgaatcaagaagattaatattgaacaacctaactatccaaattacagatattacaagtccactatggctagattctgtaatacaatacttacctgaagatagcgacattcttacaatggacgcagagaccactaaagatgaaacaagggaacagctttataagactattgtgaatatttggacacgtacttctcctaatattccaaaaattagcatcatcaaggtatttttattagactatgaagggactttgttcttaatgaggaatgccattcagtattatgggcaggttcaactcaagaaaccatatagctcaaatgcaaaaaactcagaatggtacttgtgttgcggtaaacgaagaattcaacgactcaaaattgatttctcagaccaggtaggaatttttctgatttgtaaagcaatgtcgcgccaaagacaagcaattccttactggttaaaacatatagaaaagaattatcctgcttcattacataagtttttcctaactttgggtttcccttctttagagtcatctttctgccatcgttatactattccattcagtgaaggaaaggctctttttcataaggtccaatcttatgttcgtcaaggcaaacaacatttacattctcttatgttggattatgaaaacaattcacctctactagacttgagaaatcactttatttgctcattgaggggaaagataactaagtattacaatgatatattaaagttaaatctagttatcaaggcagtagagaaaggtaaaaattggtcacaacttgttgagacccttcctaatatgcattcagtctgcatagtacacgtggatcatgagtgctttggatgtgagaaacggttactactcaaattggattttattagaaacacaaagatcgcagaacaaaaattacttaatagagtaatcgggtatattttattctttccgttcggtctgtttaaatctgaatcattaacagcataactttaacaaagagaacttcatttaattcacgaaaataatctatttaaaaatgagggttacattttctagagtattgtatgagaaataataaaataaacaagaagaagaaaaaactattagacagcttgctttacacaagataatcttatatcgtctcaaaccgtacacaagtagggaaatcacgcgcacaaattaacttgtgattgaacgttcggtcacaccagtggtaacttttcaatgttagttactcaaatattattgctcataattggtattgatattggtacattgggtgagtccttgagctttatccttaatataatgtaagaaattagggaaatactgagatatactagttgaattgagttatgacataccatatatcataaatataaaagaacgatctgctgtaatctataagcatctcttttacatacattggggaaagaactaggttatcgttgagattaaaaagactacgttacgttttctctgatgacaagtgacaaaatttcgtagttaaatttctagaatgtcaatgtgaatgtaaattaagaaaaaccaatatataaaattaaaaaattaaaaaactttgatataagtaacacaaaacattcttcatcttttttgtgtgtcca

SEQ ID NO: 3 - RNA, 19 nt, Artificial Sequence
  Ebola virus polymerase complex protein VP35 siRNA sense strand EBL-VP35-1
uaagcgacaucuucuguga

SEQ ID NO: 4 - RNA, 19 nt, Artificial Sequence
  Ebola virus polymerase complex protein VP35 siRNA antisense strand EBL-VP35-1
ucacagaagaugucgcuua

SEQ ID NO: 5 - RNA, 19 nt, Artificial Sequence
  Ebola virus polymerase complex protein VP35 siRNA sense strand EBL-VP35-2
ugagaacaauccaggauua

SEQ ID NO: 6 - RNA, 19 nt, Artificial Sequence
  Ebola virus polymerase complex protein VP35 siRNA antisense strand EBL-VP35-2
uaauccuggauuguucuca

SEQ ID NO: 7 - RNA, 19 nt, Artificial Sequence
  Ebola virus polymerase complex protein VP35 siRNA sense strand EBL-VP35-3
ucauuagaacaacgcauua

SEQ ID NO: 8 - RNA, 19 nt, Artificial Sequence
  Ebola virus polymerase complex protein VP35 siRNA antisense strand EBL-VP35-3
uaaugcguuguucuaauga

SEQ ID NO: 9 - RNA, 19 nt, Artificial Sequence
  Ebola virus polymerase complex protein VP35 siRNA sense strand EBL-VP35-4
ggaggcauucaacaaucua

SEQ ID NO: 10 - RNA, 19 nt, Artificial Sequence
  Ebola virus polymerase complex protein VP35 siRNA antisense strand EBL-VP35-4
uagauuguugaaugccucc

SEQ ID NO: 11 - RNA, 19 nt, Artificial Sequence
  Ebola virus polymerase complex protein VP35 siRNA sense strand EBL-VP35-5
ccgaaagaggcgacuaaua

SEQ ID NO: 12 - RNA, 19 nt, Artificial Sequence
  Ebola virus polymerase complex protein VP35 siRNA antisense strand EBL-VP35-5
uauuagucgccucuuucgg

SEQ ID NO: 13 - RNA, 19 nt, Artificial Sequence
  Ebola virus membrane-associated protein VP24 siRNA sense strand EBL-VP24-1
cgaccucuguaacuucuua

SEQ ID NO: 14 - RNA, 19 nt, Artificial Sequence
  Ebola virus membrane-associated protein VP24 siRNA antisense strand EBL-VP24-1
uaagaaguuacagaggucg

SEQ ID NO: 15 - RNA, 19 nt, Artificial Sequence
  Ebola virus membrane-associated protein VP24 siRNA sense strand EBL-VP24-2
ggacgauacaaucuaauau

SEQ ID NO: 16 - RNA, 19 nt, Artificial Sequence
  Ebola virus membrane-associated protein VP24 siRNA antisense strand EBL-VP24-2
auauuagauuguaucgucc

SEQ ID NO: 17 - RNA, 19 nt, Artificial Sequence
  Ebola virus membrane-associated protein VP24 siRNA sense strand EBL-VP24-3
uacaugucgugaacuacaa

SEQ ID NO: 18 - RNA, 19 nt, Artificial Sequence
  Ebola virus membrane-associated protein VP24 siRNA antisense strand EBL-VP24-3
uuguaguucacgacaugua

SEQ ID NO: 19 - RNA, 19 nt, Artificial Sequence
  Ebola virus membrane-associated protein VP24 siRNA sense strand EBL-VP24-4
auagcucucuugcuaucua

SEQ ID NO: 20 - RNA, 19 nt, Artificial Sequence
  Ebola virus membrane-associated protein VP24 siRNA antisense strand EBL-VP24-4
uagauagcaagagagcuau

SEQ ID NO: 21 - RNA, 19 nt, Artificial Sequence
  Ebola virus membrane-associated protein VP24 siRNA sense strand EBL-VP24-5
uaugcugacucaauaguua

SEQ ID NO: 22 - RNA, 19 nt, Artificial Sequence
  Ebola virus membrane-associated protein VP24 siRNA antisense strand EBL-VP24-5
uaacuauugagucagcaua

SEQ ID NO: 23 - RNA, 19 nt, Artificial Sequence
  Ebola virus RNA-dependent RNA polymerase (L-pol) siRNA sense strand EK1
guacgaagcuguauauaaa

SEQ ID NO: 24 - RNA, 19 nt, Artificial Sequence
  Ebola virus RNA-dependent RNA polymerase (L-pol) siRNA antisense strand EK1
uuuauauacagcuucguac

SEQ ID NO: 25 - RNA, 19 nt, Artificial Sequence
  Ebola virus RNA-dependent RNA polymerase (L-pol) siRNA sense strand EK2
ggaucuugguacaguguua

SEQ ID NO: 26 - RNA, 19 nt, Artificial Sequence
  Ebola virus RNA-dependent RNA polymerase (L-pol) siRNA antisense strand EK2
uaacacuguaccaagaucc

SEQ ID NO: 27 - RNA, 19 nt, Artificial Sequence
  Ebola virus RNA-dependent RNA polymerase (L-pol) siRNA sense strand EK3
caggcuuauuccaguuaaa

SEQ ID NO: 28 - RNA, 19 nt, Artificial Sequence
  Ebola virus RNA-dependent RNA polymerase (L-pol) siRNA antisense strand EK3
uuuaacuggaauaagccug

SEQ ID NO: 29 - RNA, 19 nt, Artificial Sequence
  Ebola virus RNA-dependent RNA polymerase (L-pol) siRNA sense strand EK4
guaaacggcugaacauuau

SEQ ID NO: 30 - RNA, 19 nt, Artificial Sequence
  Ebola virus RNA-dependent RNA polymerase (L-pol) siRNA antisense strand EK4
auaauguucagccguuuac

SEQ ID NO: 31 - RNA, 19 nt, Artificial Sequence
  Marburg virus RNA-dependent RNA polymerase (L-pol) siRNA sense strand MBG-EK1
guacuuguguugcgguaaa

SEQ ID NO: 32 - RNA, 19 nt, Artificial Sequence
  Marburg virus RNA-dependent RNA polymerase (L-pol) siRNA antisense strand MBG-EK1
uuuaccgcaacacaaguac

SEQ ID NO: 33 - RNA, 19 nt, Artificial Sequence
  Marburg virus RNA-dependent RNA polymerase (L-pol) siRNA sense strand MrM-L-4495
gacauugguucuuaugacu

SEQ ID NO: 34 - RNA, 19 nt, Artificial Sequence
  Marburg virus RNA-dependent RNA polymerase (L-pol) siRNA antisense strand MrM-L-4495
agucauaagaaccaauguc

SEQ ID NO: 35 - RNA, 19 nt, Artificial Sequence
  Marburg virus RNA-dependent RNA polymerase (L-pol) siRNA sense strand MrM-L-6340
gaaacaagggaacagcuuu

SEQ ID NO: 36 - RNA, 19 nt, Artificial Sequence
  Marburg virus RNA-dependent RNA polymerase (L-pol) siRNA antisense strand MrM-L-6340
aaagcuguucccuuguuuc

SEQ ID NO: 37 - RNA, 19 nt, Artificial Sequence
  Marburg virus RNA-dependent RNA polymerase (L-pol) siRNA sense strand MrM-L-4528
gcauggacacuaggagaaa

SEQ ID NO: 38 - RNA, 19 nt, Artificial Sequence
  Marburg virus RNA-dependent RNA polymerase (L-pol) siRNA antisense strand MrM-L-4528
uuucuccuaguguccaugc

SEQ ID NO: 39 - RNA, 19 nt, Artificial Sequence
  Marburg virus RNA-dependent RNA polymerase (L-pol) siRNA sense strand MrM-L-4995
gcuuuacuuuccuagugaa

SEQ ID NO: 40 - RNA, 19 nt, Artificial Sequence
  Marburg virus RNA-dependent RNA polymerase (L-pol) siRNA antisense strand MrM-L-4995
uucacuaggaaaguaaagc

SEQ ID NO: 41 - RNA, 19 nt, Artificial Sequence
  Marburg virus RNA-dependent RNA polymerase (L-pol) siRNA sense strand MrM-L-6830
cucuuauguuggauuauga

SEQ ID NO: 42 - RNA, 19 nt, Artificial Sequence
  Marburg virus RNA-dependent RNA polymerase (L-pol) siRNA antisense strand MrM-L-6830
ucauaauccaacauaagag

SEQ ID NO: 43 - RNA, 19 nt, Artificial Sequence
  Marburg virus membrane-associated protein VP24 siRNA sense strand MBG-VP24-602
ucaggaggauugauauuga

SEQ ID NO: 44 - RNA, 19 nt, Artificial Sequence
  Marburg virus membrane-associated protein VP24 siRNA antisense strand MBG-VP24-602
ucaauaucaauccuccuga

SEQ ID NO: 45 - RNA, 19 nt, Artificial Sequence
  Marburg virus membrane-associated protein VP24 siRNA sense strand MBG-VP24-675
ugaggcaguucuaagagaa

SEQ ID NO: 46 - RNA, 19 nt, Artificial Sequence
  Marburg virus membrane-associated protein VP24 siRNA antisense strand MBG-VP24-675
uucucuuagaacugccuca

SEQ ID NO: 47 - RNA, 19 nt, Artificial Sequence
  Marburg virus membrane-associated protein VP24 siRNA sense strand MBG-VP24-4
gcagaauuaucaacgcguu

SEQ ID NO: 48 - RNA, 19 nt, Artificial Sequence
  Marburg virus membrane-associated protein VP24 siRNA antisense strand MBG-VP24-4
aacgcguugauaauucugc

SEQ ID NO: 49 - RNA, 19 nt, Artificial Sequence
  Marburg virus membrane-associated protein VP24 siRNA sense strand MBG-VP24-24
caacuugccugcaaauguu

SEQ ID NO: 50 - RNA, 19 nt, Artificial Sequence
  Marburg virus membrane-associated protein VP24 siRNA antisense strand MBG-VP24-24
aacauuugcaggcaaguug

SEQ ID NO: 51 - RNA, 19 nt, Artificial Sequence
  Marburg virus polymerase complex protein VP35 siRNA sense strand MBG-VP35-747
ggaugcauuucaccagauu

SEQ ID NO: 52 - RNA, 19 nt, Artificial Sequence
  Marburg virus polymerase complex protein VP35 siRNA antisense strand MBG-VP35-747
aaucuggugaaaugcaucc

SEQ ID NO: 53 - RNA, 19 nt, Artificial Sequence
  Marburg virus polymerase complex protein VP35 siRNA sense strand MBG-VP35-756
ucaccagauucuaagugaa

SEQ ID NO: 54 - RNA, 19 nt, Artificial Sequence
  Marburg virus polymerase complex protein VP35 siRNA antisense strand MBG-VP35-756
uucacuuagaaucugguga

SEQ ID NO: 55 - RNA, 19 nt, Artificial Sequence
  negative control sense strand EBL-SCRAM1
caaaaaaauuuuuaccggg

SEQ ID NO: 56 - RNA, 19 nt, Artificial Sequence
  negative control antisense strand EBL-SCRAM1
cccgguaaaaauuuuuuug

SEQ ID NO: 57 - DNA, 23 bp, Artificial Sequence
  Ebola virus RNA-dependent RNA polymerase (L-pol) siRNA target region
gatgaagcagttgaaattcttcc

SEQ ID NO: 58 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugaagcaguugaaauucuutt

SEQ ID NO: 59 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aagaauuucaacugcuucatt

SEQ ID NO: 60 - DNA, 23 bp, Artificial Sequence
  Ebola virus RNA-dependent RNA polymerase (L-pol) siRNA target region
gttgaaattcttcctcttgatat

SEQ ID NO: 61 - DNA, 21 bp, Artificial Sequence
  Ebola virus RNA-dependent RNA polymerase (L-pol) siRNA sense strand
ugaaauucuuccucuugautt

SEQ ID NO: 62 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA sense strand
aucaagaggaagaauuucatt

SEQ ID NO: 63 - DNA, 23 bp, Artificial Sequence
  Ebola virus RNA-dependent RNA polymerase (L-pol) siRNA target region
  Description of Combined DNA/RNA Molecule:Ebola virus RNA-dependent RNA polymerase (L-pol) siRNA antisense strand
cccgaaacatatctaccgtttga

SEQ ID NO: 64 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cgaaacauaucuaccguuutt

SEQ ID NO: 65 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaacgguagauauguuucgtt

SEQ ID NO: 66 - DNA, 23 bp, Artificial Sequence
  Ebola virus RNA-dependent RNA polymerase (L-pol) siRNA target region
caagaagactgtgttgatgaaca

SEQ ID NO: 67 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agaagacuguguugaugaatt

SEQ ID NO: 68 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uucaucaacacagucuucutt

SEQ ID NO: 69 - DNA, 23 bp, Artificial Sequence
  Ebola virus RNA-dependent RNA polymerase (L-pol) siRNA target region
gatgaacactttcaagagaaaat

SEQ ID NO: 70 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugaacacuuucaagagaaatt

SEQ ID NO: 71 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuucucuugaaaguguucatt

SEQ ID NO: 72 - DNA, 23 bp, Artificial Sequence
  Ebola virus RNA-dependent RNA polymerase (L-pol) siRNA target region
atcgaggaaactctagatcaaca

SEQ ID NO: 73 - DNA, 21 bp, Artificial Sequence
  Ebola virus RNA-dependent RNA polymerase (L-pol) siRNA sense strand
cgaggaaacucuagaucaatt

SEQ ID NO: 74 - DNA, 21 bp, Artificial Sequence
  Ebola virus RNA-dependent RNA polymerase (L-pol) siRNA antisense strand
uugaucuagaguuuccucgtt

SEQ ID NO: 75 - DNA, 23 bp, Artificial Sequence
  Ebola virus RNA-dependent RNA polymerase (L-pol) siRNA target region
gaagatcccaatttcaatgttac

SEQ ID NO: 76 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agaucccaauuucaauguutt

SEQ ID NO: 77 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aacauugaaauugggaucutt

SEQ ID NO: 78 - DNA, 23 bp, Artificial Sequence
  Ebola virus RNA-dependent RNA polymerase (L-pol) siRNA target region
gttcaagggcatacacacattgt

SEQ ID NO: 79 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ucaagggcauacacacauutt

SEQ ID NO: 80 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aauguguguaugcccuugatt

SEQ ID NO: 81 - DNA, 23 bp, Artificial Sequence
  Ebola virus RNA-dependent RNA polymerase (L-pol) siRNA target region
acacacattgtttctgtttctac

SEQ ID NO: 82 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
acacauuguuucuguuucutt

SEQ ID NO: 83 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
agaaacagaaacaaugugutt

SEQ ID NO: 84 - DNA, 23 bp, Artificial Sequence
  Ebola virus RNA-dependent RNA polymerase (L-pol) siRNA target region
caacacaactctaatctcaaaaa

SEQ ID NO: 85 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
acacaacucuaaucucaaatt

SEQ ID NO: 86 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuugagauuagaguugugutt

SEQ ID NO: 87 - DNA, 23 bp, Artificial Sequence
  Ebola virus RNA-dependent RNA polymerase (L-pol) siRNA target region
gaggatccagtttgttctgatta

SEQ ID NO: 88 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggauccaguuuguucugautt

SEQ ID NO: 89 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aucagaacaaacuggaucctt

SEQ ID NO: 90 - DNA, 23 bp, Artificial Sequence
  Ebola virus RNA-dependent RNA polymerase (L-pol) siRNA target region
gcggagattacttactctccata

SEQ ID NO: 91 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggagauuacuuacucuccatt

SEQ ID NO: 92 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uggagaguaaguaaucucctt

SEQ ID NO: 93 - DNA, 23 bp, Artificial Sequence
  Ebola virus RNA-dependent RNA polymerase (L-pol) siRNA target region
aaggatcttggtacagtgttact

SEQ ID NO: 94 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaucuugguacaguguuatt

SEQ ID NO: 95 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uaacacuguaccaagaucctt

SEQ ID NO: 96 - DNA, 23 bp, Artificial Sequence
  Ebola virus RNA-dependent RNA polymerase (L-pol) siRNA target region
tggtacagtgttacttcagatag

SEQ ID NO: 97 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guacaguguuacuucagautt

SEQ ID NO: 98 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aucugaaguaacacuguactt

SEQ ID NO: 99 - DNA, 23 bp, Artificial Sequence
  Ebola virus RNA-dependent RNA polymerase (L-pol) siRNA target region
aaagacagagctaccgcagtaga

SEQ ID NO: 100 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agacagagcuaccgcaguatt

SEQ ID NO: 101 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uacugcgguagcucugucutt

SEQ ID NO: 102 - DNA, 23 bp, Artificial Sequence
  Ebola virus RNA-dependent RNA polymerase (L-pol) siRNA target region
ttcgagcctaatgttctaggata

SEQ ID NO: 103 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cgagccuaauguucuaggatt

SEQ ID NO: 104 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uccuagaacauuaggcucgtt

SEQ ID NO: 105 - DNA, 23 bp, Artificial Sequence
  Ebola virus RNA-dependent RNA polymerase (L-pol) siRNA target region
tataatccacctcacaaatttag

SEQ ID NO: 106 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
uaauccaccucacaaauuutt

SEQ ID NO: 107 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaauuugugagguggauuatt

SEQ ID NO: 108 - DNA, 23 bp, Artificial Sequence
  Ebola virus RNA-dependent RNA polymerase (L-pol) siRNA target region
tactaccacaatatcggaacttt

SEQ ID NO: 109 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuaccacaauaucggaacutt

SEQ ID NO: 110 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aguuccgauauugugguagtt

SEQ ID NO: 111 - DNA, 23 bp, Artificial Sequence
  Ebola virus RNA-dependent RNA polymerase (L-pol) siRNA target region
aaagagttgaatgtaggtagaac

SEQ ID NO: 112 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agaguugaauguagguagatt

SEQ ID NO: 113 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ucuaccuacauucaacucutt

SEQ ID NO: 114 - DNA, 23 bp, Artificial Sequence
  Ebola virus RNA-dependent RNA polymerase (L-pol) siRNA target region
tcctagcaatatgatggtagtta

SEQ ID NO: 115 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuagcaauaugaugguagutt

SEQ ID NO: 116 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
acuaccaucauauugcuagtt

SEQ ID NO: 117 - DNA, 23 bp, Artificial Sequence
  Ebola virus RNA-dependent RNA polymerase (L-pol) siRNA target region
agggagtagctttgtaactgatt

SEQ ID NO: 118 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaguagcuuuguaacugatt

SEQ ID NO: 119 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ucaguuacaaagcuacucctt

SEQ ID NO: 120 - DNA, 23 bp, Artificial Sequence
  Ebola virus RNA-dependent RNA polymerase (L-pol) siRNA target region
gagtagctttgtaactgatttag

SEQ ID NO: 121 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guagcuuuguaacugauuutt

SEQ ID NO: 122 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaaucaguuacaaagcuactt

SEQ ID NO: 123 - DNA, 23 bp, Artificial Sequence
  Ebola virus RNA-dependent RNA polymerase (L-pol) siRNA target region
atgcatgtcagtgattattataa

SEQ ID NO: 124 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcaugucagugauuauuautt

SEQ ID NO: 125 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auaauaaucacugacaugctt

SEQ ID NO: 126 - DNA, 23 bp, Artificial Sequence
  Ebola virus RNA-dependent RNA polymerase (L-pol) siRNA target region
ggctacaagaatggcaccattgt

SEQ ID NO: 127 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuacaagaauggcaccauutt

SEQ ID NO: 128 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aauggugccauucuuguagtt

SEQ ID NO: 129 - DNA, 23 bp, Artificial Sequence
  Ebola virus RNA-dependent RNA polymerase (L-pol) siRNA target region
cacgacatatctttccttgcagg

SEQ ID NO: 130 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cgacauaucuuuccuugcatt

SEQ ID NO: 131 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ugcaaggaaagauaugucgtt

SEQ ID NO: 132 - DNA, 23 bp, Artificial Sequence
  Ebola virus RNA-dependent RNA polymerase (L-pol) siRNA target region
ggtgagaatcttgcaatatcatc

SEQ ID NO: 133 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugagaaucuugcaauaucatt

SEQ ID NO: 134 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ugauauugcaagauucucatt

SEQ ID NO: 135 - DNA, 23 bp, Artificial Sequence
  Ebola virus RNA-dependent RNA polymerase (L-pol) siRNA target region
ccgcaggtgcttggagggttatc

SEQ ID NO: 136 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcaggugcuuggaggguuatt

SEQ ID NO: 137 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uaacccuccaagcaccugctt

SEQ ID NO: 138 - DNA, 23 bp, Artificial Sequence
  Ebola virus RNA-dependent RNA polymerase (L-pol) siRNA target region
ttggagggttatccttcttgaat

SEQ ID NO: 139 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaggguuauccuucuugatt

SEQ ID NO: 140 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ucaagaaggauaacccucctt

SEQ ID NO: 141 - DNA, 23 bp, Artificial Sequence
  Ebola virus RNA-dependent RNA polymerase (L-pol) siRNA target region
ttctaccggaatctaggagatcc

SEQ ID NO: 142 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuaccggaaucuaggagautt

SEQ ID NO: 143 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aucuccuagauuccgguagtt

SEQ ID NO: 144 - DNA, 23 bp, Artificial Sequence
  Ebola virus RNA-dependent RNA polymerase (L-pol) siRNA target region
cctcaggcttattccagttaaaa

SEQ ID NO: 145 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ucaggcuuauuccaguuaatt

SEQ ID NO: 146 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuaacuggaauaagccugatt

SEQ ID NO: 147 - DNA, 23 bp, Artificial Sequence
  Ebola virus RNA-dependent RNA polymerase (L-pol) siRNA target region
aatgattgagatggatgatttat

SEQ ID NO: 148 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugauugagauggaugauuutt

SEQ ID NO: 149 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaaucauccaucucaaucatt

SEQ ID NO: 150 - DNA, 23 bp, Artificial Sequence
  Ebola virus RNA-dependent RNA polymerase (L-pol) siRNA target region
ctgcactgccattgactttgtgc

SEQ ID NO: 151 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcacugccauugacuuugutt

SEQ ID NO: 152 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
acaaagucaauggcagugctt

SEQ ID NO: 153 - DNA, 23 bp, Artificial Sequence
  Ebola virus RNA-dependent RNA polymerase (L-pol) siRNA target region
tgccattgactttgtgctaaatc

SEQ ID NO: 154 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ccauugacuuugugcuaaatt

SEQ ID NO: 155 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuuagcacaaagucaauggtt

SEQ ID NO: 156 - DNA, 23 bp, Artificial Sequence
  Ebola virus RNA-dependent RNA polymerase (L-pol) siRNA target region
cgggaagcgattgcaaattctag

SEQ ID NO: 157 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaagcgauugcaaauucutt

SEQ ID NO: 158 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
agaauuugcaaucgcuucctt

SEQ ID NO: 159 - DNA, 23 bp, Artificial Sequence
  Ebola virus RNA-dependent RNA polymerase (L-pol) siRNA target region
acgcacattattagcctctaaga

SEQ ID NO: 160 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcacauuauuagccucuaatt

SEQ ID NO: 161 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuagaggcuaauaaugugctt

SEQ ID NO: 162 - DNA, 23 bp, Artificial Sequence
  Ebola virus RNA-dependent RNA polymerase (L-pol) siRNA target region
acccaaataacttgcacagttga

SEQ ID NO: 163 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ccaaauaacuugcacaguutt

SEQ ID NO: 164 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aacugugcaaguuauuuggtt

SEQ ID NO: 165 - DNA, 23 bp, Artificial Sequence
  Ebola virus RNA-dependent RNA polymerase (L-pol) siRNA target region
ttgaattggcgtcccgtttaaca

SEQ ID NO: 166 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gaauuggcgucccguuuaatt

SEQ ID NO: 167 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuaaacgggacgccaauuctt

SEQ ID NO: 168 - DNA, 23 bp, Artificial Sequence
  Ebola virus RNA-dependent RNA polymerase (L-pol) siRNA target region
gaacagtgacttgctaataaaac

SEQ ID NO: 169 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
acagugacuugcuaauaaatt

SEQ ID NO: 170 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuuauuagcaagucacugutt

SEQ ID NO: 171 - DNA, 23 bp, Artificial Sequence
  Ebola virus RNA-dependent RNA polymerase (L-pol) siRNA target region
aggtacaacgatcaatacagtcc

SEQ ID NO: 172 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guacaacgaucaauacagutt

SEQ ID NO: 173 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
acuguauugaucguuguactt

SEQ ID NO: 174 - DNA, 23 bp, Artificial Sequence
  Ebola virus RNA-dependent RNA polymerase (L-pol) siRNA target region
gatcaatacagtcctcattcttt

SEQ ID NO: 175 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ucaauacaguccucauucutt

SEQ ID NO: 176 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
agaaugaggacuguauugatt

SEQ ID NO: 177 - DNA, 23 bp, Artificial Sequence
  Ebola virus RNA-dependent RNA polymerase (L-pol) siRNA target region
cagcaacgcgattgattgtttct

SEQ ID NO: 178 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcaacgcgauugauuguuutt

SEQ ID NO: 179 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaacaaucaaucgcguugctt

SEQ ID NO: 180 - DNA, 23 bp, Artificial Sequence
  Ebola virus RNA-dependent RNA polymerase (L-pol) siRNA target region
taccagctcagtatttaacatac

SEQ ID NO: 181 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ccagcucaguauuuaacautt

SEQ ID NO: 182 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auguuaaauacugagcuggtt

SEQ ID NO: 183 - DNA, 23 bp, Artificial Sequence
  Ebola virus RNA-dependent RNA polymerase (L-pol) siRNA target region
gaggactcaattgcaatatctca

SEQ ID NO: 184 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggacucaauugcaauaucutt

SEQ ID NO: 185 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
agauauugcaauugagucctt

SEQ ID NO: 186 - DNA, 23 bp, Artificial Sequence
  Ebola virus RNA-dependent RNA polymerase (L-pol) siRNA target region
aggtaaacggctgaacattatag

SEQ ID NO: 187 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guaaacggcugaacauuautt

SEQ ID NO: 188 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auaauguucagccguuuactt

SEQ ID NO: 189 - DNA, 23 bp, Artificial Sequence
  Ebola virus RNA-dependent RNA polymerase (L-pol) siRNA target region
caagaccatcatgcaatcaatta

SEQ ID NO: 190 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agaccaucaugcaaucaautt

SEQ ID NO: 191 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auugauugcaugauggucutt

SEQ ID NO: 192 - DNA, 23 bp, Artificial Sequence
  Ebola virus RNA-dependent RNA polymerase (L-pol) siRNA target region
cactacccatttcttaacttatc

SEQ ID NO: 193 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuacccauuucuuaacuuatt

SEQ ID NO: 194 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uaaguuaagaaauggguagtt

SEQ ID NO: 195 - DNA, 23 bp, Artificial Sequence
  Ebola virus RNA-dependent RNA polymerase (L-pol) siRNA target region
taccacatcgctcattgcgaata

SEQ ID NO: 196 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ccacaucgcucauugcgaatt

SEQ ID NO: 197 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uucgcaaugagcgauguggtt

SEQ ID NO: 198 - DNA, 23 bp, Artificial Sequence
  Ebola virus RNA-dependent RNA polymerase (L-pol) siRNA target region
tgcaagcgttatgtcacggttaa

SEQ ID NO: 199 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
caagcguuaugucacgguutt

SEQ ID NO: 200 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaccgugacauaacgcuugtt

SEQ ID NO: 201 - DNA, 23 bp, Artificial Sequence
  Ebola virus RNA-dependent RNA polymerase (L-pol) siRNA target region
gagaacgtccatttcatcttttc

SEQ ID NO: 202 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gaacguccauuucaucuuutt

SEQ ID NO: 203 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaagaugaaauggacguuctt

SEQ ID NO: 204 - DNA, 23 bp, Artificial Sequence
  Ebola virus RNA-dependent RNA polymerase (L-pol) siRNA target region
cccaacacctgtgaataattttc

SEQ ID NO: 205 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
caacaccugugaauaauuutt

SEQ ID NO: 206 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaauuauucacagguguugtt

SEQ ID NO: 207 - DNA, 23 bp, Artificial Sequence
  Ebola virus RNA-dependent RNA polymerase (L-pol) siRNA target region
cacgacaatcttgtttacacatg

SEQ ID NO: 208 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cgacaaucuuguuuacacatt

SEQ ID NO: 209 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uguguaaacaagauugucgtt

SEQ ID NO: 210 - DNA, 23 bp, Artificial Sequence
  Ebola virus RNA-dependent RNA polymerase (L-pol) siRNA target region
caagagactcttcaactggatca

SEQ ID NO: 211 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
agagacucuucaacuggautt

SEQ ID NO: 212 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auccaguugaagagucucutt

SEQ ID NO: 213 - DNA, 23 bp, Artificial Sequence
  Ebola virus RNA-dependent RNA polymerase (L-pol) siRNA target region
cttcaactggatcaagcacaaac

SEQ ID NO: 214 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ucaacuggaucaagcacaatt

SEQ ID NO: 215 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uugugcuugauccaguugatt

SEQ ID NO: 216 - DNA, 23 bp, Artificial Sequence
  Ebola virus RNA-dependent RNA polymerase (L-pol) siRNA target region
aacaacagtgatggtcatattga

SEQ ID NO: 217 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
caacagugauggucauauutt

SEQ ID NO: 218 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aauaugaccaucacuguugtt

SEQ ID NO: 219 - DNA, 23 bp, Artificial Sequence
  Ebola virus RNA-dependent RNA polymerase (L-pol) siRNA target region
attgagagaagtcaagaacaaac

SEQ ID NO: 220 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugagagaagucaagaacaatt

SEQ ID NO: 221 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuguucuugacuucucucatt

SEQ ID NO: 222 - DNA, 23 bp, Artificial Sequence
  Ebola virus RNA-dependent RNA polymerase (L-pol) siRNA target region
catgatggcactgaacggaatct

SEQ ID NO: 223 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugauggcacugaacggaautt

SEQ ID NO: 224 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auuccguucagugccaucatt

SEQ ID NO: 225 - DNA, 23 bp, Artificial Sequence
  Ebola virus RNA-dependent RNA polymerase (L-pol) siRNA target region
acggaatctagtcctacaaatga

SEQ ID NO: 226 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaaucuaguccuacaaautt

SEQ ID NO: 227 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auuuguaggacuagauucctt

SEQ ID NO: 228 - DNA, 23 bp, Artificial Sequence
  Ebola virus RNA-dependent RNA polymerase (L-pol) siRNA target region
aagaacgacaattccacaagaaa

SEQ ID NO: 229 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gaacgacaauuccacaagatt

SEQ ID NO: 230 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
ucuuguggaauugucguuctt

SEQ ID NO: 231 - DNA, 23 bp, Artificial Sequence
  Ebola virus RNA-dependent RNA polymerase (L-pol) siRNA target region
agtgactctgcttgtggtacagc

SEQ ID NO: 232 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugacucugcuugugguacatt

SEQ ID NO: 233 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uguaccacaagcagagucatt

SEQ ID NO: 234 - DNA, 23 bp, Artificial Sequence
  Ebola virus RNA-dependent RNA polymerase (L-pol) siRNA target region
ggacacgccaattaacgtcatcc

SEQ ID NO: 235 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
acacgccaauuaacgucautt

SEQ ID NO: 236 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
augacguuaauuggcgugutt

SEQ ID NO: 237 - DNA, 23 bp, Artificial Sequence
  Ebola virus RNA-dependent RNA polymerase (L-pol) siRNA target region
taggatgcttctacctgttatgt

SEQ ID NO: 238 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ggaugcuucuaccuguuautt

SEQ ID NO: 239 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auaacagguagaagcaucctt

SEQ ID NO: 240 - DNA, 23 bp, Artificial Sequence
  Ebola virus RNA-dependent RNA polymerase (L-pol) siRNA target region
agcaagccaaataacagacataa

SEQ ID NO: 241 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
caagccaaauaacagacautt

SEQ ID NO: 242 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
augucuguuauuuggcuugtt

SEQ ID NO: 243 - DNA, 23 bp, Artificial Sequence
  Ebola virus RNA-dependent RNA polymerase (L-pol) siRNA target region
acctaagcaagtcgaggttataa

SEQ ID NO: 244 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuaagcaagucgagguuautt

SEQ ID NO: 245 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auaaccucgacuugcuuagtt

SEQ ID NO: 246 - DNA, 23 bp, Artificial Sequence
  Ebola virus RNA-dependent RNA polymerase (L-pol) siRNA target region
ttgtacgaagctgtatataaatt

SEQ ID NO: 247 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guacgaagcuguauauaaatt

SEQ ID NO: 248 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuuauauacagcuucguactt

SEQ ID NO: 249 - DNA, 23 bp, Artificial Sequence
  Ebola virus RNA-dependent RNA polymerase (L-pol) siRNA target region
attgaaagcagtggtccttaaag

SEQ ID NO: 250 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugaaagcagugguccuuaatt

SEQ ID NO: 251 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuaaggaccacugcuuucatt

SEQ ID NO: 252 - DNA, 23 bp, Artificial Sequence
  Ebola virus RNA-dependent RNA polymerase (L-pol) siRNA target region
ggcaagctgagtttaagaaatta

SEQ ID NO: 253 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
caagcugaguuuaagaaautt

SEQ ID NO: 254 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auuucuuaaacucagcuugtt

SEQ ID NO: 255 - DNA, 23 bp, Artificial Sequence
  Ebola virus RNA-dependent RNA polymerase (L-pol) siRNA target region
gtgcaataggttctaccatatta

SEQ ID NO: 256 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
gcaauagguucuaccauautt

SEQ ID NO: 257 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
auaugguagaaccuauugctt

SEQ ID NO: 258 - DNA, 23 bp, Artificial Sequence
  Ebola virus RNA-dependent RNA polymerase (L-pol) siRNA target region
tgtgaagaacgtttcttagttca

SEQ ID NO: 259 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugaagaacguuucuuaguutt

SEQ ID NO: 260 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aacuaagaaacguucuucatt

SEQ ID NO: 261 - DNA, 23 bp, Artificial Sequence
  Ebola virus RNA-dependent RNA polymerase (L-pol) siRNA target region
gctgacagggcttctgagtttat

SEQ ID NO: 262 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
ugacagggcuucugaguuutt

SEQ ID NO: 263 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aaacucagaagcccugucatt

SEQ ID NO: 264 - DNA, 23 bp, Artificial Sequence
  Ebola virus RNA-dependent RNA polymerase (L-pol) siRNA target region
ctctacaggtttgattgaattac

SEQ ID NO: 265 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
cuacagguuugauugaauutt

SEQ ID NO: 266 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
aauucaaucaaaccuguagtt

SEQ ID NO: 267 - DNA, 23 bp, Artificial Sequence
  Ebola virus RNA-dependent RNA polymerase (L-pol) siRNA target region
tagtatcctgatacttgcaaagg

SEQ ID NO: 268 - DNA, 21 bp, Artificial Sequence
  Ebola virus RNA-dependent RNA polymerase (L-pol) siRNA sense strand
  Description of Combined DNA/RNA Molecule:Ebola virus RNA-dependent RNA polymerase (L-pol) siRNA sense strand
guauccugauacuugcaaatt

SEQ ID NO: 269 - DNA, 21 bp, Artificial Sequence
  Ebola virus RNA-dependent RNA polymerase (L-pol) siRNA antisense strand
  Description of Combined DNA/RNA Molecule:Ebola virus RNA-dependent RNA polymerase (L-pol) siRNA antisense strand
uuugcaaguaucaggauactt

SEQ ID NO: 270 - DNA, 23 bp, Artificial Sequence
  Marburg virus RNA-dependent RNA polymerase (L-pol) siRNA target region
catcaagcaagtgttgtagaata

SEQ ID NO: 271 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucaagcaaguguuguagaatt

SEQ ID NO: 272 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uucuacaacacuugcuugatt

SEQ ID NO: 273 - DNA, 23 bp, Artificial Sequence
  Marburg virus RNA-dependent RNA polymerase (L-pol) siRNA target region
tcacaggctgctaaacttactaa

SEQ ID NO: 274 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acaggcugcuaaacuuacutt

SEQ ID NO: 275 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aguaaguuuagcagccugutt

SEQ ID NO: 276 - DNA, 23 bp, Artificial Sequence
  Marburg virus RNA-dependent RNA polymerase (L-pol) siRNA target region
ttcgatacacgttatatctttag

SEQ ID NO: 277 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cgauacacguuauaucuuutt

SEQ ID NO: 278 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaagauauaacguguaucgtt

SEQ ID NO: 279 - DNA, 23 bp, Artificial Sequence
  Marburg virus RNA-dependent RNA polymerase (L-pol) siRNA target region
aaacagctttatcatgttagatg

SEQ ID NO: 280 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acagcuuuaucauguuagatt

SEQ ID NO: 281 - DNA, 20 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
cuaacaugauaaagcugutt

SEQ ID NO: 282 - DNA, 23 bp, Artificial Sequence
  Marburg virus RNA-dependent RNA polymerase (L-pol) siRNA target region
ttagatgccagttatccatttta

SEQ ID NO: 283 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agaugccaguuauccauuutt

SEQ ID NO: 284 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaauggauaacuggcaucutt

SEQ ID NO: 285 - DNA, 23 bp, Artificial Sequence
  Marburg virus RNA-dependent RNA polymerase (L-pol) siRNA target region
agtgaatcctttcctcaacatgc

SEQ ID NO: 286 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaauccuuuccucaacautt

SEQ ID NO: 287 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auguugaggaaaggauucatt

SEQ ID NO: 288 - DNA, 23 bp, Artificial Sequence
  Marburg virus RNA-dependent RNA polymerase (L-pol) siRNA target region
cagcatccaactcaatatcctga

SEQ ID NO: 289 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcauccaacucaauauccutt

SEQ ID NO: 290 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aggauauugaguuggaugctt

SEQ ID NO: 291 - DNA, 23 bp, Artificial Sequence
  Marburg virus RNA-dependent RNA polymerase (L-pol) siRNA target region
atgcaaggttgtcctctcctata

SEQ ID NO: 292 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcaagguuguccucuccuatt

SEQ ID NO: 293 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaggagaggacaaccuugctt

SEQ ID NO: 294 - DNA, 23 bp, Artificial Sequence
  Marburg virus RNA-dependent RNA polymerase (L-pol) siRNA target region
ctagaccagtgtgacttattagc

SEQ ID NO: 295 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agaccagugugacuuauuatt

SEQ ID NO: 296 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaauaagucacacuggucutt

SEQ ID NO: 297 - DNA, 23 bp, Artificial Sequence
  Marburg virus RNA-dependent RNA polymerase (L-pol) siRNA target region
gtttagggttgtatagtcattat

SEQ ID NO: 298 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
uuaggguuguauagucauutt

SEQ ID NO: 299 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaugacuauacaacccuaatt

SEQ ID NO: 300 - DNA, 23 bp, Artificial Sequence
  Marburg virus RNA-dependent RNA polymerase (L-pol) siRNA target region
ccacatcacatttaccgtttaag

SEQ ID NO: 301 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acaucacauuuaccguuuatt

SEQ ID NO: 302 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaaacgguaaaugugaugutt

SEQ ID NO: 303 - DNA, 23 bp, Artificial Sequence
  Marburg virus RNA-dependent RNA polymerase (L-pol) siRNA target region
ttcgacagcattaaagacatttc

SEQ ID NO: 304 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cgacagcauuaaagacauutt

SEQ ID NO: 305 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaugucuuuaaugcugucgtt

SEQ ID NO: 306 - DNA, 23 bp, Artificial Sequence
  Marburg virus RNA-dependent RNA polymerase (L-pol) siRNA target region
aaagagggtcattaagaagtaac

SEQ ID NO: 307 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agagggucauuaagaaguatt

SEQ ID NO: 308 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uacuucuuaaugacccucutt

SEQ ID NO: 309 - DNA, 23 bp, Artificial Sequence
  Marburg virus RNA-dependent RNA polymerase (L-pol) siRNA target region
aggaacagatttggagctgtttg

SEQ ID NO: 310 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaacagauuuggagcuguutt

SEQ ID NO: 311 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacagcuccaaaucuguuctt

SEQ ID NO: 312 - DNA, 23 bp, Artificial Sequence
  Marburg virus RNA-dependent RNA polymerase (L-pol) siRNA target region
ttggagctgtttggaatagcaga

SEQ ID NO: 313 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggagcuguuuggaauagcatt

SEQ ID NO: 314 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ugcuauuccaaacagcucctt

SEQ ID NO: 315 - DNA, 23 bp, Artificial Sequence
  Marburg virus RNA-dependent RNA polymerase (L-pol) siRNA target region
caaaaccgggattaagaatatgg

SEQ ID NO: 316 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
aaaccgggauuaagaauautt

SEQ ID NO: 317 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auauucuuaaucccgguuutt

SEQ ID NO: 318 - DNA, 23 bp, Artificial Sequence
  Marburg virus RNA-dependent RNA polymerase (L-pol) siRNA target region
gctgattatcctcctcttgatgt

SEQ ID NO: 319 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugauuauccuccucuugautt

SEQ ID NO: 320 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aucaagaggaggauaaucatt

SEQ ID NO: 321 - DNA, 23 bp, Artificial Sequence
  Marburg virus RNA-dependent RNA polymerase (L-pol) siRNA target region
tgtcagctgtatacaaacacatg

SEQ ID NO: 322 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucagcuguauacaaacacatt

SEQ ID NO: 323 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uguguuuguauacagcugatt

SEQ ID NO: 324 - DNA, 23 bp, Artificial Sequence
  Marburg virus RNA-dependent RNA polymerase (L-pol) siRNA target region
gatgaactccatgatctcaattt

SEQ ID NO: 325 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaacuccaugaucucaautt

SEQ ID NO: 326 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auugagaucauggaguucatt

SEQ ID NO: 327 - DNA, 23 bp, Artificial Sequence
  Marburg virus RNA-dependent RNA polymerase (L-pol) siRNA target region
ccacacatgatttgcatttgact

SEQ ID NO: 328 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acacaugauuugcauuugatt

SEQ ID NO: 329 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ucaaaugcaaaucaugugutt

SEQ ID NO: 330 - DNA, 23 bp, Artificial Sequence
  Marburg virus RNA-dependent RNA polymerase (L-pol) siRNA target region
ttgcatttgactccatatcttag

SEQ ID NO: 331 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcauuugacuccauaucuutt

SEQ ID NO: 332 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aagauauggagucaaaugctt

SEQ ID NO: 333 - DNA, 23 bp, Artificial Sequence
  Marburg virus RNA-dependent RNA polymerase (L-pol) siRNA target region
gctgaccgctgtgaaccaggagt

SEQ ID NO: 334 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaccgcugugaaccaggatt

SEQ ID NO: 335 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uccugguucacagcggucatt

SEQ ID NO: 336 - DNA, 23 bp, Artificial Sequence
  Marburg virus RNA-dependent RNA polymerase (L-pol) siRNA target region
tataaccctcctgttagatttca

SEQ ID NO: 337 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
uaacccuccuguuagauuutt

SEQ ID NO: 338 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaaucuaacaggaggguuatt

SEQ ID NO: 339 - DNA, 23 bp, Artificial Sequence
  Marburg virus RNA-dependent RNA polymerase (L-pol) siRNA target region
gagtatttggctccttcttatag

SEQ ID NO: 340 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guauuuggcuccuucuuaudt

SEQ ID NO: 341 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auaagaaggagccaaauactt

SEQ ID NO: 342 - DNA, 23 bp, Artificial Sequence
  Marburg virus RNA-dependent RNA polymerase (L-pol) siRNA target region
aaagagttgaatataggaagaac

SEQ ID NO: 343 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agaguugaauauaggaagatt

SEQ ID NO: 344 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ucuuccuauauucaacucutt

SEQ ID NO: 345 - DNA, 23 bp, Artificial Sequence
  Marburg virus RNA-dependent RNA polymerase (L-pol) siRNA target region
tgtcagaaatgtccaaacactcg

SEQ ID NO: 346 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucagaaauguccaaacacutt

SEQ ID NO: 347 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aguguuuggacauuucugatt

SEQ ID NO: 348 - DNA, 23 bp, Artificial Sequence
  Marburg virus RNA-dependent RNA polymerase (L-pol) siRNA target region
ccctagtaacatgatggttgtca

SEQ ID NO: 349 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cuaguaacaugaugguugutt

SEQ ID NO: 350 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acaaccaucauguuacuagtt

SEQ ID NO: 351 - DNA, 23 bp, Artificial Sequence
  Marburg virus RNA-dependent RNA polymerase (L-pol) siRNA target region
ttacacggcatttcatagactac

SEQ ID NO: 352 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acacggcauuucauagacutt

SEQ ID NO: 353 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
agucuaugaaaugccgugutt

SEQ ID NO: 354 - DNA, 23 bp, Artificial Sequence
  Marburg virus RNA-dependent RNA polymerase (L-pol) siRNA target region
atagactactgtaatcgatgtta

SEQ ID NO: 355 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agacuacuguaaucgaugutt

SEQ ID NO: 356 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acaucgauuacaguagucutt

SEQ ID NO: 357 - DNA, 23 bp, Artificial Sequence
  Marburg virus RNA-dependent RNA polymerase (L-pol) siRNA target region
gactactgtaatcgatgttatgg

SEQ ID NO: 358 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cuacuguaaucgauguuautt

SEQ ID NO: 359 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auaacaucgauuacaguagtt

SEQ ID NO: 360 - DNA, 23 bp, Artificial Sequence
  Marburg virus RNA-dependent RNA polymerase (L-pol) siRNA target region
cctgattgtgctaatgcttatca

SEQ ID NO: 361 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugauugugcuaaugcuuautt

SEQ ID NO: 362 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auaagcauuagcacaaucatt

SEQ ID NO: 363 - DNA, 23 bp, Artificial Sequence
  Marburg virus RNA-dependent RNA polymerase (L-pol) siRNA target region
aatcacccttgtggagttaaaaa

SEQ ID NO: 364 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucacccuuguggaguuaaatt

SEQ ID NO: 365 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuuaacuccacaagggugatt

SEQ ID NO: 366 - DNA, 23 bp, Artificial Sequence
  Marburg virus RNA-dependent RNA polymerase (L-pol) siRNA target region
gagaacgaggctgaattgaatgc

SEQ ID NO: 367 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaacgaggcugaauugaautt

SEQ ID NO: 368 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auucaauucagccucguuctt

SEQ ID NO: 369 - DNA, 23 bp, Artificial Sequence
  Marburg virus RNA-dependent RNA polymerase (L-pol) siRNA target region
gaggaaacatttgtccattcagg

SEQ ID NO: 370 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggaaacauuuguccauucatt

SEQ ID NO: 371 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ugaauggacaaauguuucctt

SEQ ID NO: 372 - DNA, 23 bp, Artificial Sequence
  Marburg virus RNA-dependent RNA polymerase (L-pol) siRNA target region
ttcgatgatcttcaaggttctct

SEQ ID NO: 373 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cgaugaucuucaagguucutt

SEQ ID NO: 374 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
agaaccuugaagaucaucgtt

SEQ ID NO: 375 - DNA, 23 bp, Artificial Sequence
  Marburg virus RNA-dependent RNA polymerase (L-pol) siRNA target region
ggatagcttcattccattcaatg

SEQ ID NO: 376 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
auagcuucauuccauucaatt

SEQ ID NO: 377 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uugaauggaaugaagcuautt

SEQ ID NO: 378 - DNA, 23 bp, Artificial Sequence
  Marburg virus RNA-dependent RNA polymerase (L-pol) siRNA target region
cttcaggtctatttcaactcaag

SEQ ID NO: 379 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucaggucuauuucaacucatt

SEQ ID NO: 380 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ugaguugaaauagaccugatt

SEQ ID NO: 381 - DNA, 23 bp, Artificial Sequence
  Marburg virus RNA-dependent RNA polymerase (L-pol) siRNA target region
caagaatgcattggaatttcttg

SEQ ID NO: 382 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agaaugcauuggaauuucutt

SEQ ID NO: 383 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
agaaauuccaaugcauucutt

SEQ ID NO: 384 - DNA, 23 bp, Artificial Sequence
  Marburg virus RNA-dependent RNA polymerase (L-pol) siRNA target region
atgcattggaatttcttgaaaag

SEQ ID NO: 385 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcauuggaauuucuugaaatt

SEQ ID NO: 386 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuucaagaaauuccaaugctt

SEQ ID NO: 387 - DNA, 23 bp, Artificial Sequence
  Marburg virus RNA-dependent RNA polymerase (L-pol) siRNA target region
atgtaccaagatcaaaggaaata

SEQ ID NO: 388 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guaccaagaucaaaggaaatt

SEQ ID NO: 389 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuuccuuugaucuugguactt

SEQ ID NO: 390 - DNA, 23 bp, Artificial Sequence
  Marburg virus RNA-dependent RNA polymerase (L-pol) siRNA target region
ttccacataggttctgatttaga

SEQ ID NO: 391 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccacauagguucugauuuatt

SEQ ID NO: 392 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaaaucagaaccuauguggtt

SEQ ID NO: 393 - DNA, 23 bp, Artificial Sequence
  Marburg virus RNA-dependent RNA polymerase (L-pol) siRNA target region
aaggaacaatgttgatgaaatta

SEQ ID NO: 394 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggaacaauguugaugaaautt

SEQ ID NO: 395 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auuucaucaacauuguucctt

SEQ ID NO: 396 - DNA, 23 bp, Artificial Sequence
  Marburg virus RNA-dependent RNA polymerase (L-pol) siRNA target region
gtccagaaacatccctctgttaa

SEQ ID NO: 397 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccagaaacaucccucuguutt

SEQ ID NO: 398 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacagagggauguuucuggtt

SEQ ID NO: 399 - DNA, 23 bp, Artificial Sequence
  Marburg virus RNA-dependent RNA polymerase (L-pol) siRNA target region
aggcaacatagttcatagatata

SEQ ID NO: 400 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcaacauaguucauagauatt

SEQ ID NO: 401 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaucuaugaacuauguugctt

SEQ ID NO: 402 - DNA, 23 bp, Artificial Sequence
  Marburg virus RNA-dependent RNA polymerase (L-pol) siRNA target region
aatgatcaatatggacaacattc

SEQ ID NO: 403 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaucaauauggacaacautt

SEQ ID NO: 404 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auguuguccauauugaucatt

SEQ ID NO: 405 - DNA, 23 bp, Artificial Sequence
  Marburg virus RNA-dependent RNA polymerase (L-pol) siRNA target region
ggtcaagctgctattgatagtaa

SEQ ID NO: 406 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucaagcugcuauugauagutt

SEQ ID NO: 407 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acuaucaauagcagcuugatt

SEQ ID NO: 408 - DNA, 23 bp, Artificial Sequence
  Marburg virus RNA-dependent RNA polymerase (L-pol) siRNA target region
gaacaagtatatggacaatgagt

SEQ ID NO: 409 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acaaguauauggacaaugatt

SEQ ID NO: 410 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ucauuguccauauacuugutt

SEQ ID NO: 411 - DNA, 23 bp, Artificial Sequence
  Marburg virus RNA-dependent RNA polymerase (L-pol) siRNA target region
aatgagttggtttatgacaatga

SEQ ID NO: 412 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaguugguuuaugacaautt

SEQ ID NO: 413 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auugucauaaaccaacucatt

SEQ ID NO: 414 - DNA, 23 bp, Artificial Sequence
  Marburg virus RNA-dependent RNA polymerase (L-pol) siRNA target region
caacactctcattgagtttgaat

SEQ ID NO: 415 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acacucucauugaguuugatt

SEQ ID NO: 416 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
ucaaacucaaugagagugutt

SEQ ID NO: 417 - DNA, 23 bp, Artificial Sequence
  Marburg virus RNA-dependent RNA polymerase (L-pol) siRNA target region
tctgatgaatcttctcaaagtac

SEQ ID NO: 418 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaugaaucuucucaaagutt

SEQ ID NO: 419 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acuuugagaagauucaucatt

SEQ ID NO: 420 - DNA, 23 bp, Artificial Sequence
  Marburg virus RNA-dependent RNA polymerase (L-pol) siRNA target region
aaaaactttcgtcacacatttcc

SEQ ID NO: 421 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
aaacuuucgucacacauuutt

SEQ ID NO: 422 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaaugugugacgaaaguuutt

SEQ ID NO: 423 - DNA, 23 bp, Artificial Sequence
  Marburg virus RNA-dependent RNA polymerase (L-pol) siRNA target region
cgtcacacatttccttgtgtatc

SEQ ID NO: 424 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucacacauuuccuuguguatt

SEQ ID NO: 425 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uacacaaggaaaugugugatt

SEQ ID NO: 426 - DNA, 23 bp, Artificial Sequence
  Marburg virus RNA-dependent RNA polymerase (L-pol) siRNA target region
aattaagaacctctcagatttga

SEQ ID NO: 427 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
uuaagaaccucucagauuutt

SEQ ID NO: 428 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaaucugagagguucuuaatt

SEQ ID NO: 429 - DNA, 23 bp, Artificial Sequence
  Marburg virus RNA-dependent RNA polymerase (L-pol) siRNA target region
gctcacccgactagcccaccaca

SEQ ID NO: 430 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucacccgacuagcccaccatt

SEQ ID NO: 431 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uggugggcuagucgggugatt

SEQ ID NO: 432 - DNA, 23 bp, Artificial Sequence
  Marburg virus RNA-dependent RNA polymerase (L-pol) siRNA target region
ggagagaagagttcatcagatgc

SEQ ID NO: 433 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agagaagaguucaucagautt

SEQ ID NO: 434 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aucugaugaacucuucucutt

SEQ ID NO: 435 - DNA, 23 bp, Artificial Sequence
  Marburg virus RNA-dependent RNA polymerase (L-pol) siRNA target region
ttacagcaagttatcagaatttt

SEQ ID NO: 436 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acagcaaguuaucagaauutt

SEQ ID NO: 437 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauucugauaacuugcugutt

SEQ ID NO: 438 - DNA, 23 bp, Artificial Sequence
  Marburg virus RNA-dependent RNA polymerase (L-pol) siRNA target region
tttcagttgtctgatgaagaagg

SEQ ID NO: 439 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucaguugucugaugaagaatt

SEQ ID NO: 440 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uucuucaucagacaacugatt

SEQ ID NO: 441 - DNA, 23 bp, Artificial Sequence
  Marburg virus RNA-dependent RNA polymerase (L-pol) siRNA target region
cgctaccggtttggctttacttt

SEQ ID NO: 442 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cuaccgguuuggcuuuacutt

SEQ ID NO: 443 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aguaaagccaaaccgguagtt

SEQ ID NO: 444 - DNA, 23 bp, Artificial Sequence
  Marburg virus RNA-dependent RNA polymerase (L-pol) siRNA target region
gctgacacctgttgtccaattgg

SEQ ID NO: 445 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugacaccuguuguccaauutt

SEQ ID NO: 446 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauuggacaacaggugucatt

SEQ ID NO: 447 - DNA, 23 bp, Artificial Sequence
  Marburg virus RNA-dependent RNA polymerase (L-pol) siRNA target region
agagacaaagctaataaggttaa

SEQ ID NO: 448 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agacaaagcuaauaagguutt

SEQ ID NO: 449 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaccuuauuagcuuugucutt

SEQ ID NO: 450 - DNA, 23 bp, Artificial Sequence
  Marburg virus RNA-dependent RNA polymerase (L-pol) siRNA target region
taccagttcagtctcctctaatc

SEQ ID NO: 451 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccaguucagucuccucuaatt

SEQ ID NO: 452 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuagaggagacugaacuggtt

SEQ ID NO: 453 - DNA, 23 bp, Artificial Sequence
  Marburg virus RNA-dependent RNA polymerase (L-pol) siRNA target region
gggcatcagattcaaggacaatc

SEQ ID NO: 454 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcaucagauucaaggacaatt

SEQ ID NO: 455 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuguccuugaaucugaugctt

SEQ ID NO: 456 - DNA, 23 bp, Artificial Sequence
  Marburg virus RNA-dependent RNA polymerase (L-pol) siRNA target region
agggaggaatcttcaccgcaaca

SEQ ID NO: 457 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggaggaaucuucaccgcaatt

SEQ ID NO: 458 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uugcggugaagauuccucctt

SEQ ID NO: 459 - DNA, 23 bp, Artificial Sequence
  Marburg virus RNA-dependent RNA polymerase (L-pol) siRNA target region
acggagtatactcttaatacaaa

SEQ ID NO: 460 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggaguauacucuuaauacatt

SEQ ID NO: 461 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uguauuaagaguauacucctt

SEQ ID NO: 462 - DNA, 23 bp, Artificial Sequence
  Marburg virus RNA-dependent RNA polymerase (L-pol) siRNA target region
gagaacaagcttcatatttgtac

SEQ ID NO: 463 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaacaagcuucauauuugutt

SEQ ID NO: 464 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acaaauaugaagcuuguuctt

SEQ ID NO: 465 - DNA, 23 bp, Artificial Sequence
  Marburg virus RNA-dependent RNA polymerase (L-pol) siRNA target region
ttgtacgttgattgcagtaatat

SEQ ID NO: 466 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guacguugauugcaguaautt

SEQ ID NO: 467 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auuacugcaaucaacguactt

SEQ ID NO: 468 - DNA, 23 bp, Artificial Sequence
  Marburg virus RNA-dependent RNA polymerase (L-pol) siRNA target region
ttgcagtaatattccttctatct

SEQ ID NO: 469 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcaguaauauuccuucuautt

SEQ ID NO: 470 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auagaaggaauauuacugctt

SEQ ID NO: 471 - DNA, 23 bp, Artificial Sequence
  Marburg virus RNA-dependent RNA polymerase (L-pol) siRNA target region
tctgatcagaatcaagttcaaat

SEQ ID NO: 472 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaucagaaucaaguucaatt

SEQ ID NO: 473 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uugaacuugauucugaucatt

SEQ ID NO: 474 - DNA, 23 bp, Artificial Sequence
  Marburg virus RNA-dependent RNA polymerase (L-pol) siRNA target region
acctacaaacgtgatttacatgc

SEQ ID NO: 475 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cuacaaacgugauuuacautt

SEQ ID NO: 476 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auguaaaucacguuuguagtt

SEQ ID NO: 477 - DNA, 23 bp, Artificial Sequence
  Marburg virus RNA-dependent RNA polymerase (L-pol) siRNA target region
gggtagtctcatcaatgcattac

SEQ ID NO: 478 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guagucucaucaaugcauutt

SEQ ID NO: 479 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaugcauugaugagacuactt

SEQ ID NO: 480 - DNA, 23 bp, Artificial Sequence
  Marburg virus RNA-dependent RNA polymerase (L-pol) siRNA target region
accgagaatgttgtataacatag

SEQ ID NO: 481 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cgagaauguuguauaacautt

SEQ ID NO: 482 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auguuauacaacauucucgtt

SEQ ID NO: 483 - DNA, 23 bp, Artificial Sequence
  Marburg virus RNA-dependent RNA polymerase (L-pol) siRNA target region
atcaaggagactaatattgaaca

SEQ ID NO: 484 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
caaggagacuaauauugaatt

SEQ ID NO: 485 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uucaauauuagucuccuugtt

SEQ ID NO: 486 - DNA, 23 bp, Artificial Sequence
  Marburg virus RNA-dependent RNA polymerase (L-pol) siRNA target region
aaggagactaatattgaacaacc

SEQ ID NO: 487 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggagacuaauauugaacaatt

SEQ ID NO: 488 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuguucaauauuagucucctt

SEQ ID NO: 489 - DNA, 23 bp, Artificial Sequence
  Marburg virus RNA-dependent RNA polymerase (L-pol) siRNA target region
aacaacctaactatccaaattac

SEQ ID NO: 490 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
caaccuaacuauccaaauutt

SEQ ID NO: 491 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauuuggauaguuagguugtt

SEQ ID NO: 492 - DNA, 23 bp, Artificial Sequence
  Marburg virus RNA-dependent RNA polymerase (L-pol) siRNA target region
cctgaagatagtgacattcttac

SEQ ID NO: 493 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaagauagugacauucuutt

SEQ ID NO: 494 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aagaaugucacuaucuucatt

SEQ ID NO: 495 - DNA, 23 bp, Artificial Sequence
  Marburg virus RNA-dependent RNA polymerase (L-pol) siRNA target region
ggacacgtacttctcctaatatc

SEQ ID NO: 496 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acacguacuucuccuaauatt

SEQ ID NO: 497 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uauuaggagaaguacgugutt

SEQ ID NO: 498 - DNA, 23 bp, Artificial Sequence
  Marburg virus RNA-dependent RNA polymerase (L-pol) siRNA target region
aattagcatcatcaaggtatttt

SEQ ID NO: 499 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
uuagcaucaucaagguauutt

SEQ ID NO: 500 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauaccuugaugaugcuaatt

SEQ ID NO: 501 - DNA, 23 bp, Artificial Sequence
  Marburg virus RNA-dependent RNA polymerase (L-pol) siRNA target region
tatgaagggactttattcttaat

SEQ ID NO: 502 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaagggacuuuauucuuatt

SEQ ID NO: 503 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaagaauaaagucccuucatt

SEQ ID NO: 504 - DNA, 23 bp, Artificial Sequence
  Marburg virus RNA-dependent RNA polymerase (L-pol) siRNA target region
atgaagggactttattcttaatg

SEQ ID NO: 505 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaagggacuuuauucuuaatt

SEQ ID NO: 506 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuaagaauaaagucccuuctt

SEQ ID NO: 507 - DNA, 23 bp, Artificial Sequence
  Marburg virus RNA-dependent RNA polymerase (L-pol) siRNA target region
atgaagaatgctattcagtatta

SEQ ID NO: 508 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaagaaugcuauucaguautt

SEQ ID NO: 509 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auacugaauagcauucuuctt

SEQ ID NO: 510 - DNA, 23 bp, Artificial Sequence
  Marburg virus RNA-dependent RNA polymerase (L-pol) siRNA target region
aagaaaccatatagctcaaatgc

SEQ ID NO: 511 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaaaccauauagcucaaautt

SEQ ID NO: 512 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auuugagcuauaugguuuctt

SEQ ID NO: 513 - DNA, 23 bp, Artificial Sequence
  Marburg virus RNA-dependent RNA polymerase (L-pol) siRNA target region
actcagaatggtacttgtgttgc

SEQ ID NO: 514 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucagaaugguacuuguguutt

SEQ ID NO: 515 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacacaaguaccauucugatt

SEQ ID NO: 516 - DNA, 23 bp, Artificial Sequence
  Marburg virus RNA-dependent RNA polymerase (L-pol) siRNA target region
tggtacttgtgttgcggtaaacg

SEQ ID NO: 517 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guacuuguguugcgguaaatt

SEQ ID NO: 518 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuuaccgcaacacaaguactt

SEQ ID NO: 519 - DNA, 23 bp, Artificial Sequence
  Marburg virus RNA-dependent RNA polymerase (L-pol) siRNA target region
aagcaattccttactggttaaaa

SEQ ID NO: 520 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcaauuccuuacugguuaatt

SEQ ID NO: 521 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uuaaccaguaaggaauugctt

SEQ ID NO: 522 - DNA, 23 bp, Artificial Sequence
  Marburg virus RNA-dependent RNA polymerase (L-pol) siRNA target region
aagaattatcctgcttcattaca

SEQ ID NO: 523 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gaauuauccugcuucauuatt

SEQ ID NO: 524 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uaaugaagcaggauaauuctt

SEQ ID NO: 525 - DNA, 23 bp, Artificial Sequence
  Marburg virus RNA-dependent RNA polymerase (L-pol) siRNA target region
agtcatctttctgccatcgttat

SEQ ID NO: 526 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ucaucuuucugccaucguutt

SEQ ID NO: 527 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacgauggcagaaagaugatt

SEQ ID NO: 528 - DNA, 23 bp, Artificial Sequence
  Marburg virus RNA-dependent RNA polymerase (L-pol) siRNA target region
tgccatcgttatactattccatt

SEQ ID NO: 529 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccaucguuauacuauuccatt

SEQ ID NO: 530 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uggaauaguauaacgauggtt

SEQ ID NO: 531 - DNA, 23 bp, Artificial Sequence
  Marburg virus RNA-dependent RNA polymerase (L-pol) siRNA target region
gtccagtcttatgttcgtcaagg

SEQ ID NO: 532 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccagucuuauguucgucaatt

SEQ ID NO: 533 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uugacgaacauaagacuggtt

SEQ ID NO: 534 - DNA, 23 bp, Artificial Sequence
  Marburg virus RNA-dependent RNA polymerase (L-pol) siRNA target region
gtgcacgtggatcatgagtgttc

SEQ ID NO: 535 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcacguggaucaugagugutt

SEQ ID NO: 536 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acacucaugauccacgugctt

SEQ ID NO: 537 - DNA, 23 bp, Artificial Sequence
  Marburg virus RNA-dependent RNA polymerase (L-pol) siRNA target region
cttgagctttatccctaatatgg

SEQ ID NO: 538 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugagcuuuaucccuaauautt

SEQ ID NO: 539 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auauuagggauaaagcucatt

SEQ ID NO: 540 - DNA, 23 bp, Artificial Sequence
  Marburg virus RNA-dependent RNA polymerase (L-pol) siRNA target region
aaatactgagatacactagttga

SEQ ID NO: 541 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
auacugagauacacuaguutt

SEQ ID NO: 542 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacuaguguaucucaguautt

SEQ ID NO: 543 - DNA, 23 bp, Artificial Sequence
  Ebola virus membrane-associated protein VP24 siRNA target region
cccaagaggcattcttcatctcc

SEQ ID NO: 544 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
caagaggcauucuucaucutt

SEQ ID NO: 545 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
agaugaagaaugccucuugtt

SEQ ID NO: 546 - DNA, 23 bp, Artificial Sequence
  Ebola virus membrane-associated protein VP24 siRNA target region
tttcagggtagtccaattagtgg

SEQ ID NO: 547 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ucaggguaguccaauuagutt

SEQ ID NO: 548 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
acuaauuggacuacccugatt

SEQ ID NO: 549 - DNA, 23 bp, Artificial Sequence
  Ebola virus membrane-associated protein VP24 siRNA target region
tttgagcgccctcacaattaaaa

SEQ ID NO: 550 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ugagcgcccucacaauuaatt

SEQ ID NO: 551 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uuaauugugagggcgcucatt

SEQ ID NO: 552 - DNA, 23 bp, Artificial Sequence
  Ebola virus membrane-associated protein VP24 siRNA target region
taggaacgtcgttccaacaatcg

SEQ ID NO: 553 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ggaacgucguuccaacaautt

SEQ ID NO: 554 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
auuguuggaacgacguucctt

SEQ ID NO: 555 - DNA, 23 bp, Artificial Sequence
  Ebola virus membrane-associated protein VP24 siRNA target region
agcgacctctgtaacttcttagt

SEQ ID NO: 556 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cgaccucuguaacuucuuatt

SEQ ID NO: 557 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uaagaaguuacagaggucgtt

SEQ ID NO: 558 - DNA, 23 bp, Artificial Sequence
  Ebola virus membrane-associated protein VP24 siRNA target region
tcacaaaggaatggccctattgc

SEQ ID NO: 559 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
acaaaggaauggcccuauutt

SEQ ID NO: 560 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aauagggccauuccuuugutt

SEQ ID NO: 561 - DNA, 23 bp, Artificial Sequence
  Ebola virus membrane-associated protein VP24 siRNA target region
aaggaatctctttcctcatttat

SEQ ID NO: 562 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ggaaucucuuuccucauuutt

SEQ ID NO: 563 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaaugaggaaagagauucctt

SEQ ID NO: 564 - DNA, 23 bp, Artificial Sequence
  Ebola virus membrane-associated protein VP24 siRNA target region
aggaatctctttcctcatttatt

SEQ ID NO: 565 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
gaaucucuuuccucauuuatt

SEQ ID NO: 566 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uaaaugaggaaagagauuctt

SEQ ID NO: 567 - DNA, 23 bp, Artificial Sequence
  Ebola virus membrane-associated protein VP24 siRNA target region
caaaatccgaattccacaattga

SEQ ID NO: 568 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
aaauccgaauuccacaauutt

SEQ ID NO: 569 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aauuguggaauucggauuutt

SEQ ID NO: 570 - DNA, 23 bp, Artificial Sequence
  Ebola virus membrane-associated protein VP24 siRNA target region
gaccagctgattgaccagtcttt

SEQ ID NO: 571 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ccagcugauugaccagucutt

SEQ ID NO: 572 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
agacuggucaaucagcuggtt

SEQ ID NO: 573 - DNA, 23 bp, Artificial Sequence
  Ebola virus membrane-associated protein VP24 siRNA target region
cacaaggatcctcgacacgaatg

SEQ ID NO: 574 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
caaggauccucgacacgaatt

SEQ ID NO: 575 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uucgugucgaggauccuugtt

SEQ ID NO: 576 - DNA, 23 bp, Artificial Sequence
  Ebola virus membrane-associated protein VP24 siRNA target region
ctcgacacgaatgcaaagtttga

SEQ ID NO: 577 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cgacacgaaugcaaaguuutt

SEQ ID NO: 578 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaacuuugcauucgugucgtt

SEQ ID NO: 579 - DNA, 23 bp, Artificial Sequence
  Ebola virus membrane-associated protein VP24 siRNA target region
taatagctctcttgctatctaac

SEQ ID NO: 580 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
auagcucucuugcuaucuatt

SEQ ID NO: 581 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uagauagcaagagagcuautt

SEQ ID NO: 582 - DNA, 23 bp, Artificial Sequence
  Ebola virus membrane-associated protein VP24 siRNA target region
cttgacatctctgctttcataat

SEQ ID NO: 583 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ugacaucucugcuuucauatt

SEQ ID NO: 584 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uaugaaagcagagaugucatt

SEQ ID NO: 585 - DNA, 23 bp, Artificial Sequence
  Ebola virus membrane-associated protein VP24 siRNA target region
ccacagataaatcctcactgtaa

SEQ ID NO: 586 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
acagauaaauccucacugutt

SEQ ID NO: 587 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
acagugaggauuuaucugutt

SEQ ID NO: 588 - DNA, 23 bp, Artificial Sequence
  Ebola virus membrane-associated protein VP24 siRNA target region
tactaactctatactcgtaatta

SEQ ID NO: 589 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cuaacucuauacucguaautt

SEQ ID NO: 590 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
auuacgaguauagaguuagtt

SEQ ID NO: 591 - DNA, 23 bp, Artificial Sequence
  Marburg virus membrane-associated protein VP24 siRNA target region
aaggatgttcttattctttgact

SEQ ID NO: 592 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ggauguucuuauucuuugatt

SEQ ID NO: 593 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ucaaagaauaagaacaucctt

SEQ ID NO: 594 - DNA, 23 bp, Artificial Sequence
  Marburg virus membrane-associated protein VP24 siRNA target region
ctaaacctgcatattctttgttg

SEQ ID NO: 595 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
aaaccugcauauucuuugutt

SEQ ID NO: 596 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
acaaagaauaugcagguuutt

SEQ ID NO: 597 - DNA, 23 bp, Artificial Sequence
  Marburg virus membrane-associated protein VP24 siRNA target region
ttttagtagcgtggcctttcagt

SEQ ID NO: 598 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
uuaguagcguggccuuucatt

SEQ ID NO: 599 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ugaaaggccacgcuacuaatt

SEQ ID NO: 600 - DNA, 23 bp, Artificial Sequence
  Marburg virus membrane-associated protein VP24 siRNA target region
tttcagtacagtctaggtgattg

SEQ ID NO: 601 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ucaguacagucuaggugautt

SEQ ID NO: 602 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aucaccuagacuguacugatt

SEQ ID NO: 603 - DNA, 23 bp, Artificial Sequence
  Marburg virus membrane-associated protein VP24 siRNA target region
gtctaggtgattgttgaaagact

SEQ ID NO: 604 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
cuaggugauuguugaaagatt

SEQ ID NO: 605 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ucuuucaacaaucaccuagtt

SEQ ID NO: 606 - DNA, 23 bp, Artificial Sequence
  Marburg virus membrane-associated protein VP24 siRNA target region
tggcagaattatcaacgcgttac

SEQ ID NO: 607 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gcagaauuaucaacgcguutt

SEQ ID NO: 608 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aacgcguugauaauucugctt

SEQ ID NO: 609 - DNA, 23 bp, Artificial Sequence
  Marburg virus membrane-associated protein VP24 siRNA target region
tacaacttgcctgcaaatgttac

SEQ ID NO: 610 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
caacuugccugcaaauguutt

SEQ ID NO: 611 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aacauuugcaggcaaguugtt

SEQ ID NO: 612 - DNA, 23 bp, Artificial Sequence
  Marburg virus membrane-associated protein VP24 siRNA target region
cttgaccttaattccacagcacg

SEQ ID NO: 613 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ugaccuuaauuccacagcatt

SEQ ID NO: 614 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ugcuguggaauuaaggucatt

SEQ ID NO: 615 - DNA, 23 bp, Artificial Sequence
  Marburg virus membrane-associated protein VP24 siRNA target region
aaatactggaatgacattgttgc

SEQ ID NO: 616 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
auacuggaaugacauuguutt

SEQ ID NO: 617 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aacaaugucauuccaguautt

SEQ ID NO: 618 - DNA, 23 bp, Artificial Sequence
  Marburg virus membrane-associated protein VP24 siRNA target region
aatgacattgttgcatcatttaa

SEQ ID NO: 619 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ugacauuguugcaucauuutt

SEQ ID NO: 620 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aaaugaugcaacaaugucatt

SEQ ID NO: 621 - DNA, 23 bp, Artificial Sequence
  Marburg virus membrane-associated protein VP24 siRNA target region
acccagcagtattgaaataaagt

SEQ ID NO: 622 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ccagcaguauugaaauaaatt

SEQ ID NO: 623 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uuuauuucaauacugcuggtt

SEQ ID NO: 624 - DNA, 23 bp, Artificial Sequence
  Marburg virus membrane-associated protein VP24 siRNA target region
agtcaggaggattgatattgaac

SEQ ID NO: 625 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ucaggaggauugauauugatt

SEQ ID NO: 626 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ucaauaucaauccuccugatt

SEQ ID NO: 627 - DNA, 23 bp, Artificial Sequence
  Marburg virus membrane-associated protein VP24 siRNA target region
gctgaggcagttctaagagaaca

SEQ ID NO: 628 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ugaggcaguucuaagagaatt

SEQ ID NO: 629 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uucucuuagaacugccucatt

SEQ ID NO: 630 - DNA, 23 bp, Artificial Sequence
  Marburg virus membrane-associated protein VP24 siRNA target region
agggatatacctaacctgattta

SEQ ID NO: 631 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ggauauaccuaaccugauutt

SEQ ID NO: 632 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aaucagguuagguauaucctt

SEQ ID NO: 633 - DNA, 23 bp, Artificial Sequence
  Marburg virus membrane-associated protein VP24 siRNA target region
tagtagcatcatcttattgaata

SEQ ID NO: 634 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
guagcaucaucuuauugaatt

SEQ ID NO: 635 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uucaauaagaugaugcuactt

SEQ ID NO: 636 - DNA, 23 bp, Artificial Sequence
  Marburg virus membrane-associated protein VP24 siRNA target region
atacaataggctgttcctataat

SEQ ID NO: 637 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
acaauaggcuguuccuauatt

SEQ ID NO: 638 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uauaggaacagccuauugutt

SEQ ID NO: 639 - DNA, 23 bp, Artificial Sequence
  Ebola virus polymerase complex protein VP35 siRNA target region
cttcatcatccttacgtcaattg

SEQ ID NO: 640 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ucaucauccuuacgucaautt

SEQ ID NO: 641 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auugacguaaggaugaugatt

SEQ ID NO: 642 - DNA, 23 bp, Artificial Sequence
  Ebola virus polymerase complex protein VP35 siRNA target region
ctcgaagcttattgtcttcaatg

SEQ ID NO: 643 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cgaagcuuauugucuucaatt

SEQ ID NO: 644 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uugaagacaauaagcuucgtt

SEQ ID NO: 645 - DNA, 23 bp, Artificial Sequence
  Ebola virus polymerase complex protein VP35 siRNA target region
tcgaagcttattgtcttcaatgt

SEQ ID NO: 646 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gaagcuuauugucuucaautt

SEQ ID NO: 647 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auugaagacaauaagcuuctt

SEQ ID NO: 648 - DNA, 23 bp, Artificial Sequence
  Ebola virus polymerase complex protein VP35 siRNA target region
attgagaacaatccaggattatg

SEQ ID NO: 649 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ugagaacaauccaggauuatt

SEQ ID NO: 650 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uaauccuggauuguucucatt

SEQ ID NO: 651 - DNA, 23 bp, Artificial Sequence
  Ebola virus polymerase complex protein VP35 siRNA target region
atccaggattatgctacgcatcc

SEQ ID NO: 652 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ccaggauuaugcuacgcautt

SEQ ID NO: 653 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
augcguagcauaauccuggtt

SEQ ID NO: 654 - DNA, 23 bp, Artificial Sequence
  Ebola virus polymerase complex protein VP35 siRNA target region
acggacccaatttgcaatcatag

SEQ ID NO: 655 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ggacccaauuugcaaucautt

SEQ ID NO: 656 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
augauugcaaauugggucctt

SEQ ID NO: 657 - DNA, 23 bp, Artificial Sequence
  Ebola virus polymerase complex protein VP35 siRNA target region
ggctactgttgtgcaacaacaaa

SEQ ID NO: 658 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cuacuguugugcaacaacatt

SEQ ID NO: 659 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uguuguugcacaacaguagtt

SEQ ID NO: 660 - DNA, 23 bp, Artificial Sequence
  Ebola virus polymerase complex protein VP35 siRNA target region
cggcaaaggatttgagaaacatt

SEQ ID NO: 661 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gcaaaggauuugagaaacatt

SEQ ID NO: 662 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uguuucucaaauccuuugctt

SEQ ID NO: 663 - DNA, 23 bp, Artificial Sequence
  Ebola virus polymerase complex protein VP35 siRNA target region
ttggaactgctttccaccaatta

SEQ ID NO: 664 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ggaacugcuuuccaccaautt

SEQ ID NO: 665 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auugguggaaagcaguucctt

SEQ ID NO: 666 - DNA, 23 bp, Artificial Sequence
  Ebola virus polymerase complex protein VP35 siRNA target region
tggaactgctttccaccaattag

SEQ ID NO: 667 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gaacugcuuuccaccaauutt

SEQ ID NO: 668 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
aauugguggaaagcaguuctt

SEQ ID NO: 669 - DNA, 23 bp, Artificial Sequence
  Ebola virus polymerase complex protein VP35 siRNA target region
tagcaactcattggacatcattc

SEQ ID NO: 670 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gcaacucauuggacaucautt

SEQ ID NO: 671 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
augauguccaaugaguugctt

SEQ ID NO: 672 - DNA, 23 bp, Artificial Sequence
  Ebola virus polymerase complex protein VP35 siRNA target region
ctgaaggagactctcctcaatgt

SEQ ID NO: 673 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gaaggagacucuccucaautt

SEQ ID NO: 674 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auugaggagagucuccuuctt

SEQ ID NO: 675 - DNA, 23 bp, Artificial Sequence
  Ebola virus polymerase complex protein VP35 siRNA target region
agctatatctctgacagtattat

SEQ ID NO: 676 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cuauaucucugacaguauutt

SEQ ID NO: 677 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
aauacugucagagauauagtt

SEQ ID NO: 678 - DNA, 23 bp, Artificial Sequence
  Marburg virus polymerase complex protein VP35 siRNA target region
gatcaagtgtttggtgccaatcc

SEQ ID NO: 679 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ucaaguguuuggugccaautt

SEQ ID NO: 680 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auuggcaccaaacacuugatt

SEQ ID NO: 681 - DNA, 23 bp, Artificial Sequence
  Marburg virus polymerase complex protein VP35 siRNA target region
tgccaatcccttagagaagttat

SEQ ID NO: 682 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ccaaucccuuagagaaguutt

SEQ ID NO: 683 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aacuucucuaagggauuggtt

SEQ ID NO: 684 - DNA, 23 bp, Artificial Sequence
  Marburg virus polymerase complex protein VP35 siRNA target region
ttggactacaatgtagcccttgt

SEQ ID NO: 685 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ggacuacaauguagcccuutt

SEQ ID NO: 686 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aagggcuacauuguagucctt

SEQ ID NO: 687 - DNA, 23 bp, Artificial Sequence
  Marburg virus polymerase complex protein VP35 siRNA target region
gaagagaacactagctgatctac

SEQ ID NO: 688 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
agagaacacuagcugaucutt

SEQ ID NO: 689 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
agaucagcuaguguucucutt

SEQ ID NO: 690 - DNA, 23 bp, Artificial Sequence
  Marburg virus polymerase complex protein VP35 siRNA target region
gctgatctacttataccgataaa

SEQ ID NO: 691 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ugaucuacuuauaccgauatt

SEQ ID NO: 692 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uaucgguauaaguagaucatt

SEQ ID NO: 693 - DNA, 23 bp, Artificial Sequence
  Marburg virus polymerase complex protein VP35 siRNA target region
aacaacaagagtccatgaaattg

SEQ ID NO: 694 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
caacaagaguccaugaaautt

SEQ ID NO: 695 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auuucauggacucuuguugtt

SEQ ID NO: 696 - DNA, 23 bp, Artificial Sequence
  Marburg virus polymerase complex protein VP35 siRNA target region
gggaaggacactggaagcaattt

SEQ ID NO: 697 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gaaggacacuggaagcaautt

SEQ ID NO: 698 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auugcuuccaguguccuuctt

SEQ ID NO: 699 - DNA, 23 bp, Artificial Sequence
  Marburg virus polymerase complex protein VP35 siRNA target region
tacgaccaccttgtaatttcaac

SEQ ID NO: 700 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
cgaccaccuuguaauuucatt

SEQ ID NO: 701 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
ugaaauuacaagguggucgtt

SEQ ID NO: 702 - DNA, 23 bp, Artificial Sequence
  Marburg virus polymerase complex protein VP35 siRNA target region
ttggatgcatttcaccagattct

SEQ ID NO: 703 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ggaugcauuucaccagauutt

SEQ ID NO: 704 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaucuggugaaaugcaucctt

SEQ ID NO: 705 - DNA, 23 bp, Artificial Sequence
  Marburg virus polymerase complex protein VP35 siRNA target region
tttcaccagattctaagtgaagg

SEQ ID NO: 706 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ucaccagauucuaagugaatt

SEQ ID NO: 707 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uucacuuagaaucuggugatt

SEQ ID NO: 708 - DNA, 23 bp, Artificial Sequence
  Marburg virus polymerase complex protein VP35 siRNA target region
aagcagaacatttgacgctttcc

SEQ ID NO: 709 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gcagaacauuugacgcuuutt

SEQ ID NO: 710 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaagcgucaaauguucugctt

SEQ ID NO: 711 - DNA, 23 bp, Artificial Sequence
  Marburg virus polymerase complex protein VP35 siRNA target region
gggaagtgatctttccgagttga

SEQ ID NO: 712 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gaagugaucuuuccgaguutt

SEQ ID NO: 713 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aacucggaaagaucacuuctt

SEQ ID NO: 714 - DNA, 23 bp, Artificial Sequence
  Marburg virus polymerase complex protein VP35 siRNA target region
ctcaagacgcttattcatagtat

SEQ ID NO: 715 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
caagacgcuuauucauagutt

SEQ ID NO: 716 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
acuaugaauaagcgucuugtt

SEQ ID NO: 717 - DNA, 23 bp, Artificial Sequence
  Marburg virus polymerase complex protein VP35 siRNA target region
caagacgcttattcatagtatat

SEQ ID NO: 718 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
agacgcuuauucauaguautt

SEQ ID NO: 719 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auacuaugaauaagcgucutt

SEQ ID NO: 720 - DNA, 23 bp, Artificial Sequence
  Ebola virus membrane-associated protein VP24 siRNA target region
cagctgattgaccagtctttgat

SEQ ID NO: 721 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
gcugauugaccagucuuugtt

SEQ ID NO: 722 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
caaagacuggucaaucagctt

SEQ ID NO: 723 - DNA, 22 bp, Artificial Sequence
  Ebola virus membrane-associated protein VP24 siRNA target region
caacactaaccatttcaacatg

SEQ ID NO: 724 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
acacuaaccauuucaacautt

SEQ ID NO: 725 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
auguugaaaugguuagugutt

SEQ ID NO: 726 - DNA, 23 bp, Artificial Sequence
  Ebola virus membrane-associated protein VP24 siRNA target region
caacggattgttgagcagtattg

SEQ ID NO: 727 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
acggauuguugagcaguautt

SEQ ID NO: 728 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
auacugcucaacaauccgutt

SEQ ID NO: 729 - DNA, 23 bp, Artificial Sequence
  Ebola virus membrane-associated protein VP24 siRNA target region
gatcctcgacacgaatgcaaagt

SEQ ID NO: 730 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
uccucgacacgaaugcaaatt

SEQ ID NO: 731 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uuugcauucgugucgaggatt

SEQ ID NO: 732 - DNA, 23 bp, Artificial Sequence
  Ebola virus membrane-associated protein VP24 siRNA target region
gatgtgactcacaaaggaatggc

SEQ ID NO: 733 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ugugacucacaaaggaaugtt

SEQ ID NO: 734 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
cauuccuuugugagucacatt

SEQ ID NO: 735 - DNA, 23 bp, Artificial Sequence
  Ebola virus membrane-associated protein VP24 siRNA target region
aatggccctattgcatagactga

SEQ ID NO: 736 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
uggcccuauugcauagacutt

SEQ ID NO: 737 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
agucuaugcaauagggccatt

SEQ ID NO: 738 - DNA, 23 bp, Artificial Sequence
  Ebola virus membrane-associated protein VP24 siRNA target region
caaggaatctctttcctcattta

SEQ ID NO: 739 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
aggaaucucuuuccucauutt

SEQ ID NO: 740 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaugaggaaagagauuccutt

SEQ ID NO: 741 - DNA, 23 bp, Artificial Sequence
  Ebola virus membrane-associated protein VP24 siRNA target region
aaggaatctctttcctcatttat

SEQ ID NO: 742 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ggaaucucuuuccucauuutt

SEQ ID NO: 743 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaaugaggaaagagauucctt

SEQ ID NO: 744 - DNA, 23 bp, Artificial Sequence
  Ebola virus membrane-associated protein VP24 siRNA target region
aaatccgaattccacaattgaat

SEQ ID NO: 745 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
auccgaauuccacaauugatt

SEQ ID NO: 746 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
ucaauuguggaauucggautt

SEQ ID NO: 747 - DNA, 23 bp, Artificial Sequence
  Ebola virus membrane-associated protein VP24 siRNA target region
aatccgaattccacaattgaatc

SEQ ID NO: 748 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
uccgaauuccacaauugaatt

SEQ ID NO: 749 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uucaauuguggaauucggatt

SEQ ID NO: 750 - DNA, 23 bp, Artificial Sequence
  Ebola virus membrane-associated protein VP24 siRNA target region
aacaaccaacactaaccatttca

SEQ ID NO: 751 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
caaccaacacuaaccauuutt

SEQ ID NO: 752 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaaugguuaguguugguugtt

SEQ ID NO: 753 - DNA, 23 bp, Artificial Sequence
  Ebola virus membrane-associated protein VP24 siRNA target region
aaccaacactaaccatttcaaca

SEQ ID NO: 754 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ccaacacuaaccauuucaatt

SEQ ID NO: 755 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uugaaaugguuaguguuggtt

SEQ ID NO: 756 - DNA, 23 bp, Artificial Sequence
  Ebola virus membrane-associated protein VP24 siRNA target region
catgcgaacacaacgtgtcaagg

SEQ ID NO: 757 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
ugcgaacacaacgugucaatt

SEQ ID NO: 758 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uugacacguuguguucgcatt

SEQ ID NO: 759 - DNA, 23 bp, Artificial Sequence
  Ebola virus membrane-associated protein VP24 siRNA target region
aacgtgtcaaggaacaattgagc

SEQ ID NO: 760 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cgugucaaggaacaauugatt

SEQ ID NO: 761 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
ucaauuguuccuugacacgtt

SEQ ID NO: 762 - DNA, 23 bp, Artificial Sequence
  Ebola virus membrane-associated protein VP24 siRNA target region
caaggaacaattgagcctaaaaa

SEQ ID NO: 763 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
aggaacaauugagccuaaatt

SEQ ID NO: 764 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
uuuaggcucaauuguuccutt

SEQ ID NO: 765 - DNA, 23 bp, Artificial Sequence
  Ebola virus membrane-associated protein VP24 siRNA target region
aacggattgttgagcagtattga

SEQ ID NO: 766 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cggauuguugagcaguauutt

SEQ ID NO: 767 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aauacugcucaacaauccgtt

SEQ ID NO: 768 - DNA, 23 bp, Artificial Sequence
  Ebola virus membrane-associated protein VP24 siRNA target region
aactcgaactaacatgggttttc

SEQ ID NO: 769 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cucgaacuaacauggguuutt

SEQ ID NO: 770 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaacccauguuaguucgagtt

SEQ ID NO: 771 - DNA, 23 bp, Artificial Sequence
  Ebola virus membrane-associated protein VP24 siRNA target region
gagtccacactgaaagcatttac

SEQ ID NO: 772 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
guccacacugaaagcauuutt

SEQ ID NO: 773 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aaaugcuuucaguguggactt

SEQ ID NO: 774 - DNA, 23 bp, Artificial Sequence
  Ebola virus membrane-associated protein VP24 siRNA target region
gacacgaatgcaaagtttgattc

SEQ ID NO: 775 - DNA, 21 bp, Artificial Sequence
  Ebola virus membrane-associated protein VP24 siRNA sense strand
  Description of Combined DNA/RNA Molecule:Ebola virus membrane-associated protein VP24 siRNA sense strand
cacgaaugcaaaguuugautt

SEQ ID NO: 776 - DNA, 21 bp, Artificial Sequence
  Ebola virus membrane-associated protein VP24 siRNA antisense strand
  Description of Combined DNA/RNA Molecule:Ebola virus membrane-associated protein VP24 siRNA antisense strand
aucaaacuuugcauucgugtt

SEQ ID NO: 777 - DNA, 23 bp, Artificial Sequence
  Ebola virus polymerase complex protein VP35 siRNA target region
aagcgacatcttctgtgatattg

SEQ ID NO: 778 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gcgacaucuucugugauautt

SEQ ID NO: 779 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auaucacagaagaugucgctt

SEQ ID NO: 780 - DNA, 23 bp, Artificial Sequence
  Ebola virus polymerase complex protein VP35 siRNA target region
gaggaggtagtacaaacattggc

SEQ ID NO: 781 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ggagguaguacaaacauugtt

SEQ ID NO: 782 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
caauguuuguacuaccucctt

SEQ ID NO: 783 - DNA, 23 bp, Artificial Sequence
  Ebola virus polymerase complex protein VP35 siRNA target region
tagggaggcattcaacaatctaa

SEQ ID NO: 784 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gggaggcauucaacaaucutt

SEQ ID NO: 785 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
agauuguugaaugccuccctt

SEQ ID NO: 786 - DNA, 23 bp, Artificial Sequence
  Ebola virus polymerase complex protein VP35 siRNA target region
tagcaactcattggacatcattc

SEQ ID NO: 787 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gcaacucauuggacaucautt

SEQ ID NO: 788 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
augauguccaaugaguugctt

SEQ ID NO: 789 - DNA, 23 bp, Artificial Sequence
  Ebola virus polymerase complex protein VP35 siRNA target region
tacgcatcccaaatgcaacaaac

SEQ ID NO: 790 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cgcaucccaaaugcaacaatt

SEQ ID NO: 791 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uuguugcauuugggaugcgtt

SEQ ID NO: 792 - DNA, 23 bp, Artificial Sequence
  Ebola virus polymerase complex protein VP35 siRNA target region
catcccaaatgcaacaaacgaag

SEQ ID NO: 793 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ucccaaaugcaacaaacgatt

SEQ ID NO: 794 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
ucguuuguugcauuugggatt

SEQ ID NO: 795 - DNA, 23 bp, Artificial Sequence
  Ebola virus polymerase complex protein VP35 siRNA target region
aaacccaaacggacccaatttgc

SEQ ID NO: 796 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
acccaaacggacccaauuutt

SEQ ID NO: 797 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
aaauuggguccguuugggutt

SEQ ID NO: 798 - DNA, 23 bp, Artificial Sequence
  Ebola virus polymerase complex protein VP35 siRNA target region
aaacggacccaatttgcaatcat

SEQ ID NO: 799 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
acggacccaauuugcaauctt

SEQ ID NO: 800 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
gauugcaaauuggguccgutt

SEQ ID NO: 801 - DNA, 23 bp, Artificial Sequence
  Ebola virus polymerase complex protein VP35 siRNA target region
aacggacccaatttgcaatcata

SEQ ID NO: 802 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cggacccaauuugcaaucatt

SEQ ID NO: 803 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
ugauugcaaauuggguccgtt

SEQ ID NO: 804 - DNA, 23 bp, Artificial Sequence
  Ebola virus polymerase complex protein VP35 siRNA target region
gacccaatttgcaatcatagttt

SEQ ID NO: 805 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cccaauuugcaaucauagutt

SEQ ID NO: 806 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
acuaugauugcaaauugggtt

SEQ ID NO: 807 - DNA, 23 bp, Artificial Sequence
  Ebola virus polymerase complex protein VP35 siRNA target region
tagtacaaacattggcttcattg

SEQ ID NO: 808 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
guacaaacauuggcuucautt

SEQ ID NO: 809 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
augaagccaauguuuguactt

SEQ ID NO: 810 - DNA, 23 bp, Artificial Sequence
  Ebola virus polymerase complex protein VP35 siRNA target region
catcgcatcagaatcattagaac

SEQ ID NO: 811 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ucgcaucagaaucauuagatt

SEQ ID NO: 812 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
ucuaaugauucugaugcgatt

SEQ ID NO: 813 - DNA, 23 bp, Artificial Sequence
  Ebola virus polymerase complex protein VP35 siRNA target region
caacgcattacgagtcttgagaa

SEQ ID NO: 814 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
acgcauuacgagucuugagtt

SEQ ID NO: 815 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
cucaagacucguaaugcgutt

SEQ ID NO: 816 - DNA, 23 bp, Artificial Sequence
  Ebola virus polymerase complex protein VP35 siRNA target region
gagtcttgagaatggtctaaagc

SEQ ID NO: 817 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
gucuugagaauggucuaaatt

SEQ ID NO: 818 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uuuagaccauucucaagactt

SEQ ID NO: 819 - DNA, 23 bp, Artificial Sequence
  Ebola virus polymerase complex protein VP35 siRNA target region
gaatggtctaaagccagtttatg

SEQ ID NO: 820 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
auggucuaaagccaguuuatt

SEQ ID NO: 821 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uaaacuggcuuuagaccautt

SEQ ID NO: 822 - DNA, 23 bp, Artificial Sequence
  Ebola virus polymerase complex protein VP35 siRNA target region
aatggtctaaagccagtttatga

SEQ ID NO: 823 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
uggucuaaagccaguuuautt

SEQ ID NO: 824 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
auaaacuggcuuuagaccatt

SEQ ID NO: 825 - DNA, 23 bp, Artificial Sequence
  Ebola virus polymerase complex protein VP35 siRNA target region
cacctggaccatcactttatgaa

SEQ ID NO: 826 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ccuggaccaucacuuuaugtt

SEQ ID NO: 827 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
cauaaagugaugguccaggtt

SEQ ID NO: 828 - DNA, 23 bp, Artificial Sequence
  Ebola virus polymerase complex protein VP35 siRNA target region
gaccatcactttatgaagaaagt

SEQ ID NO: 829 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ccaucacuuuaugaagaaatt

SEQ ID NO: 830 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uuucuucauaaagugauggtt

SEQ ID NO: 831 - DNA, 23 bp, Artificial Sequence
  Ebola virus polymerase complex protein VP35 siRNA target region
gaggcattcaacaatctaaacag

SEQ ID NO: 832 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ggcauucaacaaucuaaactt

SEQ ID NO: 833 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
guuuagauuguugaaugcctt

SEQ ID NO: 834 - DNA, 23 bp, Artificial Sequence
  Ebola virus polymerase complex protein VP35 siRNA target region
aaacctgacatttcggcaaagga

SEQ ID NO: 835 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
accugacauuucggcaaagtt

SEQ ID NO: 836 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
cuuugccgaaaugucaggutt

SEQ ID NO: 837 - DNA, 23 bp, Artificial Sequence
  Ebola virus polymerase complex protein VP35 siRNA target region
aaggatttgagaaacattatgta

SEQ ID NO: 838 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ggauuugagaaacauuaugtt

SEQ ID NO: 839 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
cauaauguuucucaaaucctt

SEQ ID NO: 840 - DNA, 23 bp, Artificial Sequence
  Ebola virus polymerase complex protein VP35 siRNA target region
gaactgctttccaccaattagta

SEQ ID NO: 841 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
acugcuuuccaccaauuagtt

SEQ ID NO: 842 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
cuaauugguggaaagcagutt

SEQ ID NO: 843 - DNA, 23 bp, Artificial Sequence
  Ebola virus polymerase complex protein VP35 siRNA target region
aactgctttccaccaattagtac

SEQ ID NO: 844 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
cugcuuuccaccaauuagutt

SEQ ID NO: 845 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
acuaauugguggaaagcagtt

SEQ ID NO: 846 - DNA, 23 bp, Artificial Sequence
  Ebola virus polymerase complex protein VP35 siRNA target region
caatgtgccctaattcaaattac

SEQ ID NO: 847 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
augugcccuaauucaaauutt

SEQ ID NO: 848 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
aauuugaauuagggcacautt

SEQ ID NO: 849 - DNA, 23 bp, Artificial Sequence
  Ebola virus polymerase complex protein VP35 siRNA target region
aatgtgccctaattcaaattaca

SEQ ID NO: 850 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ugugcccuaauucaaauuatt

SEQ ID NO: 851 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
uaauuugaauuagggcacatt

SEQ ID NO: 852 - DNA, 23 bp, Artificial Sequence
  Ebola virus polymerase complex protein VP35 siRNA target region
gatcgaggttgggtatgtgtttt

SEQ ID NO: 853 - DNA, 21 bp, Artificial Sequence
  Ebola virus polymerase complex protein VP35 siRNA sense strand
  Description of Combined DNA/RNA Molecule:Ebola virus polymerase complex protein VP35 siRNA sense strand
ucgagguuggguauguguutt

SEQ ID NO: 854 - DNA, 21 bp, Artificial Sequence
  Ebola virus polymerase complex protein VP35 siRNA antisense strand
  Description of Combined DNA/RNA Molecule:Ebola virus polymerase complex protein VP35 siRNA antisense strand
aacacauacccaaccucgatt

SEQ ID NO: 855 - DNA, 23 bp, Artificial Sequence
  Marburg virus RNA-dependent RNA polymerase (L-pol) siRNA target region
aagagagtgccagagcaattttt

SEQ ID NO: 856 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gagagugccagagcaauuutt

SEQ ID NO: 857 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaauugcucuggcacucuctt

SEQ ID NO: 858 - DNA, 23 bp, Artificial Sequence
  Marburg virus RNA-dependent RNA polymerase (L-pol) siRNA target region
aagtggaagaagacggattattt

SEQ ID NO: 859 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guggaagaagacggauuautt

SEQ ID NO: 860 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
auaauccgucuucuuccactt

SEQ ID NO: 861 - DNA, 23 bp, Artificial Sequence
  Marburg virus RNA-dependent RNA polymerase (L-pol) siRNA target region
aatgaggaatgccattcagtatt

SEQ ID NO: 862 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugaggaaugccauucaguatt

SEQ ID NO: 863 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uacugaauggcauuccucatt

SEQ ID NO: 864 - DNA, 23 bp, Artificial Sequence
  Marburg virus RNA-dependent RNA polymerase (L-pol) siRNA target region
aaggcatatcttaataagatctt

SEQ ID NO: 865 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggcauaucuuaauaagauctt

SEQ ID NO: 866 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
gaucuuauuaagauaugcctt

SEQ ID NO: 867 - DNA, 23 bp, Artificial Sequence
  Marburg virus RNA-dependent RNA polymerase (L-pol) siRNA target region
aaggtcacaatgggaggattttt

SEQ ID NO: 868 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ggucacaaugggaggauuutt

SEQ ID NO: 869 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaauccucccauugugacctt

SEQ ID NO: 870 - DNA, 23 bp, Artificial Sequence
  Marburg virus RNA-dependent RNA polymerase (L-pol) siRNA target region
aagcgtcgctagttatgaatgtt

SEQ ID NO: 871 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gcgucgcuaguuaugaaugtt

SEQ ID NO: 872 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
cauucauaacuagcgacgctt

SEQ ID NO: 873 - DNA, 23 bp, Artificial Sequence
  Marburg virus RNA-dependent RNA polymerase (L-pol) siRNA target region
aaagagagtgccagagcaatttt

SEQ ID NO: 874 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
agagagugccagagcaauutt

SEQ ID NO: 875 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauugcucuggcacucucutt

SEQ ID NO: 876 - DNA, 23 bp, Artificial Sequence
  Marburg virus RNA-dependent RNA polymerase (L-pol) siRNA target region
aaccttgccttccgatatgaatt

SEQ ID NO: 877 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ccuugccuuccgauaugaatt

SEQ ID NO: 878 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uucauaucggaaggcaaggtt

SEQ ID NO: 879 - DNA, 23 bp, Artificial Sequence
  Marburg virus RNA-dependent RNA polymerase (L-pol) siRNA target region
aagttctaggagggttatcattt

SEQ ID NO: 880 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
guucuaggaggguuaucautt

SEQ ID NO: 881 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
augauaacccuccuagaactt

SEQ ID NO: 882 - DNA, 23 bp, Artificial Sequence
  Marburg virus RNA-dependent RNA polymerase (L-pol) siRNA target region
aatgtcactttccgtttgatgtt

SEQ ID NO: 883 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
ugucacuuuccguuugaugtt

SEQ ID NO: 884 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
caucaaacggaaagugacatt

SEQ ID NO: 885 - DNA, 23 bp, Artificial Sequence
  Marburg virus RNA-dependent RNA polymerase (L-pol) siRNA target region
aaactatagtcggaagcattttt

SEQ ID NO: 886 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acuauagucggaagcauuutt

SEQ ID NO: 887 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aaaugcuuccgacuauagutt

SEQ ID NO: 888 - DNA, 23 bp, Artificial Sequence
  Marburg virus RNA-dependent RNA polymerase (L-pol) siRNA target region
aagtgaccaattcgaaatatatt

SEQ ID NO: 889 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
gugaccaauucgaaauauatt

SEQ ID NO: 890 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
uauauuucgaauuggucactt

SEQ ID NO: 891 - DNA, 23 bp, Artificial Sequence
  Marburg virus RNA-dependent RNA polymerase (L-pol) siRNA target region
aacaagcttcatatttgtatgtt

SEQ ID NO: 892 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
caagcuucauauuuguaugtt

SEQ ID NO: 893 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
cauacaaauaugaagcuugtt

SEQ ID NO: 894 - DNA, 23 bp, Artificial Sequence
  Marburg virus RNA-dependent RNA polymerase (L-pol) siRNA target region
aaacgtgatttacatgcttgttt

SEQ ID NO: 895 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
acgugauuuacaugcuugutt

SEQ ID NO: 896 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
acaagcauguaaaucacgutt

SEQ ID NO: 897 - DNA, 23 bp, Artificial Sequence
  Marburg virus RNA-dependent RNA polymerase (L-pol) siRNA target region
aacgtgatttacatgcttgtttt

SEQ ID NO: 898 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
cgugauuuacaugcuuguutt

SEQ ID NO: 899 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aacaagcauguaaaucacgtt

SEQ ID NO: 900 - DNA, 23 bp, Artificial Sequence
  Marburg virus RNA-dependent RNA polymerase (L-pol) siRNA target region
aattagcatcatcaaggtatttt

SEQ ID NO: 901 - DNA, 21 bp, Artificial Sequence
  Marburg virus RNA-dependent RNA polymerase (L-pol) siRNA sense strand
  Description of Combined DNA/RNA Molecule:Marburg virus RNA-dependent RNA polymerase (L-pol) siRNA sense strand
uuagcaucaucaagguauutt

SEQ ID NO: 902 - DNA, 21 bp, Artificial Sequence
  Marburg virus RNA-dependent RNA polymerase (L-pol) siRNA antisense strand
  Description of Combined DNA/RNA Molecule:Marburg virus RNA-dependent RNA polymerase (L-pol) siRNA antisense strand
aauaccuugaugaugcuaatt

SEQ ID NO: 903 - DNA, 23 bp, Artificial Sequence
  Marburg virus membrane-associated protein VP24 siRNA target region
aattcctggatttagatctattg

SEQ ID NO: 904 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
uuccuggauuuagaucuautt

SEQ ID NO: 905 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
auagaucuaaauccaggaatt

SEQ ID NO: 906 - DNA, 23 bp, Artificial Sequence
  Marburg virus membrane-associated protein VP24 siRNA target region
cagatcattatcactcgtgttaa

SEQ ID NO: 907 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gaucauuaucacucguguutt

SEQ ID NO: 908 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aacacgagugauaaugauctt

SEQ ID NO: 909 - DNA, 23 bp, Artificial Sequence
  Marburg virus membrane-associated protein VP24 siRNA target region
gagacagtcctctcagaatcagt

SEQ ID NO: 910 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gacaguccucucagaaucatt

SEQ ID NO: 911 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ugauucugagaggacuguctt

SEQ ID NO: 912 - DNA, 23 bp, Artificial Sequence
  Marburg virus membrane-associated protein VP24 siRNA target region
gatggcattgttgcatcatttaa

SEQ ID NO: 913 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
uggcauuguugcaucauuutt

SEQ ID NO: 914 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA sense strand
aaaugaugcaacaaugccatt

SEQ ID NO: 915 - DNA, 23 bp, Artificial Sequence
  Marburg virus membrane-associated protein VP24 siRNA target region
gagtggcaacaaacaaggaatct

SEQ ID NO: 916 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
guggcaacaaacaaggaautt

SEQ ID NO: 917 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
auuccuuguuuguugccactt

SEQ ID NO: 918 - DNA, 23 bp, Artificial Sequence
  Marburg virus membrane-associated protein VP24 siRNA target region
aaaaacccaaagtcaacaattat

SEQ ID NO: 919 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
aaacccaaagucaacaauutt

SEQ ID NO: 920 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aauuguugacuuuggguuutt

SEQ ID NO: 921 - DNA, 23 bp, Artificial Sequence
  Marburg virus membrane-associated protein VP24 siRNA target region
aaaacccaaagtcaacaattata

SEQ ID NO: 922 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
aacccaaagucaacaauuatt

SEQ ID NO: 923 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uaauuguugacuuuggguutt

SEQ ID NO: 924 - DNA, 23 bp, Artificial Sequence
  Marburg virus membrane-associated protein VP24 siRNA target region
aaacccaaagtcaacaattatag

SEQ ID NO: 925 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
acccaaagucaacaauuautt

SEQ ID NO: 926 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
auaauuguugacuuugggutt

SEQ ID NO: 927 - DNA, 23 bp, Artificial Sequence
  Marburg virus membrane-associated protein VP24 siRNA target region
aacccaaagtcaacaattataga

SEQ ID NO: 928 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
cccaaagucaacaauuauatt

SEQ ID NO: 929 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uauaauuguugacuuugggtt

SEQ ID NO: 930 - DNA, 23 bp, Artificial Sequence
  Marburg virus membrane-associated protein VP24 siRNA target region
tagaaccgttcttggctttgagg

SEQ ID NO: 931 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gaaccguucuuggcuuugatt

SEQ ID NO: 932 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
ucaaagccaagaacgguuctt

SEQ ID NO: 933 - DNA, 23 bp, Artificial Sequence
  Marburg virus membrane-associated protein VP24 siRNA target region
gagttgctttgaaggatcaagaa

SEQ ID NO: 934 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
guugcuuugaaggaucaagtt

SEQ ID NO: 935 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
cuugauccuucaaagcaactt

SEQ ID NO: 936 - DNA, 23 bp, Artificial Sequence
  Marburg virus membrane-associated protein VP24 siRNA target region
aaggatcaagaattacagcaatc

SEQ ID NO: 937 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ggaucaagaauuacagcaatt

SEQ ID NO: 938 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uugcuguaauucuugaucctt

SEQ ID NO: 939 - DNA, 23 bp, Artificial Sequence
  Marburg virus membrane-associated protein VP24 siRNA target region
taacgtcggcaatccatattagc

SEQ ID NO: 940 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
acgucggcaauccauauuatt

SEQ ID NO: 941 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uaauauggauugccgacgutt

SEQ ID NO: 942 - DNA, 23 bp, Artificial Sequence
  Marburg virus membrane-associated protein VP24 siRNA target region
aacgtcggcaatccatattagcc

SEQ ID NO: 943 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
cgucggcaauccauauuagtt

SEQ ID NO: 944 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
cuaauauggauugccgacgtt

SEQ ID NO: 945 - DNA, 23 bp, Artificial Sequence
  Marburg virus membrane-associated protein VP24 siRNA target region
caatctgttgggaatctatttga

SEQ ID NO: 946 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
aucuguugggaaucuauuutt

SEQ ID NO: 947 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aaauagauucccaacagautt

SEQ ID NO: 948 - DNA, 23 bp, Artificial Sequence
  Marburg virus membrane-associated protein VP24 siRNA target region
gacctcagacatgtttaagattc

SEQ ID NO: 949 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ccucagacauguuuaagautt

SEQ ID NO: 950 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aucuuaaacaugucugaggtt

SEQ ID NO: 951 - DNA, 23 bp, Artificial Sequence
  Marburg virus membrane-associated protein VP24 siRNA target region
aagatgttcactcttcatgttgt

SEQ ID NO: 952 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gauguucacucuucauguutt

SEQ ID NO: 953 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
aacaugaagagugaacauctt

SEQ ID NO: 954 - DNA, 23 bp, Artificial Sequence
  Marburg virus membrane-associated protein VP24 siRNA target region
aaaacccagcagtattgaaataa

SEQ ID NO: 955 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
aacccagcaguauugaaautt

SEQ ID NO: 956 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
auuucaauacugcuggguutt

SEQ ID NO: 957 - DNA, 23 bp, Artificial Sequence
  Marburg virus membrane-associated protein VP24 siRNA target region
aaacccagcagtattgaaataaa

SEQ ID NO: 958 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
acccagcaguauugaaauatt

SEQ ID NO: 959 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uauuucaauacugcugggutt

SEQ ID NO: 960 - DNA, 23 bp, Artificial Sequence
  Marburg virus membrane-associated protein VP24 siRNA target region
aacccagcagtattgaaataaag

SEQ ID NO: 961 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
cccagcaguauugaaauaatt

SEQ ID NO: 962 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uuauuucaauacugcugggtt

SEQ ID NO: 963 - DNA, 23 bp, Artificial Sequence
  Marburg virus membrane-associated protein VP24 siRNA target region
taactggacaacagatcattatc

SEQ ID NO: 964 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
acuggacaacagaucauuatt

SEQ ID NO: 965 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
uaaugaucuguuguccagutt

SEQ ID NO: 966 - DNA, 23 bp, Artificial Sequence
  Marburg virus membrane-associated protein VP24 siRNA target region
aactggacaacagatcattatca

SEQ ID NO: 967 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
cuggacaacagaucauuautt

SEQ ID NO: 968 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
auaaugaucuguuguccagtt

SEQ ID NO: 969 - DNA, 23 bp, Artificial Sequence
  Marburg virus membrane-associated protein VP24 siRNA target region
aagtcaggaggattgatattgaa

SEQ ID NO: 970 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
gucaggaggauugauauugtt

SEQ ID NO: 971 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
caauaucaauccuccugactt

SEQ ID NO: 972 - DNA, 23 bp, Artificial Sequence
  Marburg virus membrane-associated protein VP24 siRNA target region
caggaggattgatattgaacctt

SEQ ID NO: 973 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ggaggauugauauugaacctt

SEQ ID NO: 974 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
gguucaauaucaauccucctt

SEQ ID NO: 975 - DNA, 23 bp, Artificial Sequence
  Marburg virus membrane-associated protein VP24 siRNA target region
cagtcctctcagaatcagttgtt

SEQ ID NO: 976 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
guccucucagaaucaguugtt

SEQ ID NO: 977 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
caacugauucugagaggactt

SEQ ID NO: 978 - DNA, 23 bp, Artificial Sequence
  Marburg virus membrane-associated protein VP24 siRNA target region
gaggcagttctaagagaacacag

SEQ ID NO: 979 - DNA, 21 bp, Artificial Sequence
  Marburg virus membrane-associated protein VP24 siRNA sense strand
  Description of Combined DNA/RNA Molecule:Marburg virus membrane-associated protein VP24 siRNA sense strand
ggcaguucuaagagaacactt

SEQ ID NO: 980 - DNA, 21 bp, Artificial Sequence
  Marburg virus membrane-associated protein VP24 siRNA antisense strand
  Description of Combined DNA/RNA Molecule:Marburg virus membrane-associated protein VP24 siRNA antisense strand
guguucucuuagaacugcctt

SEQ ID NO: 981 - DNA, 23 bp, Artificial Sequence
  Marburg virus polymerase complex protein VP35 siRNA target region
cagcccttgtctaatgtcaaagg

SEQ ID NO: 982 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gcccuugucuaaugucaaatt

SEQ ID NO: 983 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uuugacauuagacaagggctt

SEQ ID NO: 984 - DNA, 23 bp, Artificial Sequence
  Marburg virus polymerase complex protein VP35 siRNA target region
aagcactctaaacgaagtaacaa

SEQ ID NO: 985 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gcacucuaaacgaaguaactt

SEQ ID NO: 986 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
guuacuucguuuagagugctt

SEQ ID NO: 987 - DNA, 23 bp, Artificial Sequence
  Marburg virus polymerase complex protein VP35 siRNA target region
tatcctagctcaagtcctttcaa

SEQ ID NO: 988 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
uccuagcucaaguccuuuctt

SEQ ID NO: 989 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
gaaaggacuugagcuaggatt

SEQ ID NO: 990 - DNA, 23 bp, Artificial Sequence
  Marburg virus polymerase complex protein VP35 siRNA target region
caatgcagcccttgtctaatgtc

SEQ ID NO: 991 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
augcagcccuugucuaaugtt

SEQ ID NO: 992 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
cauuagacaagggcugcautt

SEQ ID NO: 993 - DNA, 23 bp, Artificial Sequence
  Marburg virus polymerase complex protein VP35 siRNA target region
gacaagcactgatgatattgttt

SEQ ID NO: 994 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
caagcacugaugauauugutt

SEQ ID NO: 995 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
acaauaucaucagugcuugtt

SEQ ID NO: 996 - DNA, 23 bp, Artificial Sequence
  Marburg virus polymerase complex protein VP35 siRNA target region
caagcactgatgatattgtttgg

SEQ ID NO: 997 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
agcacugaugauauuguuutt

SEQ ID NO: 998 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaacaauaucaucagugcutt

SEQ ID NO: 999 - DNA, 23 bp, Artificial Sequence
  Marburg virus polymerase complex protein VP35 siRNA target region
gaccaactgatcgtgaagaaaac

SEQ ID NO: 1000 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ccaacugaucgugaagaaatt

SEQ ID NO: 1001 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uuucuucacgaucaguuggtt

SEQ ID NO: 1002 - DNA, 23 bp, Artificial Sequence
  Marburg virus polymerase complex protein VP35 siRNA target region
aacactagctgatctacttatac

SEQ ID NO: 1003 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
cacuagcugaucuacuuautt

SEQ ID NO: 1004 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auaaguagaucagcuagugtt

SEQ ID NO: 1005 - DNA, 23 bp, Artificial Sequence
  Marburg virus polymerase complex protein VP35 siRNA target region
cactagctgatctacttataccg

SEQ ID NO: 1006 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
cuagcugaucuacuuauactt

SEQ ID NO: 1007 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
guauaaguagaucagcuagtt

SEQ ID NO: 1008 - DNA, 23 bp, Artificial Sequence
  Marburg virus polymerase complex protein VP35 siRNA target region
tataccgataaataggcagatat

SEQ ID NO: 1009 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
uaccgauaaauaggcagautt

SEQ ID NO: 1010 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aucugccuauuuaucgguatt

SEQ ID NO: 1011 - DNA, 23 bp, Artificial Sequence
  Marburg virus polymerase complex protein VP35 siRNA target region
taccgataaataggcagatatcg

SEQ ID NO: 1012 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ccgauaaauaggcagauautt

SEQ ID NO: 1013 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auaucugccuauuuaucggtt

SEQ ID NO: 1014 - DNA, 23 bp, Artificial Sequence
  Marburg virus polymerase complex protein VP35 siRNA target region
aataggcagatatcggacattca

SEQ ID NO: 1015 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
uaggcagauaucggacauutt

SEQ ID NO: 1016 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aauguccgauaucugccuatt

SEQ ID NO: 1017 - DNA, 23 bp, Artificial Sequence
  Marburg virus polymerase complex protein VP35 siRNA target region
taggcagatatcggacattcaaa

SEQ ID NO: 1018 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ggcagauaucggacauucatt

SEQ ID NO: 1019 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
ugaauguccgauaucugcctt

SEQ ID NO: 1020 - DNA, 23 bp, Artificial Sequence
  Marburg virus polymerase complex protein VP35 siRNA target region
aaagcactctaaacgaagtaaca

SEQ ID NO: 1021 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
agcacucuaaacgaaguaatt

SEQ ID NO: 1022 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uuacuucguuuagagugcutt

SEQ ID NO: 1023 - DNA, 23 bp, Artificial Sequence
  Marburg virus polymerase complex protein VP35 siRNA target region
catgaaattgagcggcaattaca

SEQ ID NO: 1024 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ugaaauugagcggcaauuatt

SEQ ID NO: 1025 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uaauugccgcucaauuucatt

SEQ ID NO: 1026 - DNA, 23 bp, Artificial Sequence
  Marburg virus polymerase complex protein VP35 siRNA target region
gagcggcaattacatgagataac

SEQ ID NO: 1027 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gcggcaauuacaugagauatt

SEQ ID NO: 1028 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uaucucauguaauugccgctt

SEQ ID NO: 1029 - DNA, 23 bp, Artificial Sequence
  Marburg virus polymerase complex protein VP35 siRNA target region
gaaggacactggaagcaatttcc

SEQ ID NO: 1030 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
aggacacuggaagcaauuutt

SEQ ID NO: 1031 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaauugcuuccaguguccutt

SEQ ID NO: 1032 - DNA, 23 bp, Artificial Sequence
  Marburg virus polymerase complex protein VP35 siRNA target region
aaatacgaccacctcgtaatttc

SEQ ID NO: 1033 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
auacgaccaccucguaauutt

SEQ ID NO: 1034 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aauuacgagguggucguautt

SEQ ID NO: 1035 - DNA, 23 bp, Artificial Sequence
  Marburg virus polymerase complex protein VP35 siRNA target region
aatacgaccacctcgtaatttca

SEQ ID NO: 1036 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
uacgaccaccucguaauuutt

SEQ ID NO: 1037 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaauuacgagguggucguatt

SEQ ID NO: 1038 - DNA, 23 bp, Artificial Sequence
  Marburg virus polymerase complex protein VP35 siRNA target region
tacgaccacctcgtaatttcaac

SEQ ID NO: 1039 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
cgaccaccucguaauuucatt

SEQ ID NO: 1040 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
ugaaauuacgagguggucgtt

SEQ ID NO: 1041 - DNA, 23 bp, Artificial Sequence
  Marburg virus polymerase complex protein VP35 siRNA target region
gaccacctcgtaatttcaactgg

SEQ ID NO: 1042 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ccaccucguaauuucaacutt

SEQ ID NO: 1043 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aguugaaauuacgagguggtt

SEQ ID NO: 1044 - DNA, 23 bp, Artificial Sequence
  Marburg virus polymerase complex protein VP35 siRNA target region
aagatgtcgaaagttcttgaact

SEQ ID NO: 1045 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gaugucgaaaguucuugaatt

SEQ ID NO: 1046 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uucaagaacuuucgacauctt

SEQ ID NO: 1047 - DNA, 23 bp, Artificial Sequence
  Marburg virus polymerase complex protein VP35 siRNA target region
gatgtcgaaagttcttgaactca

SEQ ID NO: 1048 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ugucgaaaguucuugaacutt

SEQ ID NO: 1049 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aguucaagaacuuucgacatt

SEQ ID NO: 1050 - DNA, 23 bp, Artificial Sequence
  Marburg virus polymerase complex protein VP35 siRNA target region
gagacgttctccaagccaaatct

SEQ ID NO: 1051 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gacguucuccaagccaaautt

SEQ ID NO: 1052 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
auuuggcuuggagaacguctt

SEQ ID NO: 1053 - DNA, 23 bp, Artificial Sequence
  Marburg virus polymerase complex protein VP35 siRNA target region
caagccaaatctttcagctaagg

SEQ ID NO: 1054 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
agccaaaucuuucagcuaatt

SEQ ID NO: 1055 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uuagcugaaagauuuggcutt

SEQ ID NO: 1056 - DNA, 23 bp, Artificial Sequence
  Marburg virus polymerase complex protein VP35 siRNA target region
aagccaaatctttcagctaagga

SEQ ID NO: 1057 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gccaaaucuuucagcuaagtt

SEQ ID NO: 1058 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
cuuagcugaaagauuuggctt

SEQ ID NO: 1059 - DNA, 23 bp, Artificial Sequence
  Marburg virus polymerase complex protein VP35 siRNA target region
gatgcatttcaccagattctaag

SEQ ID NO: 1060 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ugcauuucaccagauucuatt

SEQ ID NO: 1061 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uagaaucuggugaaaugcatt

SEQ ID NO: 1062 - DNA, 23 bp, Artificial Sequence
  Marburg virus polymerase complex protein VP35 siRNA target region
gactcgactaagcagaacatttg

SEQ ID NO: 1063 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
cucgacuaagcagaacauutt

SEQ ID NO: 1064 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aauguucugcuuagucgagtt

SEQ ID NO: 1065 - DNA, 23 bp, Artificial Sequence
  Marburg virus polymerase complex protein VP35 siRNA target region
aagcagaacatttgatgctttcc

SEQ ID NO: 1066 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
gcagaacauuugaugcuuutt

SEQ ID NO: 1067 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aaagcaucaaauguucugctt

SEQ ID NO: 1068 - DNA, 23 bp, Artificial Sequence
  Marburg virus polymerase complex protein VP35 siRNA target region
gatgctttcctcggagtagttcc

SEQ ID NO: 1069 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
ugcuuuccucggaguaguutt

SEQ ID NO: 1070 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
aacuacuccgaggaaagcatt

SEQ ID NO: 1071 - DNA, 23 bp, Artificial Sequence
  Marburg virus polymerase complex protein VP35 siRNA target region
gagtagttcctccagtgataaga

SEQ ID NO: 1072 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
guaguuccuccagugauaatt

SEQ ID NO: 1073 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uuaucacuggaggaacuactt

SEQ ID NO: 1074 - DNA, 23 bp, Artificial Sequence
  Marburg virus polymerase complex protein VP35 siRNA target region
tagttcctccagtgataagagtc

SEQ ID NO: 1075 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
guuccuccagugauaagagtt

SEQ ID NO: 1076 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
cucuuaucacuggaggaactt

SEQ ID NO: 1077 - DNA, 23 bp, Artificial Sequence
  Marburg virus polymerase complex protein VP35 siRNA target region
caacccaacaattgacaaaggat

SEQ ID NO: 1078 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
acccaacaauugacaaaggtt

SEQ ID NO: 1079 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA sense strand
ccuuugucaauuguugggutt

SEQ ID NO: 1080 - DNA, 23 bp, Artificial Sequence
  Marburg virus polymerase complex protein VP35 siRNA target region
caaaggatgggtctgtgtttatt

SEQ ID NO: 1081 - DNA, 21 bp, Artificial Sequence
  Marburg virus polymerase complex protein VP35 siRNA sense strand
  Description of Combined DNA/RNA Molecule:Marburg virus polymerase complex protein VP35 siRNA sense strand
aaggaugggucuguguuuatt

SEQ ID NO: 1082 - DNA, 21 bp, Artificial Sequence
  Marburg virus polymerase complex protein VP35 siRNA antisense strand
  Description of Combined DNA/RNA Molecule:Marburg virus polymerase complex protein VP35 siRNA antisense strand
uaaacacagacccauccuutt

SEQ ID NO: 1083 - RNA, 21 nt, Artificial Sequence
  Ebola virus siRNA sense strand
cggacacacaaaaagaaagaa

SEQ ID NO: 1084 - RNA, 21 nt, Artificial Sequence
  Ebola virus siRNA sense strand
ggacacacaaaaagaaagaag

SEQ ID NO: 1085 - RNA, 21 nt, Artificial Sequence
  Ebola virus siRNA sense strand
gacacacaaaaagaaagaaga

SEQ ID NO: 1086 - RNA, 21 nt, Artificial Sequence
  Ebola virus siRNA sense strand
acacacaaaaagaaagaagaa

SEQ ID NO: 1087 - RNA, 21 nt, Artificial Sequence
  Ebola virus siRNA sense strand
cacacaaaaagaaagaagaau

SEQ ID NO: 1088 - RNA, 21 nt, Artificial Sequence
  Ebola virus siRNA sense strand
acacaaaaagaaagaagaauu

SEQ ID NO: 1089 - RNA, 21 nt, Artificial Sequence
  Ebola virus siRNA sense strand
cacaaaaagaaagaagaauuu

SEQ ID NO: 1090 - RNA, 21 nt, Artificial Sequence
  Ebola virus siRNA sense strand
acaaaaagaaagaagaauuuu

SEQ ID NO: 1091 - RNA, 21 nt, Artificial Sequence
  Ebola virus siRNA sense strand
caaaaagaaagaagaauuuuu

SEQ ID NO: 1092 - RNA, 21 nt, Artificial Sequence
  Ebola virus siRNA sense strand
aaaaagaaagaagaauuuuua

SEQ ID NO: 1093 - RNA, 21 nt, Artificial Sequence
  Ebola virus siRNA sense strand
aaaagaaagaagaauuuuuag

SEQ ID NO: 1094 - RNA, 21 nt, Artificial Sequence
  Ebola virus siRNA sense strand
aaagaaagaagaauuuuuagg

SEQ ID NO: 1095 - RNA, 21 nt, Artificial Sequence
  Ebola virus siRNA sense strand
aagaaagaagaauuuuuagga

SEQ ID NO: 1096 - RNA, 21 nt, Artificial Sequence
  Ebola virus siRNA sense strand
agaaagaagaauuuuuaggau

SEQ ID NO: 1097 - RNA, 21 nt, Artificial Sequence
  Ebola virus siRNA sense strand
gaaagaagaauuuuuaggauc

SEQ ID NO: 1098 - RNA, 21 nt, Artificial Sequence
  Ebola virus siRNA sense strand
aaagaagaauuuuuaggaucu

SEQ ID NO: 1099 - RNA, 21 nt, Artificial Sequence
  Ebola virus siRNA sense strand
aagaagaauuuuuaggaucuu

SEQ ID NO: 1100 - RNA, 21 nt, Artificial Sequence
  Ebola virus siRNA sense strand
agaagaauuuuuaggaucuuu

SEQ ID NO: 1101 - RNA, 21 nt, Artificial Sequence
  Ebola virus siRNA sense strand
gaagaauuuuuaggaucuuuu

SEQ ID NO: 1102 - RNA, 21 nt, Artificial Sequence
  Ebola virus siRNA sense strand
aagaauuuuuaggaucuuuug

SEQ ID NO: 1103 - RNA, 21 nt, Artificial Sequence
  Ebola virus siRNA sense strand
agaauuuuuaggaucuuuugu

SEQ ID NO: 1104 - RNA, 21 nt, Artificial Sequence
  Ebola virus siRNA sense strand
gaauuuuuaggaucuuuugug

SEQ ID NO: 1105 - RNA, 21 nt, Artificial Sequence
  Ebola virus siRNA sense strand
aauuuuuaggaucuuuugugu

SEQ ID NO: 1106 - RNA, 21 nt, Artificial Sequence
  Ebola virus siRNA sense strand
auuuuuaggaucuuuugugug

SEQ ID NO: 1107 - RNA, 21 nt, Artificial Sequence
  Ebola virus siRNA sense strand
uuuuuaggaucuuuugugugc

SEQ ID NO: 1108 - RNA, 21 nt, Artificial Sequence
  Ebola virus siRNA sense strand
uuuuaggaucuuuugugugcg

SEQ ID NO: 1109 - RNA, 21 nt, Artificial Sequence
  Ebola virus siRNA sense strand
uuuaggaucuuuugugugcga

SEQ ID NO: 1110 - RNA, 21 nt, Artificial Sequence
  Ebola virus siRNA sense strand
uuaggaucuuuugugugcgaa

SEQ ID NO: 1111 - RNA, 21 nt, Artificial Sequence
  Ebola virus siRNA sense strand
uaggaucuuuugugugcgaau

SEQ ID NO: 1112 - RNA, 21 nt, Artificial Sequence
  Ebola virus siRNA sense strand
aggaucuuuugugugcgaaua

SEQ ID NO: 1113 - RNA, 21 nt, Artificial Sequence
  Ebola virus siRNA sense strand
ggaucuuuugugugcgaauaa

SEQ ID NO: 1114 - RNA, 21 nt, Artificial Sequence
  Ebola virus siRNA sense strand
gaucuuuugugugcgaauaac

SEQ ID NO: 1115 - RNA, 21 nt, Artificial Sequence
  Ebola virus siRNA sense strand
aucuuuugugugcgaauaacu

SEQ ID NO: 1116 - RNA, 21 nt, Artificial Sequence
  Ebola virus siRNA sense strand
ucuuuugugugcgaauaacua

SEQ ID NO: 1117 - RNA, 21 nt, Artificial Sequence
  Ebola virus siRNA sense strand
cuuuugugugcgaauaacuau

SEQ ID NO: 1118 - RNA, 21 nt, Artificial Sequence
  Ebola virus siRNA sense strand
uuuugugugcgaauaacuaug

SEQ ID NO: 1119 - RNA, 21 nt, Artificial Sequence
  Ebola virus siRNA sense strand
uuugugugcgaauaacuauga

SEQ ID NO: 1120 - RNA, 21 nt, Artificial Sequence
  Ebola virus siRNA sense strand
uugugugcgaauaacuaugag

SEQ ID NO: 1121 - RNA, 21 nt, Artificial Sequence
  Ebola virus siRNA sense strand
ugugugcgaauaacuaugagg

SEQ ID NO: 1122 - RNA, 21 nt, Artificial Sequence
  Ebola virus siRNA sense strand
gugugcgaauaacuaugagga

SEQ ID NO: 1123 - RNA, 21 nt, Artificial Sequence
  Ebola virus siRNA sense strand
ugugcgaauaacuaugaggaa

SEQ ID NO: 1124 - RNA, 21 nt, Artificial Sequence
  Ebola virus siRNA sense strand
gugcgaauaacuaugaggaag

SEQ ID NO: 1125 - RNA, 21 nt, Artificial Sequence
  Ebola virus siRNA sense strand
ugcgaauaacuaugaggaaga

SEQ ID NO: 1126 - RNA, 21 nt, Artificial Sequence
  Ebola virus siRNA sense strand
gcgaauaacuaugaggaagau

SEQ ID NO: 1127 - RNA, 21 nt, Artificial Sequence
  Ebola virus siRNA sense strand
cgaauaacuaugaggaagauu

SEQ ID NO: 1128 - RNA, 21 nt, Artificial Sequence
  Ebola virus siRNA sense strand
gaauaacuaugaggaagauua

SEQ ID NO: 1129 - RNA, 21 nt, Artificial Sequence
  Ebola virus siRNA sense strand
aauaacuaugaggaagauuaa

SEQ ID NO: 1130 - RNA, 21 nt, Artificial Sequence
  Ebola virus siRNA sense strand
auaacuaugaggaagauuaau

SEQ ID NO: 1131 - RNA, 21 nt, Artificial Sequence
  Ebola virus siRNA sense strand
uaacuaugaggaagauuaaua

SEQ ID NO: 1132 - RNA, 21 nt, Artificial Sequence
  Ebola virus siRNA sense strand
aacuaugaggaagauuaauaa

SEQ ID NO: 1133 - RNA, 21 nt, Artificial Sequence
  Ebola virus siRNA sense strand
acuaugaggaagauuaauaau

SEQ ID NO: 1134 - RNA, 21 nt, Artificial Sequence
  Ebola virus siRNA sense strand
cuaugaggaagauuaauaauu

SEQ ID NO: 1135 - RNA, 21 nt, Artificial Sequence
  Ebola virus siRNA sense strand
uaugaggaagauuaauaauuu

SEQ ID NO: 1136 - RNA, 21 nt, Artificial Sequence
  Ebola virus siRNA sense strand
augaggaagauuaauaauuuu

SEQ ID NO: 1137 - RNA, 21 nt, Artificial Sequence
  Ebola virus siRNA sense strand
ugaggaagauuaauaauuuuc

SEQ ID NO: 1138 - RNA, 21 nt, Artificial Sequence
  Ebola virus siRNA sense strand
gaggaagauuaauaauuuucc

SEQ ID NO: 1139 - RNA, 21 nt, Artificial Sequence
  Ebola virus siRNA sense strand
aggaagauuaauaauuuuccu

SEQ ID NO: 1140 - RNA, 21 nt, Artificial Sequence
  Ebola virus siRNA sense strand
ggaagauuaauaauuuuccuc

SEQ ID NO: 1141 - RNA, 21 nt, Artificial Sequence
  Ebola virus siRNA sense strand
gaagauuaauaauuuuccucu

SEQ ID NO: 1142 - RNA, 21 nt, Artificial Sequence
  Ebola virus siRNA sense strand
aagauuaauaauuuuccucuc

SEQ ID NO: 1143 - RNA, 21 nt, Artificial Sequence
  Ebola virus siRNA sense strand
agauuaauaauuuuccucuca

SEQ ID NO: 1144 - RNA, 21 nt, Artificial Sequence
  Ebola virus siRNA sense strand
gauuaauaauuuuccucucau

SEQ ID NO: 1145 - RNA, 21 nt, Artificial Sequence
  Ebola virus siRNA sense strand
auuaauaauuuuccucucauu

SEQ ID NO: 1146 - RNA, 21 nt, Artificial Sequence
  Ebola virus siRNA sense strand
uuaauaauuuuccucucauug

SEQ ID NO: 1147 - RNA, 21 nt, Artificial Sequence
  Ebola virus siRNA sense strand
uaauaauuuuccucucauuga

SEQ ID NO: 1148 - RNA, 21 nt, Artificial Sequence
  Ebola virus siRNA sense strand
aauaauuuuccucucauugaa

SEQ ID NO: 1149 - RNA, 21 nt, Artificial Sequence
  Ebola virus siRNA sense strand
auaauuuuccucucauugaaa

SEQ ID NO: 1150 - RNA, 21 nt, Artificial Sequence
  Ebola virus siRNA sense strand
uaauuuuccucucauugaaau

SEQ ID NO: 1151 - RNA, 21 nt, Artificial Sequence
  Ebola virus siRNA sense strand
aauuuuccucucauugaaauu

SEQ ID NO: 1152 - RNA, 21 nt, Artificial Sequence
  Ebola virus siRNA sense strand
auuuuccucucauugaaauuu

SEQ ID NO: 1153 - RNA, 21 nt, Artificial Sequence
  Ebola virus siRNA sense strand
uuuuccucucauugaaauuua

SEQ ID NO: 1154 - RNA, 21 nt, Artificial Sequence
  Ebola virus siRNA sense strand
uuuccucucauugaaauuuau

SEQ ID NO: 1155 - RNA, 21 nt, Artificial Sequence
  Ebola virus siRNA sense strand
uuccucucauugaaauuuaua

SEQ ID NO: 1156 - RNA, 21 nt, Artificial Sequence
  Ebola virus siRNA sense strand
uccucucauugaaauuuauau

SEQ ID NO: 1157 - RNA, 21 nt, Artificial Sequence
  Ebola virus siRNA sense strand
ccucucauugaaauuuauauc

SEQ ID NO: 1158 - RNA, 21 nt, Artificial Sequence
  Ebola virus siRNA sense strand
cucucauugaaauuuauaucg

SEQ ID NO: 1159 - RNA, 21 nt, Artificial Sequence
  Ebola virus siRNA sense strand
ucucauugaaauuuauaucgg

SEQ ID NO: 1160 - RNA, 21 nt, Artificial Sequence
  Ebola virus siRNA sense strand
cucauugaaauuuauaucgga

SEQ ID NO: 1161 - RNA, 21 nt, Artificial Sequence
  Ebola virus siRNA sense strand
ucauugaaauuuauaucggaa

SEQ ID NO: 1162 - RNA, 21 nt, Artificial Sequence
  Ebola virus siRNA sense strand
cauugaaauuuauaucggaau

SEQ ID NO: 1163 - RNA, 21 nt, Artificial Sequence
  Ebola virus siRNA sense strand
auugaaauuuauaucggaauu

SEQ ID NO: 1164 - RNA, 21 nt, Artificial Sequence
  Ebola virus siRNA sense strand
uugaaauuuauaucggaauuu

SEQ ID NO: 1165 - RNA, 21 nt, Artificial Sequence
  Ebola virus siRNA sense strand
ugaaauuuauaucggaauuua

SEQ ID NO: 1166 - RNA, 21 nt, Artificial Sequence
  Ebola virus siRNA sense strand
gaaauuuauaucggaauuuaa

SEQ ID NO: 1167 - RNA, 21 nt, Artificial Sequence
  Ebola virus siRNA sense strand
aaauuuauaucggaauuuaaa

SEQ ID NO: 1168 - RNA, 21 nt, Artificial Sequence
  Ebola virus siRNA sense strand
aauuuauaucggaauuuaaau

SEQ ID NO: 1169 - RNA, 21 nt, Artificial Sequence
  Ebola virus siRNA sense strand
auuuauaucggaauuuaaauu

SEQ ID NO: 1170 - RNA, 21 nt, Artificial Sequence
  Ebola virus siRNA sense strand
uuuauaucggaauuuaaauug

SEQ ID NO: 1171 - RNA, 21 nt, Artificial Sequence
  Ebola virus siRNA sense strand
uuauaucggaauuuaaauuga

SEQ ID NO: 1172 - RNA, 21 nt, Artificial Sequence
  Ebola virus siRNA sense strand
uauaucggaauuuaaauugaa

SEQ ID NO: 1173 - RNA, 21 nt, Artificial Sequence
  Ebola virus siRNA sense strand
auaucggaauuuaaauugaaa

SEQ ID NO: 1174 - RNA, 21 nt, Artificial Sequence
  Ebola virus siRNA sense strand
uaucggaauuuaaauugaaau

SEQ ID NO: 1175 - RNA, 21 nt, Artificial Sequence
  Ebola virus siRNA sense strand
aucggaauuuaaauugaaauu

SEQ ID NO: 1176 - RNA, 21 nt, Artificial Sequence
  Ebola virus siRNA sense strand
ucggaauuuaaauugaaauug

SEQ ID NO: 1177 - RNA, 21 nt, Artificial Sequence
  Ebola virus siRNA sense strand
cggaauuuaaauugaaauugu

SEQ ID NO: 1178 - RNA, 21 nt, Artificial Sequence
  Ebola virus siRNA sense strand
ggaauuuaaauugaaauuguu

SEQ ID NO: 1179 - RNA, 21 nt, Artificial Sequence
  Ebola virus siRNA sense strand
gaauuuaaauugaaauuguua

SEQ ID NO: 1180 - RNA, 21 nt, Artificial Sequence
  Ebola virus siRNA sense strand
aauuuaaauugaaauuguuac

SEQ ID NO: 1181 - RNA, 21 nt, Artificial Sequence
  Ebola virus siRNA sense strand
auuuaaauugaaauuguuacu

SEQ ID NO: 1182 - RNA, 21 nt, Artificial Sequence
  Ebola virus siRNA sense strand
uuuaaauugaaauuguuacug

SEQ ID NO: 1183 - RNA, 21 nt, Artificial Sequence
  Ebola virus siRNA sense strand
uuaaauugaaauuguuacugu

SEQ ID NO: 1184 - RNA, 21 nt, Artificial Sequence
  Ebola virus siRNA sense strand
uaaauugaaauuguuacugua

SEQ ID NO: 1185 - RNA, 21 nt, Artificial Sequence
  Ebola virus siRNA sense strand
aaauugaaauuguuacuguaa

SEQ ID NO: 1186 - RNA, 21 nt, Artificial Sequence
  Ebola virus siRNA sense strand
aauugaaauuguuacuguaau

SEQ ID NO: 1187 - RNA, 21 nt, Artificial Sequence
  Ebola virus siRNA sense strand
auugaaauuguuacuguaauc

SEQ ID NO: 1188 - RNA, 21 nt, Artificial Sequence
  Ebola virus siRNA sense strand
uugaaauuguuacuguaauca

SEQ ID NO: 1189 - RNA, 21 nt, Artificial Sequence
  Ebola virus siRNA sense strand
ugaaauuguuacuguaaucac

SEQ ID NO: 1190 - RNA, 21 nt, Artificial Sequence
  Ebola virus siRNA sense strand
gaaauuguuacuguaaucaca

SEQ ID NO: 1191 - RNA, 21 nt, Artificial Sequence
  Ebola virus siRNA sense strand
aaauuguuacuguaaucacac

SEQ ID NO: 1192 - RNA, 21 nt, Artificial Sequence
  Ebola virus siRNA sense strand
aauuguuacuguaaucacacc

SEQ ID NO: 1193 - RNA, 21 nt, Artificial Sequence
  Ebola virus siRNA sense strand
auuguuacuguaaucacaccu

SEQ ID NO: 1194 - RNA, 21 nt, Artificial Sequence
  Ebola virus siRNA sense strand
uuguuacuguaaucacaccug

SEQ ID NO: 1195 - RNA, 21 nt, Artificial Sequence
  Ebola virus siRNA sense strand
uguuacuguaaucacaccugg

SEQ ID NO: 1196 - RNA, 21 nt, Artificial Sequence
  Ebola virus siRNA sense strand
guuacuguaaucacaccuggu

SEQ ID NO: 1197 - RNA, 21 nt, Artificial Sequence
  Ebola virus siRNA sense strand
uuacuguaaucacaccugguu

SEQ ID NO: 1198 - RNA, 21 nt, Artificial Sequence
  Ebola virus siRNA sense strand
uacuguaaucacaccugguuu

SEQ ID NO: 1199 - RNA, 21 nt, Artificial Sequence
  Ebola virus siRNA sense strand
acuguaaucacaccugguuug

SEQ ID NO: 1200 - RNA, 21 nt, Artificial Sequence
  Ebola virus siRNA sense strand
cuguaaucacaccugguuugu

SEQ ID NO: 1201 - RNA, 21 nt, Artificial Sequence
  Ebola virus siRNA sense strand
uguaaucacaccugguuuguu

SEQ ID NO: 1202 - RNA, 21 nt, Artificial Sequence
  Ebola virus siRNA sense strand
guaaucacaccugguuuguuu

SEQ ID NO: 1203 - RNA, 21 nt, Artificial Sequence
  Ebola virus siRNA sense strand
uaaucacaccugguuuguuuc

SEQ ID NO: 1204 - RNA, 21 nt, Artificial Sequence
  Ebola virus siRNA sense strand
aaucacaccugguuuguuuca

SEQ ID NO: 1205 - RNA, 21 nt, Artificial Sequence
  Ebola virus siRNA sense strand
aucacaccugguuuguuucag

SEQ ID NO: 1206 - RNA, 21 nt, Artificial Sequence
  Ebola virus siRNA sense strand
ucacaccugguuuguuucaga

SEQ ID NO: 1207 - RNA, 21 nt, Artificial Sequence
  Ebola virus siRNA sense strand
cacaccugguuuguuucagag

SEQ ID NO: 1208 - RNA, 21 nt, Artificial Sequence
  Ebola virus siRNA sense strand
acaccugguuuguuucagagc

SEQ ID NO: 1209 - RNA, 21 nt, Artificial Sequence
  Ebola virus siRNA sense strand
caccugguuuguuucagagcc

SEQ ID NO: 1210 - RNA, 21 nt, Artificial Sequence
  Ebola virus siRNA sense strand
accugguuuguuucagagcca

SEQ ID NO: 1211 - RNA, 21 nt, Artificial Sequence
  Ebola virus siRNA sense strand
ccugguuuguuucagagccac

SEQ ID NO: 1212 - RNA, 21 nt, Artificial Sequence
  Ebola virus siRNA sense strand
cugguuuguuucagagccaca

SEQ ID NO: 1213 - RNA, 21 nt, Artificial Sequence
  Ebola virus siRNA sense strand
ugguuuguuucagagccacau

SEQ ID NO: 1214 - RNA, 21 nt, Artificial Sequence
  Ebola virus siRNA sense strand
gguuuguuucagagccacauc

SEQ ID NO: 1215 - RNA, 21 nt, Artificial Sequence
  Ebola virus siRNA sense strand
guuuguuucagagccacauca

SEQ ID NO: 1216 - RNA, 21 nt, Artificial Sequence
  Ebola virus siRNA sense strand
uuuguuucagagccacaucac

SEQ ID NO: 1217 - RNA, 21 nt, Artificial Sequence
  Ebola virus siRNA sense strand
uuguuucagagccacaucaca

SEQ ID NO: 1218 - RNA, 21 nt, Artificial Sequence
  Ebola virus siRNA sense strand
uguuucagagccacaucacaa

SEQ ID NO: 1219 - RNA, 21 nt, Artificial Sequence
  Ebola virus siRNA sense strand
guuucagagccacaucacaaa

SEQ ID NO: 1220 - RNA, 21 nt, Artificial Sequence
  Ebola virus siRNA sense strand
uuucagagccacaucacaaag

SEQ ID NO: 1221 - RNA, 21 nt, Artificial Sequence
  Ebola virus siRNA sense strand
uucagagccacaucacaaaga

SEQ ID NO: 1222 - RNA, 21 nt, Artificial Sequence
  Ebola virus siRNA sense strand
ucagagccacaucacaaagau

SEQ ID NO: 1223 - RNA, 21 nt, Artificial Sequence
  Ebola virus siRNA sense strand
cagagccacaucacaaagaua

SEQ ID NO: 1224 - RNA, 21 nt, Artificial Sequence
  Ebola virus siRNA sense strand
agagccacaucacaaagauag

SEQ ID NO: 1225 - RNA, 21 nt, Artificial Sequence
  Ebola virus siRNA sense strand
gagccacaucacaaagauaga

SEQ ID NO: 1226 - RNA, 21 nt, Artificial Sequence
  Ebola virus siRNA sense strand
agccacaucacaaagauagag

SEQ ID NO: 1227 - RNA, 21 nt, Artificial Sequence
  Ebola virus siRNA sense strand
gccacaucacaaagauagaga

SEQ ID NO: 1228 - RNA, 21 nt, Artificial Sequence
  Ebola virus siRNA sense strand
ccacaucacaaagauagagaa

SEQ ID NO: 1229 - RNA, 21 nt, Artificial Sequence
  Ebola virus siRNA sense strand
cacaucacaaagauagagaac

SEQ ID NO: 1230 - RNA, 21 nt, Artificial Sequence
  Ebola virus siRNA sense strand
acaucacaaagauagagaaca

SEQ ID NO: 1231 - RNA, 21 nt, Artificial Sequence
  Ebola virus siRNA sense strand
caucacaaagauagagaacaa

SEQ ID NO: 1232 - RNA, 21 nt, Artificial Sequence
  Ebola virus siRNA sense strand
aucacaaagauagagaacaac

SEQ ID NO: 1233 - RNA, 21 nt, Artificial Sequence
  Ebola virus siRNA sense strand
ucacaaagauagagaacaacc

SEQ ID NO: 1234 - RNA, 21 nt, Artificial Sequence
  Ebola virus siRNA sense strand
cacaaagauagagaacaaccu

SEQ ID NO: 1235 - RNA, 21 nt, Artificial Sequence
  Ebola virus siRNA sense strand
acaaagauagagaacaaccua

SEQ ID NO: 1236 - RNA, 21 nt, Artificial Sequence
  Ebola virus siRNA sense strand
caaagauagagaacaaccuag

SEQ ID NO: 1237 - RNA, 21 nt, Artificial Sequence
  Ebola virus siRNA sense strand
aaagauagagaacaaccuagg

SEQ ID NO: 1238 - RNA, 21 nt, Artificial Sequence
  Ebola virus siRNA sense strand
aagauagagaacaaccuaggu

SEQ ID NO: 1239 - RNA, 21 nt, Artificial Sequence
  Ebola virus siRNA sense strand
agauagagaacaaccuagguc

SEQ ID NO: 1240 - RNA, 21 nt, Artificial Sequence
  Ebola virus siRNA sense strand
gauagagaacaaccuaggucu

SEQ ID NO: 1241 - RNA, 21 nt, Artificial Sequence
  Ebola virus siRNA sense strand
auagagaacaaccuaggucuc

SEQ ID NO: 1242 - RNA, 21 nt, Artificial Sequence
  Ebola virus siRNA sense strand
uagagaacaaccuaggucucc

SEQ ID NO: 1243 - RNA, 21 nt, Artificial Sequence
  Ebola virus siRNA sense strand
agagaacaaccuaggucuccg

SEQ ID NO: 1244 - RNA, 21 nt, Artificial Sequence
  Ebola virus siRNA sense strand
gagaacaaccuaggucuccga

SEQ ID NO: 1245 - RNA, 21 nt, Artificial Sequence
  Ebola virus siRNA sense strand
agaacaaccuaggucuccgaa

SEQ ID NO: 1246 - RNA, 21 nt, Artificial Sequence
  Ebola virus siRNA sense strand
gaacaaccuaggucuccgaag

SEQ ID NO: 1247 - RNA, 21 nt, Artificial Sequence
  Ebola virus siRNA sense strand
aacaaccuaggucuccgaagg

SEQ ID NO: 1248 - RNA, 21 nt, Artificial Sequence
  Ebola virus siRNA sense strand
acaaccuaggucuccgaaggg

SEQ ID NO: 1249 - RNA, 21 nt, Artificial Sequence
  Ebola virus siRNA sense strand
caaccuaggucuccgaaggga

SEQ ID NO: 1250 - RNA, 21 nt, Artificial Sequence
  Ebola virus siRNA sense strand
aaccuaggucuccgaagggag

SEQ ID NO: 1251 - RNA, 21 nt, Artificial Sequence
  Ebola virus siRNA sense strand
accuaggucuccgaagggagc

SEQ ID NO: 1252 - RNA, 21 nt, Artificial Sequence
  Ebola virus siRNA sense strand
ccuaggucuccgaagggagca

SEQ ID NO: 1253 - RNA, 21 nt, Artificial Sequence
  Ebola virus siRNA sense strand
cuaggucuccgaagggagcaa

SEQ ID NO: 1254 - RNA, 21 nt, Artificial Sequence
  Ebola virus siRNA sense strand
uaggucuccgaagggagcaag

SEQ ID NO: 1255 - RNA, 21 nt, Artificial Sequence
  Ebola virus siRNA sense strand
aggucuccgaagggagcaagg

SEQ ID NO: 1256 - RNA, 21 nt, Artificial Sequence
  Ebola virus siRNA sense strand
ggucuccgaagggagcaaggg

SEQ ID NO: 1257 - RNA, 21 nt, Artificial Sequence
  Ebola virus siRNA sense strand
gucuccgaagggagcaagggc

SEQ ID NO: 1258 - RNA, 21 nt, Artificial Sequence
  Ebola virus siRNA sense strand
ucuccgaagggagcaagggca

SEQ ID NO: 1259 - RNA, 21 nt, Artificial Sequence
  Ebola virus siRNA sense strand
cuccgaagggagcaagggcau

SEQ ID NO: 1260 - RNA, 21 nt, Artificial Sequence
  Ebola virus siRNA sense strand
uccgaagggagcaagggcauc

SEQ ID NO: 1261 - RNA, 21 nt, Artificial Sequence
  Ebola virus siRNA sense strand
ccgaagggagcaagggcauca

SEQ ID NO: 1262 - RNA, 21 nt, Artificial Sequence
  Ebola virus siRNA sense strand
cgaagggagcaagggcaucag

SEQ ID NO: 1263 - RNA, 21 nt, Artificial Sequence
  Ebola virus siRNA sense strand
gaagggagcaagggcaucagu

SEQ ID NO: 1264 - RNA, 21 nt, Artificial Sequence
  Ebola virus siRNA sense strand
aagggagcaagggcaucagug

SEQ ID NO: 1265 - RNA, 21 nt, Artificial Sequence
  Ebola virus siRNA sense strand
agggagcaagggcaucagugu

SEQ ID NO: 1266 - RNA, 21 nt, Artificial Sequence
  Ebola virus siRNA sense strand
gggagcaagggcaucagugug

SEQ ID NO: 1267 - RNA, 21 nt, Artificial Sequence
  Ebola virus siRNA sense strand
ggagcaagggcaucagugugc

SEQ ID NO: 1268 - RNA, 21 nt, Artificial Sequence
  Ebola virus siRNA sense strand
gagcaagggcaucagugugcu

SEQ ID NO: 1269 - RNA, 21 nt, Artificial Sequence
  Ebola virus siRNA sense strand
agcaagggcaucagugugcuc

SEQ ID NO: 1270 - RNA, 21 nt, Artificial Sequence
  Ebola virus siRNA sense strand
gcaagggcaucagugugcuca

SEQ ID NO: 1271 - RNA, 21 nt, Artificial Sequence
  Ebola virus siRNA sense strand
caagggcaucagugugcucag

SEQ ID NO: 1272 - RNA, 21 nt, Artificial Sequence
  Ebola virus siRNA sense strand
aagggcaucagugugcucagu

SEQ ID NO: 1273 - RNA, 21 nt, Artificial Sequence
  Ebola virus siRNA sense strand
agggcaucagugugcucaguu

SEQ ID NO: 1274 - RNA, 21 nt, Artificial Sequence
  Ebola virus siRNA sense strand
gggcaucagugugcucaguug

SEQ ID NO: 1275 - RNA, 21 nt, Artificial Sequence
  Ebola virus siRNA sense strand
ggcaucagugugcucaguuga

SEQ ID NO: 1276 - RNA, 21 nt, Artificial Sequence
  Ebola virus siRNA sense strand
gcaucagugugcucaguugaa

SEQ ID NO: 1277 - RNA, 21 nt, Artificial Sequence
  Ebola virus siRNA sense strand
caucagugugcucaguugaaa

SEQ ID NO: 1278 - RNA, 21 nt, Artificial Sequence
  Ebola virus siRNA sense strand
aucagugugcucaguugaaaa

SEQ ID NO: 1279 - RNA, 21 nt, Artificial Sequence
  Ebola virus siRNA sense strand
ucagugugcucaguugaaaau

SEQ ID NO: 1280 - RNA, 21 nt, Artificial Sequence
  Ebola virus siRNA sense strand
cagugugcucaguugaaaauc

SEQ ID NO: 1281 - RNA, 21 nt, Artificial Sequence
  Ebola virus siRNA sense strand
agugugcucaguugaaaaucc

SEQ ID NO: 1282 - RNA, 21 nt, Artificial Sequence
  Ebola virus siRNA sense strand
gugugcucaguugaaaauccc

SEQ ID NO: 1283 - RNA, 21 nt, Artificial Sequence
  Ebola virus siRNA sense strand
ugugcucaguugaaaaucccu

SEQ ID NO: 1284 - RNA, 21 nt, Artificial Sequence
  Ebola virus siRNA sense strand
gugcucaguugaaaaucccuu

SEQ ID NO: 1285 - RNA, 21 nt, Artificial Sequence
  Ebola virus siRNA sense strand
ugcucaguugaaaaucccuug

SEQ ID NO: 1286 - RNA, 21 nt, Artificial Sequence
  Ebola virus siRNA sense strand
gcucaguugaaaaucccuugu

SEQ ID NO: 1287 - RNA, 21 nt, Artificial Sequence
  Ebola virus siRNA sense strand
cucaguugaaaaucccuuguc

SEQ ID NO: 1288 - RNA, 21 nt, Artificial Sequence
  Ebola virus siRNA sense strand
ucaguugaaaaucccuuguca

SEQ ID NO: 1289 - RNA, 21 nt, Artificial Sequence
  Ebola virus siRNA sense strand
caguugaaaaucccuugucaa

SEQ ID NO: 1290 - RNA, 21 nt, Artificial Sequence
  Ebola virus siRNA sense strand
aguugaaaaucccuugucaac

SEQ ID NO: 1291 - RNA, 21 nt, Artificial Sequence
  Ebola virus siRNA sense strand
guugaaaaucccuugucaaca

SEQ ID NO: 1292 - RNA, 21 nt, Artificial Sequence
  Ebola virus siRNA sense strand
uugaaaaucccuugucaacac

SEQ ID NO: 1293 - RNA, 21 nt, Artificial Sequence
  Ebola virus siRNA sense strand
ugaaaaucccuugucaacacc

SEQ ID NO: 1294 - RNA, 21 nt, Artificial Sequence
  Ebola virus siRNA sense strand
gaaaaucccuugucaacaccu

SEQ ID NO: 1295 - RNA, 21 nt, Artificial Sequence
  Ebola virus siRNA sense strand
aaaaucccuugucaacaccua

SEQ ID NO: 1296 - RNA, 21 nt, Artificial Sequence
  Ebola virus siRNA sense strand
aaaucccuugucaacaccuag

SEQ ID NO: 1297 - RNA, 21 nt, Artificial Sequence
  Ebola virus siRNA sense strand
aaucccuugucaacaccuagg

SEQ ID NO: 1298 - RNA, 21 nt, Artificial Sequence
  Ebola virus siRNA sense strand
aucccuugucaacaccuaggu

SEQ ID NO: 1299 - RNA, 21 nt, Artificial Sequence
  Ebola virus siRNA sense strand
ucccuugucaacaccuagguc

SEQ ID NO: 1300 - RNA, 21 nt, Artificial Sequence
  Ebola virus siRNA sense strand
cccuugucaacaccuaggucu

SEQ ID NO: 1301 - RNA, 21 nt, Artificial Sequence
  Ebola virus siRNA sense strand
ccuugucaacaccuaggucuu

SEQ ID NO: 1302 - RNA, 21 nt, Artificial Sequence
  Ebola virus siRNA sense strand
cuugucaacaccuaggucuua

SEQ ID NO: 1303 - RNA, 21 nt, Artificial Sequence
  Ebola virus siRNA sense strand
uugucaacaccuaggucuuau

SEQ ID NO: 1304 - RNA, 21 nt, Artificial Sequence
  Ebola virus siRNA sense strand
ugucaacaccuaggucuuauc

SEQ ID NO: 1305 - RNA, 21 nt, Artificial Sequence
  Ebola virus siRNA sense strand
gucaacaccuaggucuuauca

SEQ ID NO: 1306 - RNA, 21 nt, Artificial Sequence
  Ebola virus siRNA sense strand
ucaacaccuaggucuuaucac

SEQ ID NO: 1307 - RNA, 21 nt, Artificial Sequence
  Ebola virus siRNA sense strand
caacaccuaggucuuaucaca

SEQ ID NO: 1308 - RNA, 21 nt, Artificial Sequence
  Ebola virus siRNA sense strand
aacaccuaggucuuaucacau

SEQ ID NO: 1309 - RNA, 21 nt, Artificial Sequence
  Ebola virus siRNA sense strand
acaccuaggucuuaucacauc

SEQ ID NO: 1310 - RNA, 21 nt, Artificial Sequence
  Ebola virus siRNA sense strand
caccuaggucuuaucacauca

SEQ ID NO: 1311 - RNA, 21 nt, Artificial Sequence
  Ebola virus siRNA sense strand
accuaggucuuaucacaucac

SEQ ID NO: 1312 - RNA, 21 nt, Artificial Sequence
  Ebola virus siRNA sense strand
ccuaggucuuaucacaucaca

SEQ ID NO: 1313 - RNA, 21 nt, Artificial Sequence
  Ebola virus siRNA sense strand
cuaggucuuaucacaucacaa

SEQ ID NO: 1314 - RNA, 21 nt, Artificial Sequence
  Ebola virus siRNA sense strand
uaggucuuaucacaucacaag

SEQ ID NO: 1315 - RNA, 21 nt, Artificial Sequence
  Ebola virus siRNA sense strand
aggucuuaucacaucacaagu

SEQ ID NO: 1316 - RNA, 21 nt, Artificial Sequence
  Ebola virus siRNA sense strand
ggucuuaucacaucacaaguu

SEQ ID NO: 1317 - RNA, 21 nt, Artificial Sequence
  Ebola virus siRNA sense strand
gucuuaucacaucacaaguuc

SEQ ID NO: 1318 - RNA, 21 nt, Artificial Sequence
  Ebola virus siRNA sense strand
ucuuaucacaucacaaguucc

SEQ ID NO: 1319 - RNA, 21 nt, Artificial Sequence
  Ebola virus siRNA sense strand
cuuaucacaucacaaguucca

SEQ ID NO: 1320 - RNA, 21 nt, Artificial Sequence
  Ebola virus siRNA sense strand
uuaucacaucacaaguuccac

SEQ ID NO: 1321 - RNA, 21 nt, Artificial Sequence
  Ebola virus siRNA sense strand
uaucacaucacaaguuccacc

SEQ ID NO: 1322 - RNA, 21 nt, Artificial Sequence
  Ebola virus siRNA sense strand
aucacaucacaaguuccaccu

SEQ ID NO: 1323 - RNA, 21 nt, Artificial Sequence
  Ebola virus siRNA sense strand
ucacaucacaaguuccaccuc

SEQ ID NO: 1324 - RNA, 21 nt, Artificial Sequence
  Ebola virus siRNA sense strand
cacaucacaaguuccaccuca

SEQ ID NO: 1325 - RNA, 21 nt, Artificial Sequence
  Ebola virus siRNA sense strand
acaucacaaguuccaccucag

SEQ ID NO: 1326 - RNA, 21 nt, Artificial Sequence
  Ebola virus siRNA sense strand
caucacaaguuccaccucaga

SEQ ID NO: 1327 - RNA, 21 nt, Artificial Sequence
  Ebola virus siRNA sense strand
aucacaaguuccaccucagac

SEQ ID NO: 1328 - RNA, 21 nt, Artificial Sequence
  Ebola virus siRNA sense strand
ucacaaguuccaccucagacu

SEQ ID NO: 1329 - RNA, 21 nt, Artificial Sequence
  Ebola virus siRNA sense strand
cacaaguuccaccucagacuc

SEQ ID NO: 1330 - RNA, 21 nt, Artificial Sequence
  Ebola virus siRNA sense strand
acaaguuccaccucagacucu

SEQ ID NO: 1331 - RNA, 21 nt, Artificial Sequence
  Ebola virus siRNA sense strand
caaguuccaccucagacucug

SEQ ID NO: 1332 - RNA, 21 nt, Artificial Sequence
  Ebola virus siRNA sense strand
aaguuccaccucagacucugc

SEQ ID NO: 1333 - RNA, 21 nt, Artificial Sequence
  Ebola virus siRNA sense strand
aguuccaccucagacucugca

SEQ ID NO: 1334 - RNA, 21 nt, Artificial Sequence
  Ebola virus siRNA sense strand
guuccaccucagacucugcag

SEQ ID NO: 1335 - RNA, 21 nt, Artificial Sequence
  Ebola virus siRNA sense strand
uuccaccucagacucugcagg

SEQ ID NO: 1336 - RNA, 21 nt, Artificial Sequence
  Ebola virus siRNA sense strand
uccaccucagacucugcaggg

SEQ ID NO: 1337 - RNA, 21 nt, Artificial Sequence
  Ebola virus siRNA sense strand
ccaccucagacucugcagggu

SEQ ID NO: 1338 - RNA, 21 nt, Artificial Sequence
  Ebola virus siRNA sense strand
caccucagacucugcagggug

SEQ ID NO: 1339 - RNA, 21 nt, Artificial Sequence
  Ebola virus siRNA sense strand
accucagacucugcaggguga

SEQ ID NO: 1340 - RNA, 21 nt, Artificial Sequence
  Ebola virus siRNA sense strand
ccucagacucugcagggugau

SEQ ID NO: 1341 - RNA, 21 nt, Artificial Sequence
  Ebola virus siRNA sense strand
cucagacucugcagggugauc

SEQ ID NO: 1342 - RNA, 21 nt, Artificial Sequence
  Ebola virus siRNA sense strand
ucagacucugcagggugaucc

SEQ ID NO: 1343 - RNA, 21 nt, Artificial Sequence
  Ebola virus siRNA sense strand
cagacucugcagggugaucca

SEQ ID NO: 1344 - RNA, 21 nt, Artificial Sequence
  Ebola virus siRNA sense strand
agacucugcagggugauccaa

SEQ ID NO: 1345 - RNA, 21 nt, Artificial Sequence
  Ebola virus siRNA sense strand
gacucugcagggugauccaac

SEQ ID NO: 1346 - RNA, 21 nt, Artificial Sequence
  Ebola virus siRNA sense strand
acucugcagggugauccaaca

SEQ ID NO: 1347 - RNA, 21 nt, Artificial Sequence
  Ebola virus siRNA sense strand
cucugcagggugauccaacaa

SEQ ID NO: 1348 - RNA, 21 nt, Artificial Sequence
  Ebola virus siRNA sense strand
ucugcagggugauccaacaac

SEQ ID NO: 1349 - RNA, 21 nt, Artificial Sequence
  Ebola virus siRNA sense strand
cugcagggugauccaacaacc

SEQ ID NO: 1350 - RNA, 21 nt, Artificial Sequence
  Ebola virus siRNA sense strand
ugcagggugauccaacaaccu

SEQ ID NO: 1351 - RNA, 21 nt, Artificial Sequence
  Ebola virus siRNA sense strand
gcagggugauccaacaaccuu

SEQ ID NO: 1352 - RNA, 21 nt, Artificial Sequence
  Ebola virus siRNA sense strand
cagggugauccaacaaccuua

SEQ ID NO: 1353 - RNA, 21 nt, Artificial Sequence
  Ebola virus siRNA sense strand
agggugauccaacaaccuuaa

SEQ ID NO: 1354 - RNA, 21 nt, Artificial Sequence
  Ebola virus siRNA sense strand
gggugauccaacaaccuuaau

SEQ ID NO: 1355 - RNA, 21 nt, Artificial Sequence
  Ebola virus siRNA sense strand
ggugauccaacaaccuuaaua

SEQ ID NO: 1356 - RNA, 21 nt, Artificial Sequence
  Ebola virus siRNA sense strand
gugauccaacaaccuuaauag

SEQ ID NO: 1357 - RNA, 21 nt, Artificial Sequence
  Ebola virus siRNA sense strand
ugauccaacaaccuuaauaga

SEQ ID NO: 1358 - RNA, 21 nt, Artificial Sequence
  Ebola virus siRNA sense strand
gauccaacaaccuuaauagaa

SEQ ID NO: 1359 - RNA, 21 nt, Artificial Sequence
  Ebola virus siRNA sense strand
auccaacaaccuuaauagaaa

SEQ ID NO: 1360 - RNA, 21 nt, Artificial Sequence
  Ebola virus siRNA sense strand
uccaacaaccuuaauagaaac

SEQ ID NO: 1361 - RNA, 21 nt, Artificial Sequence
  Ebola virus siRNA sense strand
ccaacaaccuuaauagaaaca

SEQ ID NO: 1362 - RNA, 21 nt, Artificial Sequence
  Ebola virus siRNA sense strand
caacaaccuuaauagaaacau

SEQ ID NO: 1363 - RNA, 21 nt, Artificial Sequence
  Ebola virus siRNA sense strand
aacaaccuuaauagaaacauu

SEQ ID NO: 1364 - RNA, 21 nt, Artificial Sequence
  Ebola virus siRNA sense strand
acaaccuuaauagaaacauua

SEQ ID NO: 1365 - RNA, 21 nt, Artificial Sequence
  Ebola virus siRNA sense strand
caaccuuaauagaaacauuau

SEQ ID NO: 1366 - RNA, 21 nt, Artificial Sequence
  Ebola virus siRNA sense strand
aaccuuaauagaaacauuauu

SEQ ID NO: 1367 - RNA, 21 nt, Artificial Sequence
  Ebola virus siRNA sense strand
accuuaauagaaacauuauug

SEQ ID NO: 1368 - RNA, 21 nt, Artificial Sequence
  Ebola virus siRNA sense strand
ccuuaauagaaacauuauugu

SEQ ID NO: 1369 - RNA, 21 nt, Artificial Sequence
  Ebola virus siRNA sense strand
cuuaauagaaacauuauuguu

SEQ ID NO: 1370 - RNA, 21 nt, Artificial Sequence
  Ebola virus siRNA sense strand
uuaauagaaacauuauuguua

SEQ ID NO: 1371 - RNA, 21 nt, Artificial Sequence
  Ebola virus siRNA sense strand
uaauagaaacauuauuguuaa

SEQ ID NO: 1372 - RNA, 21 nt, Artificial Sequence
  Ebola virus siRNA sense strand
aauagaaacauuauuguuaaa

SEQ ID NO: 1373 - RNA, 21 nt, Artificial Sequence
  Ebola virus siRNA sense strand
auagaaacauuauuguuaaag

SEQ ID NO: 1374 - RNA, 21 nt, Artificial Sequence
  Ebola virus siRNA sense strand
uagaaacauuauuguuaaagg

SEQ ID NO: 1375 - RNA, 21 nt, Artificial Sequence
  Ebola virus siRNA sense strand
agaaacauuauuguuaaagga

SEQ ID NO: 1376 - RNA, 21 nt, Artificial Sequence
  Ebola virus siRNA sense strand
gaaacauuauuguuaaaggac

SEQ ID NO: 1377 - RNA, 21 nt, Artificial Sequence
  Ebola virus siRNA sense strand
aaacauuauuguuaaaggaca

SEQ ID NO: 1378 - RNA, 21 nt, Artificial Sequence
  Ebola virus siRNA sense strand
aacauuauuguuaaaggacag

SEQ ID NO: 1379 - RNA, 21 nt, Artificial Sequence
  Ebola virus siRNA sense strand
acauuauuguuaaaggacagc

SEQ ID NO: 1380 - RNA, 21 nt, Artificial Sequence
  Ebola virus siRNA sense strand
cauuauuguuaaaggacagca

SEQ ID NO: 1381 - RNA, 21 nt, Artificial Sequence
  Ebola virus siRNA sense strand
auuauuguuaaaggacagcau

SEQ ID NO: 1382 - RNA, 21 nt, Artificial Sequence
  Ebola virus siRNA sense strand
uuauuguuaaaggacagcauu

SEQ ID NO: 1383 - RNA, 21 nt, Artificial Sequence
  Ebola virus siRNA sense strand
uauuguuaaaggacagcauua

SEQ ID NO: 1384 - RNA, 21 nt, Artificial Sequence
  Ebola virus siRNA sense strand
auuguuaaaggacagcauuag

SEQ ID NO: 1385 - RNA, 21 nt, Artificial Sequence
  Ebola virus siRNA sense strand
uuguuaaaggacagcauuagu

SEQ ID NO: 1386 - RNA, 21 nt, Artificial Sequence
  Ebola virus siRNA sense strand
uguuaaaggacagcauuaguu

SEQ ID NO: 1387 - RNA, 21 nt, Artificial Sequence
  Ebola virus siRNA sense strand
guuaaaggacagcauuaguuc

SEQ ID NO: 1388 - RNA, 21 nt, Artificial Sequence
  Ebola virus siRNA sense strand
uuaaaggacagcauuaguuca

SEQ ID NO: 1389 - RNA, 21 nt, Artificial Sequence
  Ebola virus siRNA sense strand
uaaaggacagcauuaguucac

SEQ ID NO: 1390 - RNA, 21 nt, Artificial Sequence
  Ebola virus siRNA sense strand
aaaggacagcauuaguucaca

SEQ ID NO: 1391 - RNA, 21 nt, Artificial Sequence
  Ebola virus siRNA sense strand
aaggacagcauuaguucacag

SEQ ID NO: 1392 - RNA, 21 nt, Artificial Sequence
  Ebola virus siRNA sense strand
aggacagcauuaguucacagu

SEQ ID NO: 1393 - RNA, 21 nt, Artificial Sequence
  Ebola virus siRNA sense strand
ggacagcauuaguucacaguc

SEQ ID NO: 1394 - RNA, 21 nt, Artificial Sequence
  Ebola virus siRNA sense strand
gacagcauuaguucacaguca

SEQ ID NO: 1395 - RNA, 21 nt, Artificial Sequence
  Ebola virus siRNA sense strand
acagcauuaguucacagucaa

SEQ ID NO: 1396 - RNA, 21 nt, Artificial Sequence
  Ebola virus siRNA sense strand
cagcauuaguucacagucaaa

SEQ ID NO: 1397 - RNA, 21 nt, Artificial Sequence
  Ebola virus siRNA sense strand
agcauuaguucacagucaaac

SEQ ID NO: 1398 - RNA, 21 nt, Artificial Sequence
  Ebola virus siRNA sense strand
gcauuaguucacagucaaaca

SEQ ID NO: 1399 - RNA, 21 nt, Artificial Sequence
  Ebola virus siRNA sense strand
cauuaguucacagucaaacaa

SEQ ID NO: 1400 - RNA, 21 nt, Artificial Sequence
  Ebola virus siRNA sense strand
auuaguucacagucaaacaag

SEQ ID NO: 1401 - RNA, 21 nt, Artificial Sequence
  Ebola virus siRNA sense strand
uuaguucacagucaaacaagc

SEQ ID NO: 1402 - RNA, 21 nt, Artificial Sequence
  Ebola virus siRNA sense strand
uaguucacagucaaacaagca

SEQ ID NO: 1403 - RNA, 21 nt, Artificial Sequence
  Ebola virus siRNA sense strand
aguucacagucaaacaagcaa

SEQ ID NO: 1404 - RNA, 21 nt, Artificial Sequence
  Ebola virus siRNA sense strand
guucacagucaaacaagcaag

SEQ ID NO: 1405 - RNA, 21 nt, Artificial Sequence
  Ebola virus siRNA sense strand
uucacagucaaacaagcaaga

SEQ ID NO: 1406 - RNA, 21 nt, Artificial Sequence
  Ebola virus siRNA sense strand
ucacagucaaacaagcaagau

SEQ ID NO: 1407 - RNA, 21 nt, Artificial Sequence
  Ebola virus siRNA sense strand
cacagucaaacaagcaagauu

SEQ ID NO: 1408 - RNA, 21 nt, Artificial Sequence
  Ebola virus siRNA sense strand
acagucaaacaagcaagauug

SEQ ID NO: 1409 - RNA, 21 nt, Artificial Sequence
  Ebola virus siRNA sense strand
cagucaaacaagcaagauuga

SEQ ID NO: 1410 - RNA, 21 nt, Artificial Sequence
  Ebola virus siRNA sense strand
agucaaacaagcaagauugag

SEQ ID NO: 1411 - RNA, 21 nt, Artificial Sequence
  Ebola virus siRNA sense strand
gucaaacaagcaagauugaga

SEQ ID NO: 1412 - RNA, 21 nt, Artificial Sequence
  Ebola virus siRNA sense strand
ucaaacaagcaagauugagaa

SEQ ID NO: 1413 - RNA, 21 nt, Artificial Sequence
  Ebola virus siRNA sense strand
caaacaagcaagauugagaau

SEQ ID NO: 1414 - RNA, 21 nt, Artificial Sequence
  Ebola virus siRNA sense strand
aaacaagcaagauugagaauu

SEQ ID NO: 1415 - RNA, 21 nt, Artificial Sequence
  Ebola virus siRNA sense strand
aacaagcaagauugagaauua

SEQ ID NO: 1416 - RNA, 21 nt, Artificial Sequence
  Ebola virus siRNA sense strand
acaagcaagauugagaauuaa

SEQ ID NO: 1417 - RNA, 21 nt, Artificial Sequence
  Ebola virus siRNA sense strand
caagcaagauugagaauuaac

SEQ ID NO: 1418 - RNA, 21 nt, Artificial Sequence
  Ebola virus siRNA sense strand
aagcaagauugagaauuaacc

SEQ ID NO: 1419 - RNA, 21 nt, Artificial Sequence
  Ebola virus siRNA sense strand
agcaagauugagaauuaaccu

SEQ ID NO: 1420 - RNA, 21 nt, Artificial Sequence
  Ebola virus siRNA sense strand
gcaagauugagaauuaaccuu

SEQ ID NO: 1421 - RNA, 21 nt, Artificial Sequence
  Ebola virus siRNA sense strand
caagauugagaauuaaccuug

SEQ ID NO: 1422 - RNA, 21 nt, Artificial Sequence
  Ebola virus siRNA sense strand
aagauugagaauuaaccuugg

SEQ ID NO: 1423 - RNA, 21 nt, Artificial Sequence
  Ebola virus siRNA sense strand
agauugagaauuaaccuuggu

SEQ ID NO: 1424 - RNA, 21 nt, Artificial Sequence
  Ebola virus siRNA sense strand
gauugagaauuaaccuugguu

SEQ ID NO: 1425 - RNA, 21 nt, Artificial Sequence
  Ebola virus siRNA sense strand
auugagaauuaaccuugguuu

SEQ ID NO: 1426 - RNA, 21 nt, Artificial Sequence
  Ebola virus siRNA sense strand
uugagaauuaaccuugguuuu

SEQ ID NO: 1427 - RNA, 21 nt, Artificial Sequence
  Ebola virus siRNA sense strand
ugagaauuaaccuugguuuug

SEQ ID NO: 1428 - RNA, 21 nt, Artificial Sequence
  Ebola virus siRNA sense strand
gagaauuaaccuugguuuuga

SEQ ID NO: 1429 - RNA, 21 nt, Artificial Sequence
  Ebola virus siRNA sense strand
agaauuaaccuugguuuugaa

SEQ ID NO: 1430 - RNA, 21 nt, Artificial Sequence
  Ebola virus siRNA sense strand
gaauuaaccuugguuuugaac

SEQ ID NO: 1431 - RNA, 21 nt, Artificial Sequence
  Ebola virus siRNA sense strand
aauuaaccuugguuuugaacu

SEQ ID NO: 1432 - RNA, 21 nt, Artificial Sequence
  Ebola virus siRNA sense strand
auuaaccuugguuuugaacuu

SEQ ID NO: 1433 - RNA, 21 nt, Artificial Sequence
  Ebola virus siRNA sense strand
uuaaccuugguuuugaacuug

SEQ ID NO: 1434 - RNA, 21 nt, Artificial Sequence
  Ebola virus siRNA sense strand
uaaccuugguuuugaacuuga

SEQ ID NO: 1435 - RNA, 21 nt, Artificial Sequence
  Ebola virus siRNA sense strand
aaccuugguuuugaacuugaa

SEQ ID NO: 1436 - RNA, 21 nt, Artificial Sequence
  Ebola virus siRNA sense strand
accuugguuuugaacuugaac

SEQ ID NO: 1437 - RNA, 21 nt, Artificial Sequence
  Ebola virus siRNA sense strand
ccuugguuuugaacuugaaca

SEQ ID NO: 1438 - RNA, 21 nt, Artificial Sequence
  Ebola virus siRNA sense strand
cuugguuuugaacuugaacac

SEQ ID NO: 1439 - RNA, 21 nt, Artificial Sequence
  Ebola virus siRNA sense strand
uugguuuugaacuugaacacu

SEQ ID NO: 1440 - RNA, 21 nt, Artificial Sequence
  Ebola virus siRNA sense strand
ugguuuugaacuugaacacuu

SEQ ID NO: 1441 - RNA, 21 nt, Artificial Sequence
  Ebola virus siRNA sense strand
gguuuugaacuugaacacuua

SEQ ID NO: 1442 - RNA, 21 nt, Artificial Sequence
  Ebola virus siRNA sense strand
guuuugaacuugaacacuuag

SEQ ID NO: 1443 - RNA, 21 nt, Artificial Sequence
  Ebola virus siRNA sense strand
uuuugaacuugaacacuuagg

SEQ ID NO: 1444 - RNA, 21 nt, Artificial Sequence
  Ebola virus siRNA sense strand
uuugaacuugaacacuuaggg

SEQ ID NO: 1445 - RNA, 21 nt, Artificial Sequence
  Ebola virus siRNA sense strand
uugaacuugaacacuuagggg

SEQ ID NO: 1446 - RNA, 21 nt, Artificial Sequence
  Ebola virus siRNA sense strand
ugaacuugaacacuuagggga

SEQ ID NO: 1447 - RNA, 21 nt, Artificial Sequence
  Ebola virus siRNA sense strand
gaacuugaacacuuaggggau

SEQ ID NO: 1448 - RNA, 21 nt, Artificial Sequence
  Ebola virus siRNA sense strand
aacuugaacacuuaggggauu

SEQ ID NO: 1449 - RNA, 21 nt, Artificial Sequence
  Ebola virus siRNA sense strand
acuugaacacuuaggggauug

SEQ ID NO: 1450 - RNA, 21 nt, Artificial Sequence
  Ebola virus siRNA sense strand
cuugaacacuuaggggauuga

SEQ ID NO: 1451 - RNA, 21 nt, Artificial Sequence
  Ebola virus siRNA sense strand
uugaacacuuaggggauugaa

SEQ ID NO: 1452 - RNA, 21 nt, Artificial Sequence
  Ebola virus siRNA sense strand
ugaacacuuaggggauugaag

SEQ ID NO: 1453 - RNA, 21 nt, Artificial Sequence
  Ebola virus siRNA sense strand
gaacacuuaggggauugaaga

SEQ ID NO: 1454 - RNA, 21 nt, Artificial Sequence
  Ebola virus siRNA sense strand
aacacuuaggggauugaagau

SEQ ID NO: 1455 - RNA, 21 nt, Artificial Sequence
  Ebola virus siRNA sense strand
acacuuaggggauugaagauu

SEQ ID NO: 1456 - RNA, 21 nt, Artificial Sequence
  Ebola virus siRNA sense strand
cacuuaggggauugaagauuc

SEQ ID NO: 1457 - RNA, 21 nt, Artificial Sequence
  Ebola virus siRNA sense strand
acuuaggggauugaagauuca

SEQ ID NO: 1458 - RNA, 21 nt, Artificial Sequence
  Ebola virus siRNA sense strand
cuuaggggauugaagauucaa

SEQ ID NO: 1459 - RNA, 21 nt, Artificial Sequence
  Ebola virus siRNA sense strand
uuaggggauugaagauucaac

SEQ ID NO: 1460 - RNA, 21 nt, Artificial Sequence
  Ebola virus siRNA sense strand
uaggggauugaagauucaaca

SEQ ID NO: 1461 - RNA, 21 nt, Artificial Sequence
  Ebola virus siRNA sense strand
aggggauugaagauucaacaa

SEQ ID NO: 1462 - RNA, 21 nt, Artificial Sequence
  Ebola virus siRNA sense strand
ggggauugaagauucaacaac

SEQ ID NO: 1463 - RNA, 21 nt, Artificial Sequence
  Ebola virus siRNA sense strand
gggauugaagauucaacaacc

SEQ ID NO: 1464 - RNA, 21 nt, Artificial Sequence
  Ebola virus siRNA sense strand
ggauugaagauucaacaaccc

SEQ ID NO: 1465 - RNA, 21 nt, Artificial Sequence
  Ebola virus siRNA sense strand
gauugaagauucaacaacccu

SEQ ID NO: 1466 - RNA, 21 nt, Artificial Sequence
  Ebola virus siRNA sense strand
auugaagauucaacaacccua

SEQ ID NO: 1467 - RNA, 21 nt, Artificial Sequence
  Ebola virus siRNA sense strand
uugaagauucaacaacccuaa

SEQ ID NO: 1468 - RNA, 21 nt, Artificial Sequence
  Ebola virus siRNA sense strand
ugaagauucaacaacccuaaa

SEQ ID NO: 1469 - RNA, 21 nt, Artificial Sequence
  Ebola virus siRNA sense strand
gaagauucaacaacccuaaag

SEQ ID NO: 1470 - RNA, 21 nt, Artificial Sequence
  Ebola virus siRNA sense strand
aagauucaacaacccuaaagc

SEQ ID NO: 1471 - RNA, 21 nt, Artificial Sequence
  Ebola virus siRNA sense strand
agauucaacaacccuaaagcu

SEQ ID NO: 1472 - RNA, 21 nt, Artificial Sequence
  Ebola virus siRNA sense strand
gauucaacaacccuaaagcuu

SEQ ID NO: 1473 - RNA, 21 nt, Artificial Sequence
  Ebola virus siRNA sense strand
auucaacaacccuaaagcuug

SEQ ID NO: 1474 - RNA, 21 nt, Artificial Sequence
  Ebola virus siRNA sense strand
uucaacaacccuaaagcuugg

SEQ ID NO: 1475 - RNA, 21 nt, Artificial Sequence
  Ebola virus siRNA sense strand
ucaacaacccuaaagcuuggg

SEQ ID NO: 1476 - RNA, 21 nt, Artificial Sequence
  Ebola virus siRNA sense strand
caacaacccuaaagcuugggg

SEQ ID NO: 1477 - RNA, 21 nt, Artificial Sequence
  Ebola virus siRNA sense strand
aacaacccuaaagcuuggggu

SEQ ID NO: 1478 - RNA, 21 nt, Artificial Sequence
  Ebola virus siRNA sense strand
acaacccuaaagcuuggggua

SEQ ID NO: 1479 - RNA, 21 nt, Artificial Sequence
  Ebola virus siRNA sense strand
caacccuaaagcuugggguaa

SEQ ID NO: 1480 - RNA, 21 nt, Artificial Sequence
  Ebola virus siRNA sense strand
aacccuaaagcuugggguaaa

SEQ ID NO: 1481 - RNA, 21 nt, Artificial Sequence
  Ebola virus siRNA sense strand
acccuaaagcuugggguaaaa

SEQ ID NO: 1482 - RNA, 21 nt, Artificial Sequence
  Ebola virus siRNA sense strand
cccuaaagcuugggguaaaac

SEQ ID NO: 1483 - RNA, 21 nt, Artificial Sequence
  Ebola virus siRNA sense strand
ccuaaagcuugggguaaaaca

SEQ ID NO: 1484 - RNA, 21 nt, Artificial Sequence
  Ebola virus siRNA sense strand
cuaaagcuugggguaaaacau

SEQ ID NO: 1485 - RNA, 21 nt, Artificial Sequence
  Ebola virus siRNA sense strand
uaaagcuugggguaaaacauu

SEQ ID NO: 1486 - RNA, 21 nt, Artificial Sequence
  Ebola virus siRNA sense strand
aaagcuugggguaaaacauug

SEQ ID NO: 1487 - RNA, 21 nt, Artificial Sequence
  Ebola virus siRNA sense strand
aagcuugggguaaaacauugg

SEQ ID NO: 1488 - RNA, 21 nt, Artificial Sequence
  Ebola virus siRNA sense strand
agcuugggguaaaacauugga

SEQ ID NO: 1489 - RNA, 21 nt, Artificial Sequence
  Ebola virus siRNA sense strand
gcuugggguaaaacauuggaa

SEQ ID NO: 1490 - RNA, 21 nt, Artificial Sequence
  Ebola virus siRNA sense strand
cuugggguaaaacauuggaaa

SEQ ID NO: 1491 - RNA, 21 nt, Artificial Sequence
  Ebola virus siRNA sense strand
uugggguaaaacauuggaaau

SEQ ID NO: 1492 - RNA, 21 nt, Artificial Sequence
  Ebola virus siRNA sense strand
ugggguaaaacauuggaaaua

SEQ ID NO: 1493 - RNA, 21 nt, Artificial Sequence
  Ebola virus siRNA sense strand
gggguaaaacauuggaaauag

SEQ ID NO: 1494 - RNA, 21 nt, Artificial Sequence
  Ebola virus siRNA sense strand
ggguaaaacauuggaaauagu

SEQ ID NO: 1495 - RNA, 21 nt, Artificial Sequence
  Ebola virus siRNA sense strand
gguaaaacauuggaaauaguu

SEQ ID NO: 1496 - RNA, 21 nt, Artificial Sequence
  Ebola virus siRNA sense strand
guaaaacauuggaaauaguua

SEQ ID NO: 1497 - RNA, 21 nt, Artificial Sequence
  Ebola virus siRNA sense strand
uaaaacauuggaaauaguuaa

SEQ ID NO: 1498 - RNA, 21 nt, Artificial Sequence
  Ebola virus siRNA sense strand
aaaacauuggaaauaguuaaa

SEQ ID NO: 1499 - RNA, 21 nt, Artificial Sequence
  Ebola virus siRNA sense strand
aaacauuggaaauaguuaaaa

SEQ ID NO: 1500 - RNA, 21 nt, Artificial Sequence
  Ebola virus siRNA sense strand
aacauuggaaauaguuaaaag

SEQ ID NO: 1501 - RNA, 21 nt, Artificial Sequence
  Ebola virus siRNA sense strand
acauuggaaauaguuaaaaga

SEQ ID NO: 1502 - RNA, 21 nt, Artificial Sequence
  Ebola virus siRNA sense strand
cauuggaaauaguuaaaagac

SEQ ID NO: 1503 - RNA, 21 nt, Artificial Sequence
  Ebola virus siRNA sense strand
auuggaaauaguuaaaagaca

SEQ ID NO: 1504 - RNA, 21 nt, Artificial Sequence
  Ebola virus siRNA sense strand
uuggaaauaguuaaaagacaa

SEQ ID NO: 1505 - RNA, 21 nt, Artificial Sequence
  Ebola virus siRNA sense strand
uggaaauaguuaaaagacaaa

SEQ ID NO: 1506 - RNA, 21 nt, Artificial Sequence
  Ebola virus siRNA sense strand
ggaaauaguuaaaagacaaau

SEQ ID NO: 1507 - RNA, 21 nt, Artificial Sequence
  Ebola virus siRNA sense strand
gaaauaguuaaaagacaaauu

SEQ ID NO: 1508 - RNA, 21 nt, Artificial Sequence
  Ebola virus siRNA sense strand
aaauaguuaaaagacaaauug

SEQ ID NO: 1509 - RNA, 21 nt, Artificial Sequence
  Ebola virus siRNA sense strand
aauaguuaaaagacaaauugc

SEQ ID NO: 1510 - RNA, 21 nt, Artificial Sequence
  Ebola virus siRNA sense strand
auaguuaaaagacaaauugcu

SEQ ID NO: 1511 - RNA, 21 nt, Artificial Sequence
  Ebola virus siRNA sense strand
uaguuaaaagacaaauugcuc

SEQ ID NO: 1512 - RNA, 21 nt, Artificial Sequence
  Ebola virus siRNA sense strand
aguuaaaagacaaauugcucg

SEQ ID NO: 1513 - RNA, 21 nt, Artificial Sequence
  Ebola virus siRNA sense strand
guuaaaagacaaauugcucgg

SEQ ID NO: 1514 - RNA, 21 nt, Artificial Sequence
  Ebola virus siRNA sense strand
uuaaaagacaaauugcucgga

SEQ ID NO: 1515 - RNA, 21 nt, Artificial Sequence
  Ebola virus siRNA sense strand
uaaaagacaaauugcucggaa

SEQ ID NO: 1516 - RNA, 21 nt, Artificial Sequence
  Ebola virus siRNA sense strand
aaaagacaaauugcucggaau

SEQ ID NO: 1517 - RNA, 21 nt, Artificial Sequence
  Ebola virus siRNA sense strand
aaagacaaauugcucggaauc

SEQ ID NO: 1518 - RNA, 21 nt, Artificial Sequence
  Ebola virus siRNA sense strand
aagacaaauugcucggaauca

SEQ ID NO: 1519 - RNA, 21 nt, Artificial Sequence
  Ebola virus siRNA sense strand
agacaaauugcucggaaucac

SEQ ID NO: 1520 - RNA, 21 nt, Artificial Sequence
  Ebola virus siRNA sense strand
gacaaauugcucggaaucaca

SEQ ID NO: 1521 - RNA, 21 nt, Artificial Sequence
  Ebola virus siRNA sense strand
acaaauugcucggaaucacaa

SEQ ID NO: 1522 - RNA, 21 nt, Artificial Sequence
  Ebola virus siRNA sense strand
caaauugcucggaaucacaaa

SEQ ID NO: 1523 - RNA, 21 nt, Artificial Sequence
  Ebola virus siRNA sense strand
aaauugcucggaaucacaaaa

SEQ ID NO: 1524 - RNA, 21 nt, Artificial Sequence
  Ebola virus siRNA sense strand
aauugcucggaaucacaaaau

SEQ ID NO: 1525 - RNA, 21 nt, Artificial Sequence
  Ebola virus siRNA sense strand
auugcucggaaucacaaaauu

SEQ ID NO: 1526 - RNA, 21 nt, Artificial Sequence
  Ebola virus siRNA sense strand
uugcucggaaucacaaaauuc

SEQ ID NO: 1527 - RNA, 21 nt, Artificial Sequence
  Ebola virus siRNA sense strand
ugcucggaaucacaaaauucc

SEQ ID NO: 1528 - RNA, 21 nt, Artificial Sequence
  Ebola virus siRNA sense strand
gcucggaaucacaaaauuccg

SEQ ID NO: 1529 - RNA, 21 nt, Artificial Sequence
  Ebola virus siRNA sense strand
cucggaaucacaaaauuccga

SEQ ID NO: 1530 - RNA, 21 nt, Artificial Sequence
  Ebola virus siRNA sense strand
ucggaaucacaaaauuccgag

SEQ ID NO: 1531 - RNA, 21 nt, Artificial Sequence
  Ebola virus siRNA sense strand
cggaaucacaaaauuccgagu

SEQ ID NO: 1532 - RNA, 21 nt, Artificial Sequence
  Ebola virus siRNA sense strand
ggaaucacaaaauuccgagua

SEQ ID NO: 1533 - RNA, 21 nt, Artificial Sequence
  Ebola virus siRNA sense strand
gaaucacaaaauuccgaguau

SEQ ID NO: 1534 - RNA, 21 nt, Artificial Sequence
  Ebola virus siRNA sense strand
aaucacaaaauuccgaguaug

SEQ ID NO: 1535 - RNA, 21 nt, Artificial Sequence
  Ebola virus siRNA sense strand
aucacaaaauuccgaguaugg

SEQ ID NO: 1536 - RNA, 21 nt, Artificial Sequence
  Ebola virus siRNA sense strand
ucacaaaauuccgaguaugga

SEQ ID NO: 1537 - RNA, 21 nt, Artificial Sequence
  Ebola virus siRNA sense strand
cacaaaauuccgaguauggau

SEQ ID NO: 1538 - RNA, 21 nt, Artificial Sequence
  Ebola virus siRNA sense strand
acaaaauuccgaguauggauu

SEQ ID NO: 1539 - RNA, 21 nt, Artificial Sequence
  Ebola virus siRNA sense strand
caaaauuccgaguauggauuc

SEQ ID NO: 1540 - RNA, 21 nt, Artificial Sequence
  Ebola virus siRNA sense strand
aaaauuccgaguauggauucu

SEQ ID NO: 1541 - RNA, 21 nt, Artificial Sequence
  Ebola virus siRNA sense strand
aaauuccgaguauggauucuc

SEQ ID NO: 1542 - RNA, 21 nt, Artificial Sequence
  Ebola virus siRNA sense strand
aauuccgaguauggauucucg

SEQ ID NO: 1543 - RNA, 21 nt, Artificial Sequence
  Ebola virus siRNA sense strand
auuccgaguauggauucucgu

SEQ ID NO: 1544 - RNA, 21 nt, Artificial Sequence
  Ebola virus siRNA sense strand
uuccgaguauggauucucguc

SEQ ID NO: 1545 - RNA, 21 nt, Artificial Sequence
  Ebola virus siRNA sense strand
uccgaguauggauucucgucc

SEQ ID NO: 1546 - RNA, 21 nt, Artificial Sequence
  Ebola virus siRNA sense strand
ccgaguauggauucucguccu

SEQ ID NO: 1547 - RNA, 21 nt, Artificial Sequence
  Ebola virus siRNA sense strand
cgaguauggauucucguccuc

SEQ ID NO: 1548 - RNA, 21 nt, Artificial Sequence
  Ebola virus siRNA sense strand
gaguauggauucucguccuca

SEQ ID NO: 1549 - RNA, 21 nt, Artificial Sequence
  Ebola virus siRNA sense strand
aguauggauucucguccucag

SEQ ID NO: 1550 - RNA, 21 nt, Artificial Sequence
  Ebola virus siRNA sense strand
guauggauucucguccucaga

SEQ ID NO: 1551 - RNA, 21 nt, Artificial Sequence
  Ebola virus siRNA sense strand
uauggauucucguccucagaa

SEQ ID NO: 1552 - RNA, 21 nt, Artificial Sequence
  Ebola virus siRNA sense strand
auggauucucguccucagaaa

SEQ ID NO: 1553 - RNA, 21 nt, Artificial Sequence
  Ebola virus siRNA sense strand
uggauucucguccucagaaaa

SEQ ID NO: 1554 - RNA, 21 nt, Artificial Sequence
  Ebola virus siRNA sense strand
ggauucucguccucagaaaau

SEQ ID NO: 1555 - RNA, 21 nt, Artificial Sequence
  Ebola virus siRNA sense strand
gauucucguccucagaaaauc

SEQ ID NO: 1556 - RNA, 21 nt, Artificial Sequence
  Ebola virus siRNA sense strand
auucucguccucagaaaaucu

SEQ ID NO: 1557 - RNA, 21 nt, Artificial Sequence
  Ebola virus siRNA sense strand
uucucguccucagaaaaucug

SEQ ID NO: 1558 - RNA, 21 nt, Artificial Sequence
  Ebola virus siRNA sense strand
ucucguccucagaaaaucugg

SEQ ID NO: 1559 - RNA, 21 nt, Artificial Sequence
  Ebola virus siRNA sense strand
cucguccucagaaaaucugga

SEQ ID NO: 1560 - RNA, 21 nt, Artificial Sequence
  Ebola virus siRNA sense strand
ucguccucagaaaaucuggau

SEQ ID NO: 1561 - RNA, 21 nt, Artificial Sequence
  Ebola virus siRNA sense strand
cguccucagaaaaucuggaug

SEQ ID NO: 1562 - RNA, 21 nt, Artificial Sequence
  Ebola virus siRNA sense strand
guccucagaaaaucuggaugg

SEQ ID NO: 1563 - RNA, 21 nt, Artificial Sequence
  Ebola virus siRNA sense strand
uccucagaaaaucuggauggc

SEQ ID NO: 1564 - RNA, 21 nt, Artificial Sequence
  Ebola virus siRNA sense strand
ccucagaaaaucuggauggcg

SEQ ID NO: 1565 - RNA, 21 nt, Artificial Sequence
  Ebola virus siRNA sense strand
cucagaaaaucuggauggcgc

SEQ ID NO: 1566 - RNA, 21 nt, Artificial Sequence
  Ebola virus siRNA sense strand
ucagaaaaucuggauggcgcc

SEQ ID NO: 1567 - RNA, 21 nt, Artificial Sequence
  Ebola virus siRNA sense strand
cagaaaaucuggauggcgccg

SEQ ID NO: 1568 - RNA, 21 nt, Artificial Sequence
  Ebola virus siRNA sense strand
agaaaaucuggauggcgccga

SEQ ID NO: 1569 - RNA, 21 nt, Artificial Sequence
  Ebola virus siRNA sense strand
gaaaaucuggauggcgccgag

SEQ ID NO: 1570 - RNA, 21 nt, Artificial Sequence
  Ebola virus siRNA sense strand
aaaaucuggauggcgccgagu

SEQ ID NO: 1571 - RNA, 21 nt, Artificial Sequence
  Ebola virus siRNA sense strand
aaaucuggauggcgccgaguc

SEQ ID NO: 1572 - RNA, 21 nt, Artificial Sequence
  Ebola virus siRNA sense strand
aaucuggauggcgccgagucu

SEQ ID NO: 1573 - RNA, 21 nt, Artificial Sequence
  Ebola virus siRNA sense strand
aucuggauggcgccgagucuc

SEQ ID NO: 1574 - RNA, 21 nt, Artificial Sequence
  Ebola virus siRNA sense strand
ucuggauggcgccgagucuca

SEQ ID NO: 1575 - RNA, 21 nt, Artificial Sequence
  Ebola virus siRNA sense strand
cuggauggcgccgagucucac

SEQ ID NO: 1576 - RNA, 21 nt, Artificial Sequence
  Ebola virus siRNA sense strand
uggauggcgccgagucucacu

SEQ ID NO: 1577 - RNA, 21 nt, Artificial Sequence
  Ebola virus siRNA sense strand
ggauggcgccgagucucacug

SEQ ID NO: 1578 - RNA, 21 nt, Artificial Sequence
  Ebola virus siRNA sense strand
gauggcgccgagucucacuga

SEQ ID NO: 1579 - RNA, 21 nt, Artificial Sequence
  Ebola virus siRNA sense strand
auggcgccgagucucacugaa

SEQ ID NO: 1580 - RNA, 21 nt, Artificial Sequence
  Ebola virus siRNA sense strand
uggcgccgagucucacugaau

SEQ ID NO: 1581 - RNA, 21 nt, Artificial Sequence
  Ebola virus siRNA sense strand
ggcgccgagucucacugaauc

SEQ ID NO: 1582 - RNA, 21 nt, Artificial Sequence
  Ebola virus siRNA sense strand
gcgccgagucucacugaaucu

SEQ ID NO: 1583 - RNA, 21 nt, Artificial Sequence
  Ebola virus siRNA sense strand
cgccgagucucacugaaucug

SEQ ID NO: 1584 - RNA, 21 nt, Artificial Sequence
  Ebola virus siRNA sense strand
gccgagucucacugaaucuga

SEQ ID NO: 1585 - RNA, 21 nt, Artificial Sequence
  Ebola virus siRNA sense strand
ccgagucucacugaaucugac

SEQ ID NO: 1586 - RNA, 21 nt, Artificial Sequence
  Ebola virus siRNA sense strand
cgagucucacugaaucugaca

SEQ ID NO: 1587 - RNA, 21 nt, Artificial Sequence
  Ebola virus siRNA sense strand
gagucucacugaaucugacau

SEQ ID NO: 1588 - RNA, 21 nt, Artificial Sequence
  Ebola virus siRNA sense strand
agucucacugaaucugacaug

SEQ ID NO: 1589 - RNA, 21 nt, Artificial Sequence
  Ebola virus siRNA sense strand
gucucacugaaucugacaugg

SEQ ID NO: 1590 - RNA, 21 nt, Artificial Sequence
  Ebola virus siRNA sense strand
ucucacugaaucugacaugga

SEQ ID NO: 1591 - RNA, 21 nt, Artificial Sequence
  Ebola virus siRNA sense strand
cucacugaaucugacauggau

SEQ ID NO: 1592 - RNA, 21 nt, Artificial Sequence
  Ebola virus siRNA sense strand
ucacugaaucugacauggauu

SEQ ID NO: 1593 - RNA, 21 nt, Artificial Sequence
  Ebola virus siRNA sense strand
cacugaaucugacauggauua

SEQ ID NO: 1594 - RNA, 21 nt, Artificial Sequence
  Ebola virus siRNA sense strand
acugaaucugacauggauuac

SEQ ID NO: 1595 - RNA, 21 nt, Artificial Sequence
  Ebola virus siRNA sense strand
cugaaucugacauggauuacc

SEQ ID NO: 1596 - RNA, 21 nt, Artificial Sequence
  Ebola virus siRNA sense strand
ugaaucugacauggauuacca

SEQ ID NO: 1597 - RNA, 21 nt, Artificial Sequence
  Ebola virus siRNA sense strand
gaaucugacauggauuaccac

SEQ ID NO: 1598 - RNA, 21 nt, Artificial Sequence
  Ebola virus siRNA sense strand
aaucugacauggauuaccaca

SEQ ID NO: 1599 - RNA, 21 nt, Artificial Sequence
  Ebola virus siRNA sense strand
aucugacauggauuaccacaa

SEQ ID NO: 1600 - RNA, 21 nt, Artificial Sequence
  Ebola virus siRNA sense strand
ucugacauggauuaccacaag

SEQ ID NO: 1601 - RNA, 21 nt, Artificial Sequence
  Ebola virus siRNA sense strand
cugacauggauuaccacaaga

SEQ ID NO: 1602 - RNA, 21 nt, Artificial Sequence
  Ebola virus siRNA sense strand
ugacauggauuaccacaagau

SEQ ID NO: 1603 - RNA, 21 nt, Artificial Sequence
  Ebola virus siRNA sense strand
gacauggauuaccacaagauc

SEQ ID NO: 1604 - RNA, 21 nt, Artificial Sequence
  Ebola virus siRNA sense strand
acauggauuaccacaagaucu

SEQ ID NO: 1605 - RNA, 21 nt, Artificial Sequence
  Ebola virus siRNA sense strand
cauggauuaccacaagaucuu

SEQ ID NO: 1606 - RNA, 21 nt, Artificial Sequence
  Ebola virus siRNA sense strand
auggauuaccacaagaucuug

SEQ ID NO: 1607 - RNA, 21 nt, Artificial Sequence
  Ebola virus siRNA sense strand
uggauuaccacaagaucuuga

SEQ ID NO: 1608 - RNA, 21 nt, Artificial Sequence
  Ebola virus siRNA sense strand
ggauuaccacaagaucuugac

SEQ ID NO: 1609 - RNA, 21 nt, Artificial Sequence
  Ebola virus siRNA sense strand
gauuaccacaagaucuugaca

SEQ ID NO: 1610 - RNA, 21 nt, Artificial Sequence
  Ebola virus siRNA sense strand
auuaccacaagaucuugacag

SEQ ID NO: 1611 - RNA, 21 nt, Artificial Sequence
  Ebola virus siRNA sense strand
uuaccacaagaucuugacagc

SEQ ID NO: 1612 - RNA, 21 nt, Artificial Sequence
  Ebola virus siRNA sense strand
uaccacaagaucuugacagca

SEQ ID NO: 1613 - RNA, 21 nt, Artificial Sequence
  Ebola virus siRNA sense strand
accacaagaucuugacagcag

SEQ ID NO: 1614 - RNA, 21 nt, Artificial Sequence
  Ebola virus siRNA sense strand
ccacaagaucuugacagcagg

SEQ ID NO: 1615 - RNA, 21 nt, Artificial Sequence
  Ebola virus siRNA sense strand
cacaagaucuugacagcaggu

SEQ ID NO: 1616 - RNA, 21 nt, Artificial Sequence
  Ebola virus siRNA sense strand
acaagaucuugacagcagguc

SEQ ID NO: 1617 - RNA, 21 nt, Artificial Sequence
  Ebola virus siRNA sense strand
caagaucuugacagcaggucu

SEQ ID NO: 1618 - RNA, 21 nt, Artificial Sequence
  Ebola virus siRNA sense strand
aagaucuugacagcaggucug

SEQ ID NO: 1619 - RNA, 21 nt, Artificial Sequence
  Ebola virus siRNA sense strand
agaucuugacagcaggucugu

SEQ ID NO: 1620 - RNA, 21 nt, Artificial Sequence
  Ebola virus siRNA sense strand
gaucuugacagcaggucuguc

SEQ ID NO: 1621 - RNA, 21 nt, Artificial Sequence
  Ebola virus siRNA sense strand
aucuugacagcaggucugucc

SEQ ID NO: 1622 - RNA, 21 nt, Artificial Sequence
  Ebola virus siRNA sense strand
ucuugacagcaggucuguccg

SEQ ID NO: 1623 - RNA, 21 nt, Artificial Sequence
  Ebola virus siRNA sense strand
cuugacagcaggucuguccgu

SEQ ID NO: 1624 - RNA, 21 nt, Artificial Sequence
  Ebola virus siRNA sense strand
uugacagcaggucuguccguu

SEQ ID NO: 1625 - RNA, 21 nt, Artificial Sequence
  Ebola virus siRNA sense strand
ugacagcaggucuguccguuc

SEQ ID NO: 1626 - RNA, 21 nt, Artificial Sequence
  Ebola virus siRNA sense strand
gacagcaggucuguccguuca

SEQ ID NO: 1627 - RNA, 21 nt, Artificial Sequence
  Ebola virus siRNA sense strand
acagcaggucuguccguucaa

SEQ ID NO: 1628 - RNA, 21 nt, Artificial Sequence
  Ebola virus siRNA sense strand
cagcaggucuguccguucaac

SEQ ID NO: 1629 - RNA, 21 nt, Artificial Sequence
  Ebola virus siRNA sense strand
agcaggucuguccguucaaca

SEQ ID NO: 1630 - RNA, 21 nt, Artificial Sequence
  Ebola virus siRNA sense strand
gcaggucuguccguucaacag

SEQ ID NO: 1631 - RNA, 21 nt, Artificial Sequence
  Ebola virus siRNA sense strand
caggucuguccguucaacagg

SEQ ID NO: 1632 - RNA, 21 nt, Artificial Sequence
  Ebola virus siRNA sense strand
aggucuguccguucaacaggg

SEQ ID NO: 1633 - RNA, 21 nt, Artificial Sequence
  Ebola virus siRNA sense strand
ggucuguccguucaacagggg

SEQ ID NO: 1634 - RNA, 21 nt, Artificial Sequence
  Ebola virus siRNA sense strand
gucuguccguucaacagggga

SEQ ID NO: 1635 - RNA, 21 nt, Artificial Sequence
  Ebola virus siRNA sense strand
ucuguccguucaacaggggau

SEQ ID NO: 1636 - RNA, 21 nt, Artificial Sequence
  Ebola virus siRNA sense strand
cuguccguucaacaggggauu

SEQ ID NO: 1637 - RNA, 21 nt, Artificial Sequence
  Ebola virus siRNA sense strand
uguccguucaacaggggauug

SEQ ID NO: 1638 - RNA, 21 nt, Artificial Sequence
  Ebola virus siRNA sense strand
guccguucaacaggggauugu

SEQ ID NO: 1639 - RNA, 21 nt, Artificial Sequence
  Ebola virus siRNA sense strand
uccguucaacaggggauuguu

SEQ ID NO: 1640 - RNA, 21 nt, Artificial Sequence
  Ebola virus siRNA sense strand
ccguucaacaggggauuguuc

SEQ ID NO: 1641 - RNA, 21 nt, Artificial Sequence
  Ebola virus siRNA sense strand
cguucaacaggggauuguucg

SEQ ID NO: 1642 - RNA, 21 nt, Artificial Sequence
  Ebola virus siRNA sense strand
guucaacaggggauuguucgg

SEQ ID NO: 1643 - RNA, 21 nt, Artificial Sequence
  Ebola virus siRNA sense strand
uucaacaggggauuguucggc

SEQ ID NO: 1644 - RNA, 21 nt, Artificial Sequence
  Ebola virus siRNA sense strand
ucaacaggggauuguucggca

SEQ ID NO: 1645 - RNA, 21 nt, Artificial Sequence
  Ebola virus siRNA sense strand
caacaggggauuguucggcaa

SEQ ID NO: 1646 - RNA, 21 nt, Artificial Sequence
  Ebola virus siRNA sense strand
aacaggggauuguucggcaaa

SEQ ID NO: 1647 - RNA, 21 nt, Artificial Sequence
  Ebola virus siRNA sense strand
acaggggauuguucggcaaag

SEQ ID NO: 1648 - RNA, 21 nt, Artificial Sequence
  Ebola virus siRNA sense strand
caggggauuguucggcaaaga

SEQ ID NO: 1649 - RNA, 21 nt, Artificial Sequence
  Ebola virus siRNA sense strand
aggggauuguucggcaaagag

SEQ ID NO: 1650 - RNA, 21 nt, Artificial Sequence
  Ebola virus siRNA sense strand
ggggauuguucggcaaagagu

SEQ ID NO: 1651 - RNA, 21 nt, Artificial Sequence
  Ebola virus siRNA sense strand
gggauuguucggcaaagaguc

SEQ ID NO: 1652 - RNA, 21 nt, Artificial Sequence
  Ebola virus siRNA sense strand
ggauuguucggcaaagaguca

SEQ ID NO: 1653 - RNA, 21 nt, Artificial Sequence
  Ebola virus siRNA sense strand
gauuguucggcaaagagucau

SEQ ID NO: 1654 - RNA, 21 nt, Artificial Sequence
  Ebola virus siRNA sense strand
auuguucggcaaagagucauc

SEQ ID NO: 1655 - RNA, 21 nt, Artificial Sequence
  Ebola virus siRNA sense strand
uuguucggcaaagagucaucc

SEQ ID NO: 1656 - RNA, 21 nt, Artificial Sequence
  Ebola virus siRNA sense strand
uguucggcaaagagucauccc

SEQ ID NO: 1657 - RNA, 21 nt, Artificial Sequence
  Ebola virus siRNA sense strand
guucggcaaagagucauccca

SEQ ID NO: 1658 - RNA, 21 nt, Artificial Sequence
  Ebola virus siRNA sense strand
uucggcaaagagucaucccag

SEQ ID NO: 1659 - RNA, 21 nt, Artificial Sequence
  Ebola virus siRNA sense strand
ucggcaaagagucaucccagu

SEQ ID NO: 1660 - RNA, 21 nt, Artificial Sequence
  Ebola virus siRNA sense strand
cggcaaagagucaucccagug

SEQ ID NO: 1661 - RNA, 21 nt, Artificial Sequence
  Ebola virus siRNA sense strand
ggcaaagagucaucccagugu

SEQ ID NO: 1662 - RNA, 21 nt, Artificial Sequence
  Ebola virus siRNA sense strand
gcaaagagucaucccagugua

SEQ ID NO: 1663 - RNA, 21 nt, Artificial Sequence
  Ebola virus siRNA sense strand
caaagagucaucccaguguau

SEQ ID NO: 1664 - RNA, 21 nt, Artificial Sequence
  Ebola virus siRNA sense strand
aaagagucaucccaguguauc

SEQ ID NO: 1665 - RNA, 21 nt, Artificial Sequence
  Ebola virus siRNA sense strand
aagagucaucccaguguauca

SEQ ID NO: 1666 - RNA, 21 nt, Artificial Sequence
  Ebola virus siRNA sense strand
agagucaucccaguguaucaa

SEQ ID NO: 1667 - RNA, 21 nt, Artificial Sequence
  Ebola virus siRNA sense strand
gagucaucccaguguaucaag

SEQ ID NO: 1668 - RNA, 21 nt, Artificial Sequence
  Ebola virus siRNA sense strand
agucaucccaguguaucaagu

SEQ ID NO: 1669 - RNA, 21 nt, Artificial Sequence
  Ebola virus siRNA sense strand
gucaucccaguguaucaagua

SEQ ID NO: 1670 - RNA, 21 nt, Artificial Sequence
  Ebola virus siRNA sense strand
ucaucccaguguaucaaguaa

SEQ ID NO: 1671 - RNA, 21 nt, Artificial Sequence
  Ebola virus siRNA sense strand
caucccaguguaucaaguaaa

SEQ ID NO: 1672 - RNA, 21 nt, Artificial Sequence
  Ebola virus siRNA sense strand
aucccaguguaucaaguaaac

SEQ ID NO: 1673 - RNA, 21 nt, Artificial Sequence
  Ebola virus siRNA sense strand
ucccaguguaucaaguaaaca

SEQ ID NO: 1674 - RNA, 21 nt, Artificial Sequence
  Ebola virus siRNA sense strand
cccaguguaucaaguaaacaa

SEQ ID NO: 1675 - RNA, 21 nt, Artificial Sequence
  Ebola virus siRNA sense strand
ccaguguaucaaguaaacaau

SEQ ID NO: 1676 - RNA, 21 nt, Artificial Sequence
  Ebola virus siRNA sense strand
caguguaucaaguaaacaauc

SEQ ID NO: 1677 - RNA, 21 nt, Artificial Sequence
  Ebola virus siRNA sense strand
aguguaucaaguaaacaaucu

SEQ ID NO: 1678 - RNA, 21 nt, Artificial Sequence
  Ebola virus siRNA sense strand
guguaucaaguaaacaaucuu

SEQ ID NO: 1679 - RNA, 21 nt, Artificial Sequence
  Ebola virus siRNA sense strand
uguaucaaguaaacaaucuug

SEQ ID NO: 1680 - RNA, 21 nt, Artificial Sequence
  Ebola virus siRNA sense strand
guaucaaguaaacaaucuuga

SEQ ID NO: 1681 - RNA, 21 nt, Artificial Sequence
  Ebola virus siRNA sense strand
uaucaaguaaacaaucuugaa

SEQ ID NO: 1682 - RNA, 21 nt, Artificial Sequence
  Ebola virus siRNA sense strand
aucaaguaaacaaucuugaag

SEQ ID NO: 1683 - RNA, 21 nt, Artificial Sequence
  Ebola virus siRNA sense strand
ucaaguaaacaaucuugaaga

SEQ ID NO: 1684 - RNA, 21 nt, Artificial Sequence
  Ebola virus siRNA sense strand
caaguaaacaaucuugaagaa

SEQ ID NO: 1685 - RNA, 21 nt, Artificial Sequence
  Ebola virus siRNA sense strand
aaguaaacaaucuugaagaaa

SEQ ID NO: 1686 - RNA, 21 nt, Artificial Sequence
  Ebola virus siRNA sense strand
aguaaacaaucuugaagaaau

SEQ ID NO: 1687 - RNA, 21 nt, Artificial Sequence
  Ebola virus siRNA sense strand
guaaacaaucuugaagaaauu

SEQ ID NO: 1688 - RNA, 21 nt, Artificial Sequence
  Ebola virus siRNA sense strand
uaaacaaucuugaagaaauuu

SEQ ID NO: 1689 - RNA, 21 nt, Artificial Sequence
  Ebola virus siRNA sense strand
aaacaaucuugaagaaauuug

SEQ ID NO: 1690 - RNA, 21 nt, Artificial Sequence
  Ebola virus siRNA sense strand
aacaaucuugaagaaauuugc

SEQ ID NO: 1691 - RNA, 21 nt, Artificial Sequence
  Ebola virus siRNA sense strand
acaaucuugaagaaauuugcc

SEQ ID NO: 1692 - RNA, 21 nt, Artificial Sequence
  Ebola virus siRNA sense strand
caaucuugaagaaauuugcca

SEQ ID NO: 1693 - RNA, 21 nt, Artificial Sequence
  Ebola virus siRNA sense strand
aaucuugaagaaauuugccaa

SEQ ID NO: 1694 - RNA, 21 nt, Artificial Sequence
  Ebola virus siRNA sense strand
aucuugaagaaauuugccaac

SEQ ID NO: 1695 - RNA, 21 nt, Artificial Sequence
  Ebola virus siRNA sense strand
ucuugaagaaauuugccaacu

SEQ ID NO: 1696 - RNA, 21 nt, Artificial Sequence
  Ebola virus siRNA sense strand
cuugaagaaauuugccaacuu

SEQ ID NO: 1697 - RNA, 21 nt, Artificial Sequence
  Ebola virus siRNA sense strand
uugaagaaauuugccaacuua

SEQ ID NO: 1698 - RNA, 21 nt, Artificial Sequence
  Ebola virus siRNA sense strand
ugaagaaauuugccaacuuau

SEQ ID NO: 1699 - RNA, 21 nt, Artificial Sequence
  Ebola virus siRNA sense strand
gaagaaauuugccaacuuauc

SEQ ID NO: 1700 - RNA, 21 nt, Artificial Sequence
  Ebola virus siRNA sense strand
aagaaauuugccaacuuauca

SEQ ID NO: 1701 - RNA, 21 nt, Artificial Sequence
  Ebola virus siRNA sense strand
agaaauuugccaacuuaucau

SEQ ID NO: 1702 - RNA, 21 nt, Artificial Sequence
  Ebola virus siRNA sense strand
gaaauuugccaacuuaucaua

SEQ ID NO: 1703 - RNA, 21 nt, Artificial Sequence
  Ebola virus siRNA sense strand
aaauuugccaacuuaucauac

SEQ ID NO: 1704 - RNA, 21 nt, Artificial Sequence
  Ebola virus siRNA sense strand
aauuugccaacuuaucauaca

SEQ ID NO: 1705 - RNA, 21 nt, Artificial Sequence
  Ebola virus siRNA sense strand
auuugccaacuuaucauacag

SEQ ID NO: 1706 - RNA, 21 nt, Artificial Sequence
  Ebola virus siRNA sense strand
uuugccaacuuaucauacagg

SEQ ID NO: 1707 - RNA, 21 nt, Artificial Sequence
  Ebola virus siRNA sense strand
uugccaacuuaucauacaggc

SEQ ID NO: 1708 - RNA, 21 nt, Artificial Sequence
  Ebola virus siRNA sense strand
ugccaacuuaucauacaggcc

SEQ ID NO: 1709 - RNA, 21 nt, Artificial Sequence
  Ebola virus siRNA sense strand
gccaacuuaucauacaggccu

SEQ ID NO: 1710 - RNA, 21 nt, Artificial Sequence
  Ebola virus siRNA sense strand
ccaacuuaucauacaggccuu

SEQ ID NO: 1711 - RNA, 21 nt, Artificial Sequence
  Ebola virus siRNA sense strand
caacuuaucauacaggccuuu

SEQ ID NO: 1712 - RNA, 21 nt, Artificial Sequence
  Ebola virus siRNA sense strand
aacuuaucauacaggccuuug

SEQ ID NO: 1713 - RNA, 21 nt, Artificial Sequence
  Ebola virus siRNA sense strand
acuuaucauacaggccuuuga

SEQ ID NO: 1714 - RNA, 21 nt, Artificial Sequence
  Ebola virus siRNA sense strand
cuuaucauacaggccuuugaa

SEQ ID NO: 1715 - RNA, 21 nt, Artificial Sequence
  Ebola virus siRNA sense strand
uuaucauacaggccuuugaag

SEQ ID NO: 1716 - RNA, 21 nt, Artificial Sequence
  Ebola virus siRNA sense strand
uaucauacaggccuuugaagc

SEQ ID NO: 1717 - RNA, 21 nt, Artificial Sequence
  Ebola virus siRNA sense strand
aucauacaggccuuugaagca

SEQ ID NO: 1718 - RNA, 21 nt, Artificial Sequence
  Ebola virus siRNA sense strand
ucauacaggccuuugaagcag

SEQ ID NO: 1719 - RNA, 21 nt, Artificial Sequence
  Ebola virus siRNA sense strand
cauacaggccuuugaagcagg

SEQ ID NO: 1720 - RNA, 21 nt, Artificial Sequence
  Ebola virus siRNA sense strand
auacaggccuuugaagcaggu

SEQ ID NO: 1721 - RNA, 21 nt, Artificial Sequence
  Ebola virus siRNA sense strand
uacaggccuuugaagcaggug

SEQ ID NO: 1722 - RNA, 21 nt, Artificial Sequence
  Ebola virus siRNA sense strand
acaggccuuugaagcaggugu

SEQ ID NO: 1723 - RNA, 21 nt, Artificial Sequence
  Ebola virus siRNA sense strand
caggccuuugaagcagguguu

SEQ ID NO: 1724 - RNA, 21 nt, Artificial Sequence
  Ebola virus siRNA sense strand
aggccuuugaagcagguguug

SEQ ID NO: 1725 - RNA, 21 nt, Artificial Sequence
  Ebola virus siRNA sense strand
ggccuuugaagcagguguuga

SEQ ID NO: 1726 - RNA, 21 nt, Artificial Sequence
  Ebola virus siRNA sense strand
gccuuugaagcagguguugau

SEQ ID NO: 1727 - RNA, 21 nt, Artificial Sequence
  Ebola virus siRNA sense strand
ccuuugaagcagguguugauu

SEQ ID NO: 1728 - RNA, 21 nt, Artificial Sequence
  Ebola virus siRNA sense strand
cuuugaagcagguguugauuu

SEQ ID NO: 1729 - RNA, 21 nt, Artificial Sequence
  Ebola virus siRNA sense strand
uuugaagcagguguugauuuu

SEQ ID NO: 1730 - RNA, 21 nt, Artificial Sequence
  Ebola virus siRNA sense strand
uugaagcagguguugauuuuc

SEQ ID NO: 1731 - RNA, 21 nt, Artificial Sequence
  Ebola virus siRNA sense strand
ugaagcagguguugauuuuca

SEQ ID NO: 1732 - RNA, 21 nt, Artificial Sequence
  Ebola virus siRNA sense strand
gaagcagguguugauuuucaa

SEQ ID NO: 1733 - RNA, 21 nt, Artificial Sequence
  Ebola virus siRNA sense strand
aagcagguguugauuuucaag

SEQ ID NO: 1734 - RNA, 21 nt, Artificial Sequence
  Ebola virus siRNA sense strand
agcagguguugauuuucaaga

SEQ ID NO: 1735 - RNA, 21 nt, Artificial Sequence
  Ebola virus siRNA sense strand
gcagguguugauuuucaagag

SEQ ID NO: 1736 - RNA, 21 nt, Artificial Sequence
  Ebola virus siRNA sense strand
cagguguugauuuucaagaga

SEQ ID NO: 1737 - RNA, 21 nt, Artificial Sequence
  Ebola virus siRNA sense strand
agguguugauuuucaagagag

SEQ ID NO: 1738 - RNA, 21 nt, Artificial Sequence
  Ebola virus siRNA sense strand
gguguugauuuucaagagagu

SEQ ID NO: 1739 - RNA, 21 nt, Artificial Sequence
  Ebola virus siRNA sense strand
guguugauuuucaagagagug

SEQ ID NO: 1740 - RNA, 21 nt, Artificial Sequence
  Ebola virus siRNA sense strand
uguugauuuucaagagagugc

SEQ ID NO: 1741 - RNA, 21 nt, Artificial Sequence
  Ebola virus siRNA sense strand
guugauuuucaagagagugcg

SEQ ID NO: 1742 - RNA, 21 nt, Artificial Sequence
  Ebola virus siRNA sense strand
uugauuuucaagagagugcgg

SEQ ID NO: 1743 - RNA, 21 nt, Artificial Sequence
  Ebola virus siRNA sense strand
ugauuuucaagagagugcgga

SEQ ID NO: 1744 - RNA, 21 nt, Artificial Sequence
  Ebola virus siRNA sense strand
gauuuucaagagagugcggac

SEQ ID NO: 1745 - RNA, 21 nt, Artificial Sequence
  Ebola virus siRNA sense strand
auuuucaagagagugcggaca

SEQ ID NO: 1746 - RNA, 21 nt, Artificial Sequence
  Ebola virus siRNA sense strand
uuuucaagagagugcggacag

SEQ ID NO: 1747 - RNA, 21 nt, Artificial Sequence
  Ebola virus siRNA sense strand
uuucaagagagugcggacagu

SEQ ID NO: 1748 - RNA, 21 nt, Artificial Sequence
  Ebola virus siRNA sense strand
uucaagagagugcggacaguu

SEQ ID NO: 1749 - RNA, 21 nt, Artificial Sequence
  Ebola virus siRNA sense strand
ucaagagagugcggacaguuu

SEQ ID NO: 1750 - RNA, 21 nt, Artificial Sequence
  Ebola virus siRNA sense strand
caagagagugcggacaguuuc

SEQ ID NO: 1751 - RNA, 21 nt, Artificial Sequence
  Ebola virus siRNA sense strand
aagagagugcggacaguuucc

SEQ ID NO: 1752 - RNA, 21 nt, Artificial Sequence
  Ebola virus siRNA sense strand
agagagugcggacaguuuccu

SEQ ID NO: 1753 - RNA, 21 nt, Artificial Sequence
  Ebola virus siRNA sense strand
gagagugcggacaguuuccuu

SEQ ID NO: 1754 - RNA, 21 nt, Artificial Sequence
  Ebola virus siRNA sense strand
agagugcggacaguuuccuuc

SEQ ID NO: 1755 - RNA, 21 nt, Artificial Sequence
  Ebola virus siRNA sense strand
gagugcggacaguuuccuucu

SEQ ID NO: 1756 - RNA, 21 nt, Artificial Sequence
  Ebola virus siRNA sense strand
agugcggacaguuuccuucuc

SEQ ID NO: 1757 - RNA, 21 nt, Artificial Sequence
  Ebola virus siRNA sense strand
gugcggacaguuuccuucuca

SEQ ID NO: 1758 - RNA, 21 nt, Artificial Sequence
  Ebola virus siRNA sense strand
ugcggacaguuuccuucucau

SEQ ID NO: 1759 - RNA, 21 nt, Artificial Sequence
  Ebola virus siRNA sense strand
gcggacaguuuccuucucaug

SEQ ID NO: 1760 - RNA, 21 nt, Artificial Sequence
  Ebola virus siRNA sense strand
cggacaguuuccuucucaugc

SEQ ID NO: 1761 - RNA, 21 nt, Artificial Sequence
  Ebola virus siRNA sense strand
ggacaguuuccuucucaugcu

SEQ ID NO: 1762 - RNA, 21 nt, Artificial Sequence
  Ebola virus siRNA sense strand
gacaguuuccuucucaugcuu

SEQ ID NO: 1763 - RNA, 21 nt, Artificial Sequence
  Ebola virus siRNA sense strand
acaguuuccuucucaugcuuu

SEQ ID NO: 1764 - RNA, 21 nt, Artificial Sequence
  Ebola virus siRNA sense strand
caguuuccuucucaugcuuug

SEQ ID NO: 1765 - RNA, 21 nt, Artificial Sequence
  Ebola virus siRNA sense strand
aguuuccuucucaugcuuugu

SEQ ID NO: 1766 - RNA, 21 nt, Artificial Sequence
  Ebola virus siRNA sense strand
guuuccuucucaugcuuuguc

SEQ ID NO: 1767 - RNA, 21 nt, Artificial Sequence
  Ebola virus siRNA sense strand
uuuccuucucaugcuuugucu

SEQ ID NO: 1768 - RNA, 21 nt, Artificial Sequence
  Ebola virus siRNA sense strand
uuccuucucaugcuuugucuu

SEQ ID NO: 1769 - RNA, 21 nt, Artificial Sequence
  Ebola virus siRNA sense strand
uccuucucaugcuuugucuuc

SEQ ID NO: 1770 - RNA, 21 nt, Artificial Sequence
  Ebola virus siRNA sense strand
ccuucucaugcuuugucuuca

SEQ ID NO: 1771 - RNA, 21 nt, Artificial Sequence
  Ebola virus siRNA sense strand
cuucucaugcuuugucuucau

SEQ ID NO: 1772 - RNA, 21 nt, Artificial Sequence
  Ebola virus siRNA sense strand
uucucaugcuuugucuucauc

SEQ ID NO: 1773 - RNA, 21 nt, Artificial Sequence
  Ebola virus siRNA sense strand
ucucaugcuuugucuucauca

SEQ ID NO: 1774 - RNA, 21 nt, Artificial Sequence
  Ebola virus siRNA sense strand
cucaugcuuugucuucaucau

SEQ ID NO: 1775 - RNA, 21 nt, Artificial Sequence
  Ebola virus siRNA sense strand
ucaugcuuugucuucaucaug

SEQ ID NO: 1776 - RNA, 21 nt, Artificial Sequence
  Ebola virus siRNA sense strand
caugcuuugucuucaucaugc

SEQ ID NO: 1777 - RNA, 21 nt, Artificial Sequence
  Ebola virus siRNA sense strand
augcuuugucuucaucaugcg

SEQ ID NO: 1778 - RNA, 21 nt, Artificial Sequence
  Ebola virus siRNA sense strand
ugcuuugucuucaucaugcgu

SEQ ID NO: 1779 - RNA, 21 nt, Artificial Sequence
  Ebola virus siRNA sense strand
gcuuugucuucaucaugcgua

SEQ ID NO: 1780 - RNA, 21 nt, Artificial Sequence
  Ebola virus siRNA sense strand
cuuugucuucaucaugcguac

SEQ ID NO: 1781 - RNA, 21 nt, Artificial Sequence
  Ebola virus siRNA sense strand
uuugucuucaucaugcguacc

SEQ ID NO: 1782 - RNA, 21 nt, Artificial Sequence
  Ebola virus siRNA sense strand
uugucuucaucaugcguacca

SEQ ID NO: 1783 - RNA, 21 nt, Artificial Sequence
  Ebola virus siRNA sense strand
ugucuucaucaugcguaccag

SEQ ID NO: 1784 - RNA, 21 nt, Artificial Sequence
  Ebola virus siRNA sense strand
gucuucaucaugcguaccagg

SEQ ID NO: 1785 - RNA, 21 nt, Artificial Sequence
  Ebola virus siRNA sense strand
ucuucaucaugcguaccaggg

SEQ ID NO: 1786 - RNA, 21 nt, Artificial Sequence
  Ebola virus siRNA sense strand
cuucaucaugcguaccaggga

SEQ ID NO: 1787 - RNA, 21 nt, Artificial Sequence
  Ebola virus siRNA sense strand
uucaucaugcguaccagggag

SEQ ID NO: 1788 - RNA, 21 nt, Artificial Sequence
  Ebola virus siRNA sense strand
ucaucaugcguaccagggaga

SEQ ID NO: 1789 - RNA, 21 nt, Artificial Sequence
  Ebola virus siRNA sense strand
caucaugcguaccagggagau

SEQ ID NO: 1790 - RNA, 21 nt, Artificial Sequence
  Ebola virus siRNA sense strand
aucaugcguaccagggagauu

SEQ ID NO: 1791 - RNA, 21 nt, Artificial Sequence
  Ebola virus siRNA sense strand
ucaugcguaccagggagauua

SEQ ID NO: 1792 - RNA, 21 nt, Artificial Sequence
  Ebola virus siRNA sense strand
caugcguaccagggagauuac

SEQ ID NO: 1793 - RNA, 21 nt, Artificial Sequence
  Ebola virus siRNA sense strand
augcguaccagggagauuaca

SEQ ID NO: 1794 - RNA, 21 nt, Artificial Sequence
  Ebola virus siRNA sense strand
ugcguaccagggagauuacaa

SEQ ID NO: 1795 - RNA, 21 nt, Artificial Sequence
  Ebola virus siRNA sense strand
gcguaccagggagauuacaaa

SEQ ID NO: 1796 - RNA, 21 nt, Artificial Sequence
  Ebola virus siRNA sense strand
cguaccagggagauuacaaac

SEQ ID NO: 1797 - RNA, 21 nt, Artificial Sequence
  Ebola virus siRNA sense strand
guaccagggagauuacaaacu

SEQ ID NO: 1798 - RNA, 21 nt, Artificial Sequence
  Ebola virus siRNA sense strand
uaccagggagauuacaaacuu

SEQ ID NO: 1799 - RNA, 21 nt, Artificial Sequence
  Ebola virus siRNA sense strand
accagggagauuacaaacuuu

SEQ ID NO: 1800 - RNA, 21 nt, Artificial Sequence
  Ebola virus siRNA sense strand
ccagggagauuacaaacuuuu

SEQ ID NO: 1801 - RNA, 21 nt, Artificial Sequence
  Ebola virus siRNA sense strand
cagggagauuacaaacuuuuc

SEQ ID NO: 1802 - RNA, 21 nt, Artificial Sequence
  Ebola virus siRNA sense strand
agggagauuacaaacuuuucu

SEQ ID NO: 1803 - RNA, 21 nt, Artificial Sequence
  Ebola virus siRNA sense strand
gggagauuacaaacuuuucuu

SEQ ID NO: 1804 - RNA, 21 nt, Artificial Sequence
  Ebola virus siRNA sense strand
ggagauuacaaacuuuucuug

SEQ ID NO: 1805 - RNA, 21 nt, Artificial Sequence
  Ebola virus siRNA sense strand
gagauuacaaacuuuucuugg

SEQ ID NO: 1806 - RNA, 21 nt, Artificial Sequence
  Ebola virus siRNA sense strand
agauuacaaacuuuucuugga

SEQ ID NO: 1807 - RNA, 21 nt, Artificial Sequence
  Ebola virus siRNA sense strand
gauuacaaacuuuucuuggaa

SEQ ID NO: 1808 - RNA, 21 nt, Artificial Sequence
  Ebola virus siRNA sense strand
auuacaaacuuuucuuggaaa

SEQ ID NO: 1809 - RNA, 21 nt, Artificial Sequence
  Ebola virus siRNA sense strand
uuacaaacuuuucuuggaaag

SEQ ID NO: 1810 - RNA, 21 nt, Artificial Sequence
  Ebola virus siRNA sense strand
uacaaacuuuucuuggaaagu

SEQ ID NO: 1811 - RNA, 21 nt, Artificial Sequence
  Ebola virus siRNA sense strand
acaaacuuuucuuggaaagug

SEQ ID NO: 1812 - RNA, 21 nt, Artificial Sequence
  Ebola virus siRNA sense strand
caaacuuuucuuggaaagugg

SEQ ID NO: 1813 - RNA, 21 nt, Artificial Sequence
  Ebola virus siRNA sense strand
aaacuuuucuuggaaaguggc

SEQ ID NO: 1814 - RNA, 21 nt, Artificial Sequence
  Ebola virus siRNA sense strand
aacuuuucuuggaaaguggcg

SEQ ID NO: 1815 - RNA, 21 nt, Artificial Sequence
  Ebola virus siRNA sense strand
acuuuucuuggaaaguggcgc

SEQ ID NO: 1816 - RNA, 21 nt, Artificial Sequence
  Ebola virus siRNA sense strand
cuuuucuuggaaaguggcgca

SEQ ID NO: 1817 - RNA, 21 nt, Artificial Sequence
  Ebola virus siRNA sense strand
uuuucuuggaaaguggcgcag

SEQ ID NO: 1818 - RNA, 21 nt, Artificial Sequence
  Ebola virus siRNA sense strand
uuucuuggaaaguggcgcagu

SEQ ID NO: 1819 - RNA, 21 nt, Artificial Sequence
  Ebola virus siRNA sense strand
uucuuggaaaguggcgcaguc

SEQ ID NO: 1820 - RNA, 21 nt, Artificial Sequence
  Ebola virus siRNA sense strand
ucuuggaaaguggcgcaguca

SEQ ID NO: 1821 - RNA, 21 nt, Artificial Sequence
  Ebola virus siRNA sense strand
cuuggaaaguggcgcagucaa

SEQ ID NO: 1822 - RNA, 21 nt, Artificial Sequence
  Ebola virus siRNA sense strand
uuggaaaguggcgcagucaag

SEQ ID NO: 1823 - RNA, 21 nt, Artificial Sequence
  Ebola virus siRNA sense strand
uggaaaguggcgcagucaagu

SEQ ID NO: 1824 - RNA, 21 nt, Artificial Sequence
  Ebola virus siRNA sense strand
ggaaaguggcgcagucaagua

SEQ ID NO: 1825 - RNA, 21 nt, Artificial Sequence
  Ebola virus siRNA sense strand
gaaaguggcgcagucaaguau

SEQ ID NO: 1826 - RNA, 21 nt, Artificial Sequence
  Ebola virus siRNA sense strand
aaaguggcgcagucaaguauu

SEQ ID NO: 1827 - RNA, 21 nt, Artificial Sequence
  Ebola virus siRNA sense strand
aaguggcgcagucaaguauuu

SEQ ID NO: 1828 - RNA, 21 nt, Artificial Sequence
  Ebola virus siRNA sense strand
aguggcgcagucaaguauuug

SEQ ID NO: 1829 - RNA, 21 nt, Artificial Sequence
  Ebola virus siRNA sense strand
guggcgcagucaaguauuugg

SEQ ID NO: 1830 - RNA, 21 nt, Artificial Sequence
  Ebola virus siRNA sense strand
uggcgcagucaaguauuugga

SEQ ID NO: 1831 - RNA, 21 nt, Artificial Sequence
  Ebola virus siRNA sense strand
ggcgcagucaaguauuuggaa

SEQ ID NO: 1832 - RNA, 21 nt, Artificial Sequence
  Ebola virus siRNA sense strand
gcgcagucaaguauuuggaag

SEQ ID NO: 1833 - RNA, 21 nt, Artificial Sequence
  Ebola virus siRNA sense strand
cgcagucaaguauuuggaagg

SEQ ID NO: 1834 - RNA, 21 nt, Artificial Sequence
  Ebola virus siRNA sense strand
gcagucaaguauuuggaaggg

SEQ ID NO: 1835 - RNA, 21 nt, Artificial Sequence
  Ebola virus siRNA sense strand
cagucaaguauuuggaagggc

SEQ ID NO: 1836 - RNA, 21 nt, Artificial Sequence
  Ebola virus siRNA sense strand
agucaaguauuuggaagggca

SEQ ID NO: 1837 - RNA, 21 nt, Artificial Sequence
  Ebola virus siRNA sense strand
gucaaguauuuggaagggcac

SEQ ID NO: 1838 - RNA, 21 nt, Artificial Sequence
  Ebola virus siRNA sense strand
ucaaguauuuggaagggcacg

SEQ ID NO: 1839 - RNA, 21 nt, Artificial Sequence
  Ebola virus siRNA sense strand
caaguauuuggaagggcacgg

SEQ ID NO: 1840 - RNA, 21 nt, Artificial Sequence
  Ebola virus siRNA sense strand
aaguauuuggaagggcacggg

SEQ ID NO: 1841 - RNA, 21 nt, Artificial Sequence
  Ebola virus siRNA sense strand
aguauuuggaagggcacgggu

SEQ ID NO: 1842 - RNA, 21 nt, Artificial Sequence
  Ebola virus siRNA sense strand
guauuuggaagggcacggguu

SEQ ID NO: 1843 - RNA, 21 nt, Artificial Sequence
  Ebola virus siRNA sense strand
uauuuggaagggcacggguuc

SEQ ID NO: 1844 - RNA, 21 nt, Artificial Sequence
  Ebola virus siRNA sense strand
auuuggaagggcacggguucc

SEQ ID NO: 1845 - RNA, 21 nt, Artificial Sequence
  Ebola virus siRNA sense strand
uuuggaagggcacggguuccg

SEQ ID NO: 1846 - RNA, 21 nt, Artificial Sequence
  Ebola virus siRNA sense strand
uuggaagggcacggguuccgu

SEQ ID NO: 1847 - RNA, 21 nt, Artificial Sequence
  Ebola virus siRNA sense strand
uggaagggcacggguuccguu

SEQ ID NO: 1848 - RNA, 21 nt, Artificial Sequence
  Ebola virus siRNA sense strand
ggaagggcacggguuccguuu

SEQ ID NO: 1849 - RNA, 21 nt, Artificial Sequence
  Ebola virus siRNA sense strand
gaagggcacggguuccguuuu

SEQ ID NO: 1850 - RNA, 21 nt, Artificial Sequence
  Ebola virus siRNA sense strand
aagggcacggguuccguuuug

SEQ ID NO: 1851 - RNA, 21 nt, Artificial Sequence
  Ebola virus siRNA sense strand
agggcacggguuccguuuuga

SEQ ID NO: 1852 - RNA, 21 nt, Artificial Sequence
  Ebola virus siRNA sense strand
gggcacggguuccguuuugaa

SEQ ID NO: 1853 - RNA, 21 nt, Artificial Sequence
  Ebola virus siRNA sense strand
ggcacggguuccguuuugaag

SEQ ID NO: 1854 - RNA, 21 nt, Artificial Sequence
  Ebola virus siRNA sense strand
gcacggguuccguuuugaagu

SEQ ID NO: 1855 - RNA, 21 nt, Artificial Sequence
  Ebola virus siRNA sense strand
cacggguuccguuuugaaguc

SEQ ID NO: 1856 - RNA, 21 nt, Artificial Sequence
  Ebola virus siRNA sense strand
acggguuccguuuugaaguca

SEQ ID NO: 1857 - RNA, 21 nt, Artificial Sequence
  Ebola virus siRNA sense strand
cggguuccguuuugaagucaa

SEQ ID NO: 1858 - RNA, 21 nt, Artificial Sequence
  Ebola virus siRNA sense strand
ggguuccguuuugaagucaag

SEQ ID NO: 1859 - RNA, 21 nt, Artificial Sequence
  Ebola virus siRNA sense strand
gguuccguuuugaagucaaga

SEQ ID NO: 1860 - RNA, 21 nt, Artificial Sequence
  Ebola virus siRNA sense strand
guuccguuuugaagucaagaa

SEQ ID NO: 1861 - RNA, 21 nt, Artificial Sequence
  Ebola virus siRNA sense strand
uuccguuuugaagucaagaag

SEQ ID NO: 1862 - RNA, 21 nt, Artificial Sequence
  Ebola virus siRNA sense strand
uccguuuugaagucaagaagc

SEQ ID NO: 1863 - RNA, 21 nt, Artificial Sequence
  Ebola virus siRNA sense strand
ccguuuugaagucaagaagcg

SEQ ID NO: 1864 - RNA, 21 nt, Artificial Sequence
  Ebola virus siRNA sense strand
cguuuugaagucaagaagcgu

SEQ ID NO: 1865 - RNA, 21 nt, Artificial Sequence
  Ebola virus siRNA sense strand
guuuugaagucaagaagcgug

SEQ ID NO: 1866 - RNA, 21 nt, Artificial Sequence
  Ebola virus siRNA sense strand
uuuugaagucaagaagcguga

SEQ ID NO: 1867 - RNA, 21 nt, Artificial Sequence
  Ebola virus siRNA sense strand
uuugaagucaagaagcgugau

SEQ ID NO: 1868 - RNA, 21 nt, Artificial Sequence
  Ebola virus siRNA sense strand
uugaagucaagaagcgugaug

SEQ ID NO: 1869 - RNA, 21 nt, Artificial Sequence
  Ebola virus siRNA sense strand
ugaagucaagaagcgugaugg

SEQ ID NO: 1870 - RNA, 21 nt, Artificial Sequence
  Ebola virus siRNA sense strand
gaagucaagaagcgugaugga

SEQ ID NO: 1871 - RNA, 21 nt, Artificial Sequence
  Ebola virus siRNA sense strand
aagucaagaagcgugauggag

SEQ ID NO: 1872 - RNA, 21 nt, Artificial Sequence
  Ebola virus siRNA sense strand
agucaagaagcgugauggagu

SEQ ID NO: 1873 - RNA, 21 nt, Artificial Sequence
  Ebola virus siRNA sense strand
gucaagaagcgugauggagug

SEQ ID NO: 1874 - RNA, 21 nt, Artificial Sequence
  Ebola virus siRNA sense strand
ucaagaagcgugauggaguga

SEQ ID NO: 1875 - RNA, 21 nt, Artificial Sequence
  Ebola virus siRNA sense strand
caagaagcgugauggagugaa

SEQ ID NO: 1876 - RNA, 21 nt, Artificial Sequence
  Ebola virus siRNA sense strand
aagaagcgugauggagugaag

SEQ ID NO: 1877 - RNA, 21 nt, Artificial Sequence
  Ebola virus siRNA sense strand
agaagcgugauggagugaagc

SEQ ID NO: 1878 - RNA, 21 nt, Artificial Sequence
  Ebola virus siRNA sense strand
gaagcgugauggagugaagcg

SEQ ID NO: 1879 - RNA, 21 nt, Artificial Sequence
  Ebola virus siRNA sense strand
aagcgugauggagugaagcgc

SEQ ID NO: 1880 - RNA, 21 nt, Artificial Sequence
  Ebola virus siRNA sense strand
agcgugauggagugaagcgcc

SEQ ID NO: 1881 - RNA, 21 nt, Artificial Sequence
  Ebola virus siRNA sense strand
gcgugauggagugaagcgccu

SEQ ID NO: 1882 - RNA, 21 nt, Artificial Sequence
  Ebola virus siRNA sense strand
cgugauggagugaagcgccuu

SEQ ID NO: 1883 - RNA, 21 nt, Artificial Sequence
  Ebola virus siRNA sense strand
gugauggagugaagcgccuug

SEQ ID NO: 1884 - RNA, 21 nt, Artificial Sequence
  Ebola virus siRNA sense strand
ugauggagugaagcgccuuga

SEQ ID NO: 1885 - RNA, 21 nt, Artificial Sequence
  Ebola virus siRNA sense strand
gauggagugaagcgccuugag

SEQ ID NO: 1886 - RNA, 21 nt, Artificial Sequence
  Ebola virus siRNA sense strand
auggagugaagcgccuugagg

SEQ ID NO: 1887 - RNA, 21 nt, Artificial Sequence
  Ebola virus siRNA sense strand
uggagugaagcgccuugagga

SEQ ID NO: 1888 - RNA, 21 nt, Artificial Sequence
  Ebola virus siRNA sense strand
ggagugaagcgccuugaggaa

SEQ ID NO: 1889 - RNA, 21 nt, Artificial Sequence
  Ebola virus siRNA sense strand
gagugaagcgccuugaggaau

SEQ ID NO: 1890 - RNA, 21 nt, Artificial Sequence
  Ebola virus siRNA sense strand
agugaagcgccuugaggaauu

SEQ ID NO: 1891 - RNA, 21 nt, Artificial Sequence
  Ebola virus siRNA sense strand
gugaagcgccuugaggaauug

SEQ ID NO: 1892 - RNA, 21 nt, Artificial Sequence
  Ebola virus siRNA sense strand
ugaagcgccuugaggaauugc

SEQ ID NO: 1893 - RNA, 21 nt, Artificial Sequence
  Ebola virus siRNA sense strand
gaagcgccuugaggaauugcu

SEQ ID NO: 1894 - RNA, 21 nt, Artificial Sequence
  Ebola virus siRNA sense strand
aagcgccuugaggaauugcug

SEQ ID NO: 1895 - RNA, 21 nt, Artificial Sequence
  Ebola virus siRNA sense strand
agcgccuugaggaauugcugc

SEQ ID NO: 1896 - RNA, 21 nt, Artificial Sequence
  Ebola virus siRNA sense strand
gcgccuugaggaauugcugcc

SEQ ID NO: 1897 - RNA, 21 nt, Artificial Sequence
  Ebola virus siRNA sense strand
cgccuugaggaauugcugcca

SEQ ID NO: 1898 - RNA, 21 nt, Artificial Sequence
  Ebola virus siRNA sense strand
gccuugaggaauugcugccag

SEQ ID NO: 1899 - RNA, 21 nt, Artificial Sequence
  Ebola virus siRNA sense strand
ccuugaggaauugcugccagc

SEQ ID NO: 1900 - RNA, 21 nt, Artificial Sequence
  Ebola virus siRNA sense strand
cuugaggaauugcugccagca

SEQ ID NO: 1901 - RNA, 21 nt, Artificial Sequence
  Ebola virus siRNA sense strand
uugaggaauugcugccagcag

SEQ ID NO: 1902 - RNA, 21 nt, Artificial Sequence
  Ebola virus siRNA sense strand
ugaggaauugcugccagcagu

SEQ ID NO: 1903 - RNA, 21 nt, Artificial Sequence
  Ebola virus siRNA sense strand
gaggaauugcugccagcagua

SEQ ID NO: 1904 - RNA, 21 nt, Artificial Sequence
  Ebola virus siRNA sense strand
aggaauugcugccagcaguau

SEQ ID NO: 1905 - RNA, 21 nt, Artificial Sequence
  Ebola virus siRNA sense strand
ggaauugcugccagcaguauc

SEQ ID NO: 1906 - RNA, 21 nt, Artificial Sequence
  Ebola virus siRNA sense strand
gaauugcugccagcaguaucu

SEQ ID NO: 1907 - RNA, 21 nt, Artificial Sequence
  Ebola virus siRNA sense strand
aauugcugccagcaguaucua

SEQ ID NO: 1908 - RNA, 21 nt, Artificial Sequence
  Ebola virus siRNA sense strand
auugcugccagcaguaucuag

SEQ ID NO: 1909 - RNA, 21 nt, Artificial Sequence
  Ebola virus siRNA sense strand
uugcugccagcaguaucuagu

SEQ ID NO: 1910 - RNA, 21 nt, Artificial Sequence
  Ebola virus siRNA sense strand
ugcugccagcaguaucuagug

SEQ ID NO: 1911 - RNA, 21 nt, Artificial Sequence
  Ebola virus siRNA sense strand
gcugccagcaguaucuagugg

SEQ ID NO: 1912 - RNA, 21 nt, Artificial Sequence
  Ebola virus siRNA sense strand
cugccagcaguaucuagugga

SEQ ID NO: 1913 - RNA, 21 nt, Artificial Sequence
  Ebola virus siRNA sense strand
ugccagcaguaucuaguggaa

SEQ ID NO: 1914 - RNA, 21 nt, Artificial Sequence
  Ebola virus siRNA sense strand
gccagcaguaucuaguggaaa

SEQ ID NO: 1915 - RNA, 21 nt, Artificial Sequence
  Ebola virus siRNA sense strand
ccagcaguaucuaguggaaaa

SEQ ID NO: 1916 - RNA, 21 nt, Artificial Sequence
  Ebola virus siRNA sense strand
cagcaguaucuaguggaaaaa

SEQ ID NO: 1917 - RNA, 21 nt, Artificial Sequence
  Ebola virus siRNA sense strand
agcaguaucuaguggaaaaaa

SEQ ID NO: 1918 - RNA, 21 nt, Artificial Sequence
  Ebola virus siRNA sense strand
gcaguaucuaguggaaaaaac

SEQ ID NO: 1919 - RNA, 21 nt, Artificial Sequence
  Ebola virus siRNA sense strand
caguaucuaguggaaaaaaca

SEQ ID NO: 1920 - RNA, 21 nt, Artificial Sequence
  Ebola virus siRNA sense strand
aguaucuaguggaaaaaacau

SEQ ID NO: 1921 - RNA, 21 nt, Artificial Sequence
  Ebola virus siRNA sense strand
guaucuaguggaaaaaacauu

SEQ ID NO: 1922 - RNA, 21 nt, Artificial Sequence
  Ebola virus siRNA sense strand
uaucuaguggaaaaaacauua

SEQ ID NO: 1923 - RNA, 21 nt, Artificial Sequence
  Ebola virus siRNA sense strand
aucuaguggaaaaaacauuaa

SEQ ID NO: 1924 - RNA, 21 nt, Artificial Sequence
  Ebola virus siRNA sense strand
ucuaguggaaaaaacauuaag

SEQ ID NO: 1925 - RNA, 21 nt, Artificial Sequence
  Ebola virus siRNA sense strand
cuaguggaaaaaacauuaaga

SEQ ID NO: 1926 - RNA, 21 nt, Artificial Sequence
  Ebola virus siRNA sense strand
uaguggaaaaaacauuaagag

SEQ ID NO: 1927 - RNA, 21 nt, Artificial Sequence
  Ebola virus siRNA sense strand
aguggaaaaaacauuaagaga

SEQ ID NO: 1928 - RNA, 21 nt, Artificial Sequence
  Ebola virus siRNA sense strand
guggaaaaaacauuaagagaa

SEQ ID NO: 1929 - RNA, 21 nt, Artificial Sequence
  Ebola virus siRNA sense strand
uggaaaaaacauuaagagaac

SEQ ID NO: 1930 - RNA, 21 nt, Artificial Sequence
  Ebola virus siRNA sense strand
ggaaaaaacauuaagagaaca

SEQ ID NO: 1931 - RNA, 21 nt, Artificial Sequence
  Ebola virus siRNA sense strand
gaaaaaacauuaagagaacac

SEQ ID NO: 1932 - RNA, 21 nt, Artificial Sequence
  Ebola virus siRNA sense strand
aaaaaacauuaagagaacacu

SEQ ID NO: 1933 - RNA, 21 nt, Artificial Sequence
  Ebola virus siRNA sense strand
aaaaacauuaagagaacacuu

SEQ ID NO: 1934 - RNA, 21 nt, Artificial Sequence
  Ebola virus siRNA sense strand
aaaacauuaagagaacacuug

SEQ ID NO: 1935 - RNA, 21 nt, Artificial Sequence
  Ebola virus siRNA sense strand
aaacauuaagagaacacuugc

SEQ ID NO: 1936 - RNA, 21 nt, Artificial Sequence
  Ebola virus siRNA sense strand
aacauuaagagaacacuugcu

SEQ ID NO: 1937 - RNA, 21 nt, Artificial Sequence
  Ebola virus siRNA sense strand
acauuaagagaacacuugcug

SEQ ID NO: 1938 - RNA, 21 nt, Artificial Sequence
  Ebola virus siRNA sense strand
cauuaagagaacacuugcugc

SEQ ID NO: 1939 - RNA, 21 nt, Artificial Sequence
  Ebola virus siRNA sense strand
auuaagagaacacuugcugcc

SEQ ID NO: 1940 - RNA, 21 nt, Artificial Sequence
  Ebola virus siRNA sense strand
uuaagagaacacuugcugcca

SEQ ID NO: 1941 - RNA, 21 nt, Artificial Sequence
  Ebola virus siRNA sense strand
uaagagaacacuugcugccau

SEQ ID NO: 1942 - RNA, 21 nt, Artificial Sequence
  Ebola virus siRNA sense strand
aagagaacacuugcugccaug

SEQ ID NO: 1943 - RNA, 21 nt, Artificial Sequence
  Ebola virus siRNA sense strand
agagaacacuugcugccaugc

SEQ ID NO: 1944 - RNA, 21 nt, Artificial Sequence
  Ebola virus siRNA sense strand
gagaacacuugcugccaugcc

SEQ ID NO: 1945 - RNA, 21 nt, Artificial Sequence
  Ebola virus siRNA sense strand
agaacacuugcugccaugccg

SEQ ID NO: 1946 - RNA, 21 nt, Artificial Sequence
  Ebola virus siRNA sense strand
gaacacuugcugccaugccgg

SEQ ID NO: 1947 - RNA, 21 nt, Artificial Sequence
  Ebola virus siRNA sense strand
aacacuugcugccaugccgga

SEQ ID NO: 1948 - RNA, 21 nt, Artificial Sequence
  Ebola virus siRNA sense strand
acacuugcugccaugccggaa

SEQ ID NO: 1949 - RNA, 21 nt, Artificial Sequence
  Ebola virus siRNA sense strand
cacuugcugccaugccggaag

SEQ ID NO: 1950 - RNA, 21 nt, Artificial Sequence
  Ebola virus siRNA sense strand
acuugcugccaugccggaaga

SEQ ID NO: 1951 - RNA, 21 nt, Artificial Sequence
  Ebola virus siRNA sense strand
cuugcugccaugccggaagag

SEQ ID NO: 1952 - RNA, 21 nt, Artificial Sequence
  Ebola virus siRNA sense strand
uugcugccaugccggaagagg

SEQ ID NO: 1953 - RNA, 21 nt, Artificial Sequence
  Ebola virus siRNA sense strand
ugcugccaugccggaagagga

SEQ ID NO: 1954 - RNA, 21 nt, Artificial Sequence
  Ebola virus siRNA sense strand
gcugccaugccggaagaggag

SEQ ID NO: 1955 - RNA, 21 nt, Artificial Sequence
  Ebola virus siRNA sense strand
cugccaugccggaagaggaga

SEQ ID NO: 1956 - RNA, 21 nt, Artificial Sequence
  Ebola virus siRNA sense strand
ugccaugccggaagaggagac

SEQ ID NO: 1957 - RNA, 21 nt, Artificial Sequence
  Ebola virus siRNA sense strand
gccaugccggaagaggagaca

SEQ ID NO: 1958 - RNA, 21 nt, Artificial Sequence
  Ebola virus siRNA sense strand
ccaugccggaagaggagacaa

SEQ ID NO: 1959 - RNA, 21 nt, Artificial Sequence
  Ebola virus siRNA sense strand
caugccggaagaggagacaac

SEQ ID NO: 1960 - RNA, 21 nt, Artificial Sequence
  Ebola virus siRNA sense strand
augccggaagaggagacaacu

SEQ ID NO: 1961 - RNA, 21 nt, Artificial Sequence
  Ebola virus siRNA sense strand
ugccggaagaggagacaacug

SEQ ID NO: 1962 - RNA, 21 nt, Artificial Sequence
  Ebola virus siRNA sense strand
gccggaagaggagacaacuga

SEQ ID NO: 1963 - RNA, 21 nt, Artificial Sequence
  Ebola virus siRNA sense strand
ccggaagaggagacaacugaa

SEQ ID NO: 1964 - RNA, 21 nt, Artificial Sequence
  Ebola virus siRNA sense strand
cggaagaggagacaacugaag

SEQ ID NO: 1965 - RNA, 21 nt, Artificial Sequence
  Ebola virus siRNA sense strand
ggaagaggagacaacugaagc

SEQ ID NO: 1966 - RNA, 21 nt, Artificial Sequence
  Ebola virus siRNA sense strand
gaagaggagacaacugaagcu

SEQ ID NO: 1967 - RNA, 21 nt, Artificial Sequence
  Ebola virus siRNA sense strand
aagaggagacaacugaagcua

SEQ ID NO: 1968 - RNA, 21 nt, Artificial Sequence
  Ebola virus siRNA sense strand
agaggagacaacugaagcuaa

SEQ ID NO: 1969 - RNA, 21 nt, Artificial Sequence
  Ebola virus siRNA sense strand
gaggagacaacugaagcuaau

SEQ ID NO: 1970 - RNA, 21 nt, Artificial Sequence
  Ebola virus siRNA sense strand
aggagacaacugaagcuaaug

SEQ ID NO: 1971 - RNA, 21 nt, Artificial Sequence
  Ebola virus siRNA sense strand
ggagacaacugaagcuaaugc

SEQ ID NO: 1972 - RNA, 21 nt, Artificial Sequence
  Ebola virus siRNA sense strand
gagacaacugaagcuaaugcc

SEQ ID NO: 1973 - RNA, 21 nt, Artificial Sequence
  Ebola virus siRNA sense strand
agacaacugaagcuaaugccg

SEQ ID NO: 1974 - RNA, 21 nt, Artificial Sequence
  Ebola virus siRNA sense strand
gacaacugaagcuaaugccgg

SEQ ID NO: 1975 - RNA, 21 nt, Artificial Sequence
  Ebola virus siRNA sense strand
acaacugaagcuaaugccggu

SEQ ID NO: 1976 - RNA, 21 nt, Artificial Sequence
  Ebola virus siRNA sense strand
caacugaagcuaaugccgguc

SEQ ID NO: 1977 - RNA, 21 nt, Artificial Sequence
  Ebola virus siRNA sense strand
aacugaagcuaaugccgguca

SEQ ID NO: 1978 - RNA, 21 nt, Artificial Sequence
  Ebola virus siRNA sense strand
acugaagcuaaugccggucag

SEQ ID NO: 1979 - RNA, 21 nt, Artificial Sequence
  Ebola virus siRNA sense strand
cugaagcuaaugccggucagu

SEQ ID NO: 1980 - RNA, 21 nt, Artificial Sequence
  Ebola virus siRNA sense strand
ugaagcuaaugccggucaguu

SEQ ID NO: 1981 - RNA, 21 nt, Artificial Sequence
  Ebola virus siRNA sense strand
gaagcuaaugccggucaguuu

SEQ ID NO: 1982 - RNA, 21 nt, Artificial Sequence
  Ebola virus siRNA sense strand
aagcuaaugccggucaguuuc

SEQ ID NO: 1983 - RNA, 21 nt, Artificial Sequence
  Ebola virus siRNA sense strand
agcuaaugccggucaguuucu

SEQ ID NO: 1984 - RNA, 21 nt, Artificial Sequence
  Ebola virus siRNA sense strand
gcuaaugccggucaguuucuc

SEQ ID NO: 1985 - RNA, 21 nt, Artificial Sequence
  Ebola virus siRNA sense strand
cuaaugccggucaguuucucu

SEQ ID NO: 1986 - RNA, 21 nt, Artificial Sequence
  Ebola virus siRNA sense strand
uaaugccggucaguuucucuc

SEQ ID NO: 1987 - RNA, 21 nt, Artificial Sequence
  Ebola virus siRNA sense strand
aaugccggucaguuucucucc

SEQ ID NO: 1988 - RNA, 21 nt, Artificial Sequence
  Ebola virus siRNA sense strand
augccggucaguuucucuccu

SEQ ID NO: 1989 - RNA, 21 nt, Artificial Sequence
  Ebola virus siRNA sense strand
ugccggucaguuucucuccuu

SEQ ID NO: 1990 - RNA, 21 nt, Artificial Sequence
  Ebola virus siRNA sense strand
gccggucaguuucucuccuuu

SEQ ID NO: 1991 - RNA, 21 nt, Artificial Sequence
  Ebola virus siRNA sense strand
ccggucaguuucucuccuuug

SEQ ID NO: 1992 - RNA, 21 nt, Artificial Sequence
  Ebola virus siRNA sense strand
cggucaguuucucuccuuugc

SEQ ID NO: 1993 - RNA, 21 nt, Artificial Sequence
  Ebola virus siRNA sense strand
ggucaguuucucuccuuugca

SEQ ID NO: 1994 - RNA, 21 nt, Artificial Sequence
  Ebola virus siRNA sense strand
gucaguuucucuccuuugcaa

SEQ ID NO: 1995 - RNA, 21 nt, Artificial Sequence
  Ebola virus siRNA sense strand
ucaguuucucuccuuugcaag

SEQ ID NO: 1996 - RNA, 21 nt, Artificial Sequence
  Ebola virus siRNA sense strand
caguuucucuccuuugcaagu

SEQ ID NO: 1997 - RNA, 21 nt, Artificial Sequence
  Ebola virus siRNA sense strand
aguuucucuccuuugcaaguc

SEQ ID NO: 1998 - RNA, 21 nt, Artificial Sequence
  Ebola virus siRNA sense strand
guuucucuccuuugcaagucu

SEQ ID NO: 1999 - RNA, 21 nt, Artificial Sequence
  Ebola virus siRNA sense strand
uuucucuccuuugcaagucua

SEQ ID NO: 2000 - RNA, 21 nt, Artificial Sequence
  Ebola virus siRNA sense strand
uucucuccuuugcaagucuau

SEQ ID NO: 2001 - RNA, 21 nt, Artificial Sequence
  Ebola virus siRNA sense strand
ucucuccuuugcaagucuauu

SEQ ID NO: 2002 - RNA, 21 nt, Artificial Sequence
  Ebola virus siRNA sense strand
cucuccuuugcaagucuauuc

SEQ ID NO: 2003 - RNA, 21 nt, Artificial Sequence
  Ebola virus siRNA sense strand
ucuccuuugcaagucuauucc

SEQ ID NO: 2004 - RNA, 21 nt, Artificial Sequence
  Ebola virus siRNA sense strand
cuccuuugcaagucuauuccu

SEQ ID NO: 2005 - RNA, 21 nt, Artificial Sequence
  Ebola virus siRNA sense strand
uccuuugcaagucuauuccuu

SEQ ID NO: 2006 - RNA, 21 nt, Artificial Sequence
  Ebola virus siRNA sense strand
ccuuugcaagucuauuccuuc

SEQ ID NO: 2007 - RNA, 21 nt, Artificial Sequence
  Ebola virus siRNA sense strand
cuuugcaagucuauuccuucc

SEQ ID NO: 2008 - RNA, 21 nt, Artificial Sequence
  Ebola virus siRNA sense strand
uuugcaagucuauuccuuccg

SEQ ID NO: 2009 - RNA, 21 nt, Artificial Sequence
  Ebola virus siRNA sense strand
uugcaagucuauuccuuccga

SEQ ID NO: 2010 - RNA, 21 nt, Artificial Sequence
  Ebola virus siRNA sense strand
ugcaagucuauuccuuccgaa

SEQ ID NO: 2011 - RNA, 21 nt, Artificial Sequence
  Ebola virus siRNA sense strand
gcaagucuauuccuuccgaaa

SEQ ID NO: 2012 - RNA, 21 nt, Artificial Sequence
  Ebola virus siRNA sense strand
caagucuauuccuuccgaaau

SEQ ID NO: 2013 - RNA, 21 nt, Artificial Sequence
  Ebola virus siRNA sense strand
aagucuauuccuuccgaaauu

SEQ ID NO: 2014 - RNA, 21 nt, Artificial Sequence
  Ebola virus siRNA sense strand
agucuauuccuuccgaaauug

SEQ ID NO: 2015 - RNA, 21 nt, Artificial Sequence
  Ebola virus siRNA sense strand
gucuauuccuuccgaaauugg

SEQ ID NO: 2016 - RNA, 21 nt, Artificial Sequence
  Ebola virus siRNA sense strand
ucuauuccuuccgaaauuggu

SEQ ID NO: 2017 - RNA, 21 nt, Artificial Sequence
  Ebola virus siRNA sense strand
cuauuccuuccgaaauuggua

SEQ ID NO: 2018 - RNA, 21 nt, Artificial Sequence
  Ebola virus siRNA sense strand
uauuccuuccgaaauugguag

SEQ ID NO: 2019 - RNA, 21 nt, Artificial Sequence
  Ebola virus siRNA sense strand
auuccuuccgaaauugguagu

SEQ ID NO: 2020 - RNA, 21 nt, Artificial Sequence
  Ebola virus siRNA sense strand
uuccuuccgaaauugguagua

SEQ ID NO: 2021 - RNA, 21 nt, Artificial Sequence
  Ebola virus siRNA sense strand
uccuuccgaaauugguaguag

SEQ ID NO: 2022 - RNA, 21 nt, Artificial Sequence
  Ebola virus siRNA sense strand
ccuuccgaaauugguaguagg

SEQ ID NO: 2023 - RNA, 21 nt, Artificial Sequence
  Ebola virus siRNA sense strand
cuuccgaaauugguaguagga

SEQ ID NO: 2024 - RNA, 21 nt, Artificial Sequence
  Ebola virus siRNA sense strand
uuccgaaauugguaguaggag

SEQ ID NO: 2025 - RNA, 21 nt, Artificial Sequence
  Ebola virus siRNA sense strand
uccgaaauugguaguaggaga

SEQ ID NO: 2026 - RNA, 21 nt, Artificial Sequence
  Ebola virus siRNA sense strand
ccgaaauugguaguaggagaa

SEQ ID NO: 2027 - RNA, 21 nt, Artificial Sequence
  Ebola virus siRNA sense strand
cgaaauugguaguaggagaaa

SEQ ID NO: 2028 - RNA, 21 nt, Artificial Sequence
  Ebola virus siRNA sense strand
gaaauugguaguaggagaaaa

SEQ ID NO: 2029 - RNA, 21 nt, Artificial Sequence
  Ebola virus siRNA sense strand
aaauugguaguaggagaaaag

SEQ ID NO: 2030 - RNA, 21 nt, Artificial Sequence
  Ebola virus siRNA sense strand
aauugguaguaggagaaaagg

SEQ ID NO: 2031 - RNA, 21 nt, Artificial Sequence
  Ebola virus siRNA sense strand
auugguaguaggagaaaaggc

SEQ ID NO: 2032 - RNA, 21 nt, Artificial Sequence
  Ebola virus siRNA sense strand
uugguaguaggagaaaaggcu

SEQ ID NO: 2033 - RNA, 21 nt, Artificial Sequence
  Ebola virus siRNA sense strand
ugguaguaggagaaaaggcuu

SEQ ID NO: 2034 - RNA, 21 nt, Artificial Sequence
  Ebola virus siRNA sense strand
gguaguaggagaaaaggcuug

SEQ ID NO: 2035 - RNA, 21 nt, Artificial Sequence
  Ebola virus siRNA sense strand
guaguaggagaaaaggcuugc

SEQ ID NO: 2036 - RNA, 21 nt, Artificial Sequence
  Ebola virus siRNA sense strand
uaguaggagaaaaggcuugcc

SEQ ID NO: 2037 - RNA, 21 nt, Artificial Sequence
  Ebola virus siRNA sense strand
aguaggagaaaaggcuugccu

SEQ ID NO: 2038 - RNA, 21 nt, Artificial Sequence
  Ebola virus siRNA sense strand
guaggagaaaaggcuugccuu

SEQ ID NO: 2039 - RNA, 21 nt, Artificial Sequence
  Ebola virus siRNA sense strand
uaggagaaaaggcuugccuug

SEQ ID NO: 2040 - RNA, 21 nt, Artificial Sequence
  Ebola virus siRNA sense strand
aggagaaaaggcuugccuuga

SEQ ID NO: 2041 - RNA, 21 nt, Artificial Sequence
  Ebola virus siRNA sense strand
ggagaaaaggcuugccuugag

SEQ ID NO: 2042 - RNA, 21 nt, Artificial Sequence
  Ebola virus siRNA sense strand
gagaaaaggcuugccuugaga

SEQ ID NO: 2043 - RNA, 21 nt, Artificial Sequence
  Ebola virus siRNA sense strand
agaaaaggcuugccuugagaa

SEQ ID NO: 2044 - RNA, 21 nt, Artificial Sequence
  Ebola virus siRNA sense strand
gaaaaggcuugccuugagaag

SEQ ID NO: 2045 - RNA, 21 nt, Artificial Sequence
  Ebola virus siRNA sense strand
aaaaggcuugccuugagaagg

SEQ ID NO: 2046 - RNA, 21 nt, Artificial Sequence
  Ebola virus siRNA sense strand
aaaggcuugccuugagaaggu

SEQ ID NO: 2047 - RNA, 21 nt, Artificial Sequence
  Ebola virus siRNA sense strand
aaggcuugccuugagaagguu

SEQ ID NO: 2048 - RNA, 21 nt, Artificial Sequence
  Ebola virus siRNA sense strand
aggcuugccuugagaagguuc

SEQ ID NO: 2049 - RNA, 21 nt, Artificial Sequence
  Ebola virus siRNA sense strand
ggcuugccuugagaagguuca

SEQ ID NO: 2050 - RNA, 21 nt, Artificial Sequence
  Ebola virus siRNA sense strand
gcuugccuugagaagguucaa

SEQ ID NO: 2051 - RNA, 21 nt, Artificial Sequence
  Ebola virus siRNA sense strand
cuugccuugagaagguucaaa

SEQ ID NO: 2052 - RNA, 21 nt, Artificial Sequence
  Ebola virus siRNA sense strand
uugccuugagaagguucaaag

SEQ ID NO: 2053 - RNA, 21 nt, Artificial Sequence
  Ebola virus siRNA sense strand
ugccuugagaagguucaaagg

SEQ ID NO: 2054 - RNA, 21 nt, Artificial Sequence
  Ebola virus siRNA sense strand
gccuugagaagguucaaaggc

SEQ ID NO: 2055 - RNA, 21 nt, Artificial Sequence
  Ebola virus siRNA sense strand
ccuugagaagguucaaaggca

SEQ ID NO: 2056 - RNA, 21 nt, Artificial Sequence
  Ebola virus siRNA sense strand
cuugagaagguucaaaggcaa

SEQ ID NO: 2057 - RNA, 21 nt, Artificial Sequence
  Ebola virus siRNA sense strand
uugagaagguucaaaggcaaa

SEQ ID NO: 2058 - RNA, 21 nt, Artificial Sequence
  Ebola virus siRNA sense strand
ugagaagguucaaaggcaaau

SEQ ID NO: 2059 - RNA, 21 nt, Artificial Sequence
  Ebola virus siRNA sense strand
gagaagguucaaaggcaaauu

SEQ ID NO: 2060 - RNA, 21 nt, Artificial Sequence
  Ebola virus siRNA sense strand
agaagguucaaaggcaaauuc

SEQ ID NO: 2061 - RNA, 21 nt, Artificial Sequence
  Ebola virus siRNA sense strand
gaagguucaaaggcaaauuca

SEQ ID NO: 2062 - RNA, 21 nt, Artificial Sequence
  Ebola virus siRNA sense strand
aagguucaaaggcaaauucaa

SEQ ID NO: 2063 - RNA, 21 nt, Artificial Sequence
  Ebola virus siRNA sense strand
agguucaaaggcaaauucaag

SEQ ID NO: 2064 - RNA, 21 nt, Artificial Sequence
  Ebola virus siRNA sense strand
gguucaaaggcaaauucaagu

SEQ ID NO: 2065 - RNA, 21 nt, Artificial Sequence
  Ebola virus siRNA sense strand
guucaaaggcaaauucaagua

SEQ ID NO: 2066 - RNA, 21 nt, Artificial Sequence
  Ebola virus siRNA sense strand
uucaaaggcaaauucaaguac

SEQ ID NO: 2067 - RNA, 21 nt, Artificial Sequence
  Ebola virus siRNA sense strand
ucaaaggcaaauucaaguaca

SEQ ID NO: 2068 - RNA, 21 nt, Artificial Sequence
  Ebola virus siRNA sense strand
caaaggcaaauucaaguacau

SEQ ID NO: 2069 - RNA, 21 nt, Artificial Sequence
  Ebola virus siRNA sense strand
aaaggcaaauucaaguacaug

SEQ ID NO: 2070 - RNA, 21 nt, Artificial Sequence
  Ebola virus siRNA sense strand
aaggcaaauucaaguacaugc

SEQ ID NO: 2071 - RNA, 21 nt, Artificial Sequence
  Ebola virus siRNA sense strand
aggcaaauucaaguacaugca

SEQ ID NO: 2072 - RNA, 21 nt, Artificial Sequence
  Ebola virus siRNA sense strand
ggcaaauucaaguacaugcag

SEQ ID NO: 2073 - RNA, 21 nt, Artificial Sequence
  Ebola virus siRNA sense strand
gcaaauucaaguacaugcaga

SEQ ID NO: 2074 - RNA, 21 nt, Artificial Sequence
  Ebola virus siRNA sense strand
caaauucaaguacaugcagag

SEQ ID NO: 2075 - RNA, 21 nt, Artificial Sequence
  Ebola virus siRNA sense strand
aaauucaaguacaugcagagc

SEQ ID NO: 2076 - RNA, 21 nt, Artificial Sequence
  Ebola virus siRNA sense strand
aauucaaguacaugcagagca

SEQ ID NO: 2077 - RNA, 21 nt, Artificial Sequence
  Ebola virus siRNA sense strand
auucaaguacaugcagagcaa

SEQ ID NO: 2078 - RNA, 21 nt, Artificial Sequence
  Ebola virus siRNA sense strand
uucaaguacaugcagagcaag

SEQ ID NO: 2079 - RNA, 21 nt, Artificial Sequence
  Ebola virus siRNA sense strand
ucaaguacaugcagagcaagg

SEQ ID NO: 2080 - RNA, 21 nt, Artificial Sequence
  Ebola virus siRNA sense strand
caaguacaugcagagcaagga

SEQ ID NO: 2081 - RNA, 21 nt, Artificial Sequence
  Ebola virus siRNA sense strand
aaguacaugcagagcaaggac

SEQ ID NO: 2082 - RNA, 21 nt, Artificial Sequence
  Ebola virus siRNA sense strand
aguacaugcagagcaaggacu

SEQ ID NO: 2083 - RNA, 21 nt, Artificial Sequence
  Ebola virus siRNA sense strand
guacaugcagagcaaggacug

SEQ ID NO: 2084 - RNA, 21 nt, Artificial Sequence
  Ebola virus siRNA sense strand
uacaugcagagcaaggacuga

SEQ ID NO: 2085 - RNA, 21 nt, Artificial Sequence
  Ebola virus siRNA sense strand
acaugcagagcaaggacugau

SEQ ID NO: 2086 - RNA, 21 nt, Artificial Sequence
  Ebola virus siRNA sense strand
caugcagagcaaggacugaua

SEQ ID NO: 2087 - RNA, 21 nt, Artificial Sequence
  Ebola virus siRNA sense strand
augcagagcaaggacugauac

SEQ ID NO: 2088 - RNA, 21 nt, Artificial Sequence
  Ebola virus siRNA sense strand
ugcagagcaaggacugauaca

SEQ ID NO: 2089 - RNA, 21 nt, Artificial Sequence
  Ebola virus siRNA sense strand
gcagagcaaggacugauacaa

SEQ ID NO: 2090 - RNA, 21 nt, Artificial Sequence
  Ebola virus siRNA sense strand
cagagcaaggacugauacaau

SEQ ID NO: 2091 - RNA, 21 nt, Artificial Sequence
  Ebola virus siRNA sense strand
agagcaaggacugauacaaua

SEQ ID NO: 2092 - RNA, 21 nt, Artificial Sequence
  Ebola virus siRNA sense strand
gagcaaggacugauacaauau

SEQ ID NO: 2093 - RNA, 21 nt, Artificial Sequence
  Ebola virus siRNA sense strand
agcaaggacugauacaauauc

SEQ ID NO: 2094 - RNA, 21 nt, Artificial Sequence
  Ebola virus siRNA sense strand
gcaaggacugauacaauaucc

SEQ ID NO: 2095 - RNA, 21 nt, Artificial Sequence
  Ebola virus siRNA sense strand
caaggacugauacaauaucca

SEQ ID NO: 2096 - RNA, 21 nt, Artificial Sequence
  Ebola virus siRNA sense strand
aaggacugauacaauauccaa

SEQ ID NO: 2097 - RNA, 21 nt, Artificial Sequence
  Ebola virus siRNA sense strand
aggacugauacaauauccaac

SEQ ID NO: 2098 - RNA, 21 nt, Artificial Sequence
  Ebola virus siRNA sense strand
ggacugauacaauauccaaca

SEQ ID NO: 2099 - RNA, 21 nt, Artificial Sequence
  Ebola virus siRNA sense strand
gacugauacaauauccaacag

SEQ ID NO: 2100 - RNA, 21 nt, Artificial Sequence
  Ebola virus siRNA sense strand
acugauacaauauccaacagc

SEQ ID NO: 2101 - RNA, 21 nt, Artificial Sequence
  Ebola virus siRNA sense strand
cugauacaauauccaacagcu

SEQ ID NO: 2102 - RNA, 21 nt, Artificial Sequence
  Ebola virus siRNA sense strand
ugauacaauauccaacagcuu

SEQ ID NO: 2103 - RNA, 21 nt, Artificial Sequence
  Ebola virus siRNA sense strand
gauacaauauccaacagcuug

SEQ ID NO: 2104 - RNA, 21 nt, Artificial Sequence
  Ebola virus siRNA sense strand
auacaauauccaacagcuugg

SEQ ID NO: 2105 - RNA, 21 nt, Artificial Sequence
  Ebola virus siRNA sense strand
uacaauauccaacagcuuggc

SEQ ID NO: 2106 - RNA, 21 nt, Artificial Sequence
  Ebola virus siRNA sense strand
acaauauccaacagcuuggca

SEQ ID NO: 2107 - RNA, 21 nt, Artificial Sequence
  Ebola virus siRNA sense strand
caauauccaacagcuuggcaa

SEQ ID NO: 2108 - RNA, 21 nt, Artificial Sequence
  Ebola virus siRNA sense strand
aauauccaacagcuuggcaau

SEQ ID NO: 2109 - RNA, 21 nt, Artificial Sequence
  Ebola virus siRNA sense strand
auauccaacagcuuggcaauc

SEQ ID NO: 2110 - RNA, 21 nt, Artificial Sequence
  Ebola virus siRNA sense strand
uauccaacagcuuggcaauca

SEQ ID NO: 2111 - RNA, 21 nt, Artificial Sequence
  Ebola virus siRNA sense strand
auccaacagcuuggcaaucag

SEQ ID NO: 2112 - RNA, 21 nt, Artificial Sequence
  Ebola virus siRNA sense strand
uccaacagcuuggcaaucagu

SEQ ID NO: 2113 - RNA, 21 nt, Artificial Sequence
  Ebola virus siRNA sense strand
ccaacagcuuggcaaucagua

SEQ ID NO: 2114 - RNA, 21 nt, Artificial Sequence
  Ebola virus siRNA sense strand
caacagcuuggcaaucaguag

SEQ ID NO: 2115 - RNA, 21 nt, Artificial Sequence
  Ebola virus siRNA sense strand
aacagcuuggcaaucaguagg

SEQ ID NO: 2116 - RNA, 21 nt, Artificial Sequence
  Ebola virus siRNA sense strand
acagcuuggcaaucaguagga

SEQ ID NO: 2117 - RNA, 21 nt, Artificial Sequence
  Ebola virus siRNA sense strand
cagcuuggcaaucaguaggac

SEQ ID NO: 2118 - RNA, 21 nt, Artificial Sequence
  Ebola virus siRNA sense strand
agcuuggcaaucaguaggaca

SEQ ID NO: 2119 - RNA, 21 nt, Artificial Sequence
  Ebola virus siRNA sense strand
gcuuggcaaucaguaggacac

SEQ ID NO: 2120 - RNA, 21 nt, Artificial Sequence
  Ebola virus siRNA sense strand
cuuggcaaucaguaggacaca

SEQ ID NO: 2121 - RNA, 21 nt, Artificial Sequence
  Ebola virus siRNA sense strand
uuggcaaucaguaggacacau

SEQ ID NO: 2122 - RNA, 21 nt, Artificial Sequence
  Ebola virus siRNA sense strand
uggcaaucaguaggacacaug

SEQ ID NO: 2123 - RNA, 21 nt, Artificial Sequence
  Ebola virus siRNA sense strand
ggcaaucaguaggacacauga

SEQ ID NO: 2124 - RNA, 21 nt, Artificial Sequence
  Ebola virus siRNA sense strand
gcaaucaguaggacacaugau

SEQ ID NO: 2125 - RNA, 21 nt, Artificial Sequence
  Ebola virus siRNA sense strand
caaucaguaggacacaugaug

SEQ ID NO: 2126 - RNA, 21 nt, Artificial Sequence
  Ebola virus siRNA sense strand
aaucaguaggacacaugaugg

SEQ ID NO: 2127 - RNA, 21 nt, Artificial Sequence
  Ebola virus siRNA sense strand
aucaguaggacacaugauggu

SEQ ID NO: 2128 - RNA, 21 nt, Artificial Sequence
  Ebola virus siRNA sense strand
ucaguaggacacaugauggug

SEQ ID NO: 2129 - RNA, 21 nt, Artificial Sequence
  Ebola virus siRNA sense strand
caguaggacacaugaugguga

SEQ ID NO: 2130 - RNA, 21 nt, Artificial Sequence
  Ebola virus siRNA sense strand
aguaggacacaugauggugau

SEQ ID NO: 2131 - RNA, 21 nt, Artificial Sequence
  Ebola virus siRNA sense strand
guaggacacaugauggugauu

SEQ ID NO: 2132 - RNA, 21 nt, Artificial Sequence
  Ebola virus siRNA sense strand
uaggacacaugauggugauuu

SEQ ID NO: 2133 - RNA, 21 nt, Artificial Sequence
  Ebola virus siRNA sense strand
aggacacaugauggugauuuu

SEQ ID NO: 2134 - RNA, 21 nt, Artificial Sequence
  Ebola virus siRNA sense strand
ggacacaugauggugauuuuc

SEQ ID NO: 2135 - RNA, 21 nt, Artificial Sequence
  Ebola virus siRNA sense strand
gacacaugauggugauuuucc

SEQ ID NO: 2136 - RNA, 21 nt, Artificial Sequence
  Ebola virus siRNA sense strand
acacaugauggugauuuuccg

SEQ ID NO: 2137 - RNA, 21 nt, Artificial Sequence
  Ebola virus siRNA sense strand
cacaugauggugauuuuccgu

SEQ ID NO: 2138 - RNA, 21 nt, Artificial Sequence
  Ebola virus siRNA sense strand
acaugauggugauuuuccguu

SEQ ID NO: 2139 - RNA, 21 nt, Artificial Sequence
  Ebola virus siRNA sense strand
caugauggugauuuuccguuu

SEQ ID NO: 2140 - RNA, 21 nt, Artificial Sequence
  Ebola virus siRNA sense strand
augauggugauuuuccguuug

SEQ ID NO: 2141 - RNA, 21 nt, Artificial Sequence
  Ebola virus siRNA sense strand
ugauggugauuuuccguuuga

SEQ ID NO: 2142 - RNA, 21 nt, Artificial Sequence
  Ebola virus siRNA sense strand
gauggugauuuuccguuugau

SEQ ID NO: 2143 - RNA, 21 nt, Artificial Sequence
  Ebola virus siRNA sense strand
auggugauuuuccguuugaug

SEQ ID NO: 2144 - RNA, 21 nt, Artificial Sequence
  Ebola virus siRNA sense strand
uggugauuuuccguuugaugc

SEQ ID NO: 2145 - RNA, 21 nt, Artificial Sequence
  Ebola virus siRNA sense strand
ggugauuuuccguuugaugcg

SEQ ID NO: 2146 - RNA, 21 nt, Artificial Sequence
  Ebola virus siRNA sense strand
gugauuuuccguuugaugcga

SEQ ID NO: 2147 - RNA, 21 nt, Artificial Sequence
  Ebola virus siRNA sense strand
ugauuuuccguuugaugcgaa

SEQ ID NO: 2148 - RNA, 21 nt, Artificial Sequence
  Ebola virus siRNA sense strand
gauuuuccguuugaugcgaac

SEQ ID NO: 2149 - RNA, 21 nt, Artificial Sequence
  Ebola virus siRNA sense strand
auuuuccguuugaugcgaaca

SEQ ID NO: 2150 - RNA, 21 nt, Artificial Sequence
  Ebola virus siRNA sense strand
uuuuccguuugaugcgaacaa

SEQ ID NO: 2151 - RNA, 21 nt, Artificial Sequence
  Ebola virus siRNA sense strand
uuuccguuugaugcgaacaaa

SEQ ID NO: 2152 - RNA, 21 nt, Artificial Sequence
  Ebola virus siRNA sense strand
uuccguuugaugcgaacaaau

SEQ ID NO: 2153 - RNA, 21 nt, Artificial Sequence
  Ebola virus siRNA sense strand
uccguuugaugcgaacaaauu

SEQ ID NO: 2154 - RNA, 21 nt, Artificial Sequence
  Ebola virus siRNA sense strand
ccguuugaugcgaacaaauuu

SEQ ID NO: 2155 - RNA, 21 nt, Artificial Sequence
  Ebola virus siRNA sense strand
cguuugaugcgaacaaauuuu

SEQ ID NO: 2156 - RNA, 21 nt, Artificial Sequence
  Ebola virus siRNA sense strand
guuugaugcgaacaaauuuuc

SEQ ID NO: 2157 - RNA, 21 nt, Artificial Sequence
  Ebola virus siRNA sense strand
uuugaugcgaacaaauuuucu

SEQ ID NO: 2158 - RNA, 21 nt, Artificial Sequence
  Ebola virus siRNA sense strand
uugaugcgaacaaauuuucug

SEQ ID NO: 2159 - RNA, 21 nt, Artificial Sequence
  Ebola virus siRNA sense strand
ugaugcgaacaaauuuucuga

SEQ ID NO: 2160 - RNA, 21 nt, Artificial Sequence
  Ebola virus siRNA sense strand
gaugcgaacaaauuuucugau

SEQ ID NO: 2161 - RNA, 21 nt, Artificial Sequence
  Ebola virus siRNA sense strand
augcgaacaaauuuucugauc

SEQ ID NO: 2162 - RNA, 21 nt, Artificial Sequence
  Ebola virus siRNA sense strand
ugcgaacaaauuuucugauca

SEQ ID NO: 2163 - RNA, 21 nt, Artificial Sequence
  Ebola virus siRNA sense strand
gcgaacaaauuuucugaucaa

SEQ ID NO: 2164 - RNA, 21 nt, Artificial Sequence
  Ebola virus siRNA sense strand
cgaacaaauuuucugaucaaa

SEQ ID NO: 2165 - RNA, 21 nt, Artificial Sequence
  Ebola virus siRNA sense strand
gaacaaauuuucugaucaaau

SEQ ID NO: 2166 - RNA, 21 nt, Artificial Sequence
  Ebola virus siRNA sense strand
aacaaauuuucugaucaaauu

SEQ ID NO: 2167 - RNA, 21 nt, Artificial Sequence
  Ebola virus siRNA sense strand
acaaauuuucugaucaaauuu

SEQ ID NO: 2168 - RNA, 21 nt, Artificial Sequence
  Ebola virus siRNA sense strand
caaauuuucugaucaaauuuc

SEQ ID NO: 2169 - RNA, 21 nt, Artificial Sequence
  Ebola virus siRNA sense strand
aaauuuucugaucaaauuucu

SEQ ID NO: 2170 - RNA, 21 nt, Artificial Sequence
  Ebola virus siRNA sense strand
aauuuucugaucaaauuucuc

SEQ ID NO: 2171 - RNA, 21 nt, Artificial Sequence
  Ebola virus siRNA sense strand
auuuucugaucaaauuucucc

SEQ ID NO: 2172 - RNA, 21 nt, Artificial Sequence
  Ebola virus siRNA sense strand
uuuucugaucaaauuucuccu

SEQ ID NO: 2173 - RNA, 21 nt, Artificial Sequence
  Ebola virus siRNA sense strand
uuucugaucaaauuucuccua

SEQ ID NO: 2174 - RNA, 21 nt, Artificial Sequence
  Ebola virus siRNA sense strand
uucugaucaaauuucuccuaa

SEQ ID NO: 2175 - RNA, 21 nt, Artificial Sequence
  Ebola virus siRNA sense strand
ucugaucaaauuucuccuaau

SEQ ID NO: 2176 - RNA, 21 nt, Artificial Sequence
  Ebola virus siRNA sense strand
cugaucaaauuucuccuaaua

SEQ ID NO: 2177 - RNA, 21 nt, Artificial Sequence
  Ebola virus siRNA sense strand
ugaucaaauuucuccuaauac

SEQ ID NO: 2178 - RNA, 21 nt, Artificial Sequence
  Ebola virus siRNA sense strand
gaucaaauuucuccuaauaca

SEQ ID NO: 2179 - RNA, 21 nt, Artificial Sequence
  Ebola virus siRNA sense strand
aucaaauuucuccuaauacac

SEQ ID NO: 2180 - RNA, 21 nt, Artificial Sequence
  Ebola virus siRNA sense strand
ucaaauuucuccuaauacacc

SEQ ID NO: 2181 - RNA, 21 nt, Artificial Sequence
  Ebola virus siRNA sense strand
caaauuucuccuaauacacca

SEQ ID NO: 2182 - RNA, 21 nt, Artificial Sequence
  Ebola virus siRNA sense strand
aaauuucuccuaauacaccaa

SEQ ID NO: 2183 - RNA, 21 nt, Artificial Sequence
  Ebola virus siRNA sense strand
aauuucuccuaauacaccaag

SEQ ID NO: 2184 - RNA, 21 nt, Artificial Sequence
  Ebola virus siRNA sense strand
auuucuccuaauacaccaagg

SEQ ID NO: 2185 - RNA, 21 nt, Artificial Sequence
  Ebola virus siRNA sense strand
uuucuccuaauacaccaaggg

SEQ ID NO: 2186 - RNA, 21 nt, Artificial Sequence
  Ebola virus siRNA sense strand
uucuccuaauacaccaaggga

SEQ ID NO: 2187 - RNA, 21 nt, Artificial Sequence
  Ebola virus siRNA sense strand
ucuccuaauacaccaagggau

SEQ ID NO: 2188 - RNA, 21 nt, Artificial Sequence
  Ebola virus siRNA sense strand
cuccuaauacaccaagggaug

SEQ ID NO: 2189 - RNA, 21 nt, Artificial Sequence
  Ebola virus siRNA sense strand
uccuaauacaccaagggaugc

SEQ ID NO: 2190 - RNA, 21 nt, Artificial Sequence
  Ebola virus siRNA sense strand
ccuaauacaccaagggaugca

SEQ ID NO: 2191 - RNA, 21 nt, Artificial Sequence
  Ebola virus siRNA sense strand
cuaauacaccaagggaugcac

SEQ ID NO: 2192 - RNA, 21 nt, Artificial Sequence
  Ebola virus siRNA sense strand
uaauacaccaagggaugcaca

SEQ ID NO: 2193 - RNA, 21 nt, Artificial Sequence
  Ebola virus siRNA sense strand
aauacaccaagggaugcacau

SEQ ID NO: 2194 - RNA, 21 nt, Artificial Sequence
  Ebola virus siRNA sense strand
auacaccaagggaugcacaug

SEQ ID NO: 2195 - RNA, 21 nt, Artificial Sequence
  Ebola virus siRNA sense strand
uacaccaagggaugcacaugg

SEQ ID NO: 2196 - RNA, 21 nt, Artificial Sequence
  Ebola virus siRNA sense strand
acaccaagggaugcacauggu

SEQ ID NO: 2197 - RNA, 21 nt, Artificial Sequence
  Ebola virus siRNA sense strand
caccaagggaugcacaugguu

SEQ ID NO: 2198 - RNA, 21 nt, Artificial Sequence
  Ebola virus siRNA sense strand
accaagggaugcacaugguug

SEQ ID NO: 2199 - RNA, 21 nt, Artificial Sequence
  Ebola virus siRNA sense strand
ccaagggaugcacaugguugc

SEQ ID NO: 2200 - RNA, 21 nt, Artificial Sequence
  Ebola virus siRNA sense strand
caagggaugcacaugguugcc

SEQ ID NO: 2201 - RNA, 21 nt, Artificial Sequence
  Ebola virus siRNA sense strand
aagggaugcacaugguugccg

SEQ ID NO: 2202 - RNA, 21 nt, Artificial Sequence
  Ebola virus siRNA sense strand
agggaugcacaugguugccgg

SEQ ID NO: 2203 - RNA, 21 nt, Artificial Sequence
  Ebola virus siRNA sense strand
gggaugcacaugguugccggg

SEQ ID NO: 2204 - RNA, 21 nt, Artificial Sequence
  Ebola virus siRNA sense strand
ggaugcacaugguugccgggc

SEQ ID NO: 2205 - RNA, 21 nt, Artificial Sequence
  Ebola virus siRNA sense strand
gaugcacaugguugccgggca

SEQ ID NO: 2206 - RNA, 21 nt, Artificial Sequence
  Ebola virus siRNA sense strand
augcacaugguugccgggcau

SEQ ID NO: 2207 - RNA, 21 nt, Artificial Sequence
  Ebola virus siRNA sense strand
ugcacaugguugccgggcaug

SEQ ID NO: 2208 - RNA, 21 nt, Artificial Sequence
  Ebola virus siRNA sense strand
gcacaugguugccgggcauga

SEQ ID NO: 2209 - RNA, 21 nt, Artificial Sequence
  Ebola virus siRNA sense strand
cacaugguugccgggcaugau

SEQ ID NO: 2210 - RNA, 21 nt, Artificial Sequence
  Ebola virus siRNA sense strand
acaugguugccgggcaugaug

SEQ ID NO: 2211 - RNA, 21 nt, Artificial Sequence
  Ebola virus siRNA sense strand
caugguugccgggcaugaugc

SEQ ID NO: 2212 - RNA, 21 nt, Artificial Sequence
  Ebola virus siRNA sense strand
augguugccgggcaugaugcc

SEQ ID NO: 2213 - RNA, 21 nt, Artificial Sequence
  Ebola virus siRNA sense strand
ugguugccgggcaugaugcca

SEQ ID NO: 2214 - RNA, 21 nt, Artificial Sequence
  Ebola virus siRNA sense strand
gguugccgggcaugaugccaa

SEQ ID NO: 2215 - RNA, 21 nt, Artificial Sequence
  Ebola virus siRNA sense strand
guugccgggcaugaugccaac

SEQ ID NO: 2216 - RNA, 21 nt, Artificial Sequence
  Ebola virus siRNA sense strand
uugccgggcaugaugccaacg

SEQ ID NO: 2217 - RNA, 21 nt, Artificial Sequence
  Ebola virus siRNA sense strand
ugccgggcaugaugccaacga

SEQ ID NO: 2218 - RNA, 21 nt, Artificial Sequence
  Ebola virus siRNA sense strand
gccgggcaugaugccaacgau

SEQ ID NO: 2219 - RNA, 21 nt, Artificial Sequence
  Ebola virus siRNA sense strand
ccgggcaugaugccaacgaug

SEQ ID NO: 2220 - RNA, 21 nt, Artificial Sequence
  Ebola virus siRNA sense strand
cgggcaugaugccaacgaugc

SEQ ID NO: 2221 - RNA, 21 nt, Artificial Sequence
  Ebola virus siRNA sense strand
gggcaugaugccaacgaugcu

SEQ ID NO: 2222 - RNA, 21 nt, Artificial Sequence
  Ebola virus siRNA sense strand
ggcaugaugccaacgaugcug

SEQ ID NO: 2223 - RNA, 21 nt, Artificial Sequence
  Ebola virus siRNA sense strand
gcaugaugccaacgaugcugu

SEQ ID NO: 2224 - RNA, 21 nt, Artificial Sequence
  Ebola virus siRNA sense strand
caugaugccaacgaugcugug

SEQ ID NO: 2225 - RNA, 21 nt, Artificial Sequence
  Ebola virus siRNA sense strand
augaugccaacgaugcuguga

SEQ ID NO: 2226 - RNA, 21 nt, Artificial Sequence
  Ebola virus siRNA sense strand
ugaugccaacgaugcugugau

SEQ ID NO: 2227 - RNA, 21 nt, Artificial Sequence
  Ebola virus siRNA sense strand
gaugccaacgaugcugugauu

SEQ ID NO: 2228 - RNA, 21 nt, Artificial Sequence
  Ebola virus siRNA sense strand
augccaacgaugcugugauuu

SEQ ID NO: 2229 - RNA, 21 nt, Artificial Sequence
  Ebola virus siRNA sense strand
ugccaacgaugcugugauuuc

SEQ ID NO: 2230 - RNA, 21 nt, Artificial Sequence
  Ebola virus siRNA sense strand
gccaacgaugcugugauuuca

SEQ ID NO: 2231 - RNA, 21 nt, Artificial Sequence
  Ebola virus siRNA sense strand
ccaacgaugcugugauuucaa

SEQ ID NO: 2232 - RNA, 21 nt, Artificial Sequence
  Ebola virus siRNA sense strand
caacgaugcugugauuucaaa

SEQ ID NO: 2233 - RNA, 21 nt, Artificial Sequence
  Ebola virus siRNA sense strand
aacgaugcugugauuucaaau

SEQ ID NO: 2234 - RNA, 21 nt, Artificial Sequence
  Ebola virus siRNA sense strand
acgaugcugugauuucaaauu

SEQ ID NO: 2235 - RNA, 21 nt, Artificial Sequence
  Ebola virus siRNA sense strand
cgaugcugugauuucaaauuc

SEQ ID NO: 2236 - RNA, 21 nt, Artificial Sequence
  Ebola virus siRNA sense strand
gaugcugugauuucaaauuca

SEQ ID NO: 2237 - RNA, 21 nt, Artificial Sequence
  Ebola virus siRNA sense strand
augcugugauuucaaauucag

SEQ ID NO: 2238 - RNA, 21 nt, Artificial Sequence
  Ebola virus siRNA sense strand
ugcugugauuucaaauucagu

SEQ ID NO: 2239 - RNA, 21 nt, Artificial Sequence
  Ebola virus siRNA sense strand
gcugugauuucaaauucagug

SEQ ID NO: 2240 - RNA, 21 nt, Artificial Sequence
  Ebola virus siRNA sense strand
cugugauuucaaauucagugg

SEQ ID NO: 2241 - RNA, 21 nt, Artificial Sequence
  Ebola virus siRNA sense strand
ugugauuucaaauucaguggc

SEQ ID NO: 2242 - RNA, 21 nt, Artificial Sequence
  Ebola virus siRNA sense strand
gugauuucaaauucaguggcu

SEQ ID NO: 2243 - RNA, 21 nt, Artificial Sequence
  Ebola virus siRNA sense strand
ugauuucaaauucaguggcuc

SEQ ID NO: 2244 - RNA, 21 nt, Artificial Sequence
  Ebola virus siRNA sense strand
gauuucaaauucaguggcuca

SEQ ID NO: 2245 - RNA, 21 nt, Artificial Sequence
  Ebola virus siRNA sense strand
auuucaaauucaguggcucaa

SEQ ID NO: 2246 - RNA, 21 nt, Artificial Sequence
  Ebola virus siRNA sense strand
uuucaaauucaguggcucaag

SEQ ID NO: 2247 - RNA, 21 nt, Artificial Sequence
  Ebola virus siRNA sense strand
uucaaauucaguggcucaagc

SEQ ID NO: 2248 - RNA, 21 nt, Artificial Sequence
  Ebola virus siRNA sense strand
ucaaauucaguggcucaagcu

SEQ ID NO: 2249 - RNA, 21 nt, Artificial Sequence
  Ebola virus siRNA sense strand
caaauucaguggcucaagcuc

SEQ ID NO: 2250 - RNA, 21 nt, Artificial Sequence
  Ebola virus siRNA sense strand
aaauucaguggcucaagcucg

SEQ ID NO: 2251 - RNA, 21 nt, Artificial Sequence
  Ebola virus siRNA sense strand
aauucaguggcucaagcucgu

SEQ ID NO: 2252 - RNA, 21 nt, Artificial Sequence
  Ebola virus siRNA sense strand
auucaguggcucaagcucguu

SEQ ID NO: 2253 - RNA, 21 nt, Artificial Sequence
  Ebola virus siRNA sense strand
uucaguggcucaagcucguuu

SEQ ID NO: 2254 - RNA, 21 nt, Artificial Sequence
  Ebola virus siRNA sense strand
ucaguggcucaagcucguuuu

SEQ ID NO: 2255 - RNA, 21 nt, Artificial Sequence
  Ebola virus siRNA sense strand
caguggcucaagcucguuuuu

SEQ ID NO: 2256 - RNA, 21 nt, Artificial Sequence
  Ebola virus siRNA sense strand
aguggcucaagcucguuuuuc

SEQ ID NO: 2257 - RNA, 21 nt, Artificial Sequence
  Ebola virus siRNA sense strand
guggcucaagcucguuuuuca

SEQ ID NO: 2258 - RNA, 21 nt, Artificial Sequence
  Ebola virus siRNA sense strand
uggcucaagcucguuuuucag

SEQ ID NO: 2259 - RNA, 21 nt, Artificial Sequence
  Ebola virus siRNA sense strand
ggcucaagcucguuuuucagg

SEQ ID NO: 2260 - RNA, 21 nt, Artificial Sequence
  Ebola virus siRNA sense strand
gcucaagcucguuuuucaggc

SEQ ID NO: 2261 - RNA, 21 nt, Artificial Sequence
  Ebola virus siRNA sense strand
cucaagcucguuuuucaggcu

SEQ ID NO: 2262 - RNA, 21 nt, Artificial Sequence
  Ebola virus siRNA sense strand
ucaagcucguuuuucaggcuu

SEQ ID NO: 2263 - RNA, 21 nt, Artificial Sequence
  Ebola virus siRNA sense strand
caagcucguuuuucaggcuua

SEQ ID NO: 2264 - RNA, 21 nt, Artificial Sequence
  Ebola virus siRNA sense strand
aagcucguuuuucaggcuuau

SEQ ID NO: 2265 - RNA, 21 nt, Artificial Sequence
  Ebola virus siRNA sense strand
agcucguuuuucaggcuuauu

SEQ ID NO: 2266 - RNA, 21 nt, Artificial Sequence
  Ebola virus siRNA sense strand
gcucguuuuucaggcuuauug

SEQ ID NO: 2267 - RNA, 21 nt, Artificial Sequence
  Ebola virus siRNA sense strand
cucguuuuucaggcuuauuga

SEQ ID NO: 2268 - RNA, 21 nt, Artificial Sequence
  Ebola virus siRNA sense strand
ucguuuuucaggcuuauugau

SEQ ID NO: 2269 - RNA, 21 nt, Artificial Sequence
  Ebola virus siRNA sense strand
cguuuuucaggcuuauugauu

SEQ ID NO: 2270 - RNA, 21 nt, Artificial Sequence
  Ebola virus siRNA sense strand
guuuuucaggcuuauugauug

SEQ ID NO: 2271 - RNA, 21 nt, Artificial Sequence
  Ebola virus siRNA sense strand
uuuuucaggcuuauugauugu

SEQ ID NO: 2272 - RNA, 21 nt, Artificial Sequence
  Ebola virus siRNA sense strand
uuuucaggcuuauugauuguc

SEQ ID NO: 2273 - RNA, 21 nt, Artificial Sequence
  Ebola virus siRNA sense strand
uuucaggcuuauugauuguca

SEQ ID NO: 2274 - RNA, 21 nt, Artificial Sequence
  Ebola virus siRNA sense strand
uucaggcuuauugauugucaa

SEQ ID NO: 2275 - RNA, 21 nt, Artificial Sequence
  Ebola virus siRNA sense strand
ucaggcuuauugauugucaaa

SEQ ID NO: 2276 - RNA, 21 nt, Artificial Sequence
  Ebola virus siRNA sense strand
caggcuuauugauugucaaaa

SEQ ID NO: 2277 - RNA, 21 nt, Artificial Sequence
  Ebola virus siRNA sense strand
aggcuuauugauugucaaaac

SEQ ID NO: 2278 - RNA, 21 nt, Artificial Sequence
  Ebola virus siRNA sense strand
ggcuuauugauugucaaaaca

SEQ ID NO: 2279 - RNA, 21 nt, Artificial Sequence
  Ebola virus siRNA sense strand
gcuuauugauugucaaaacag

SEQ ID NO: 2280 - RNA, 21 nt, Artificial Sequence
  Ebola virus siRNA sense strand
cuuauugauugucaaaacagu

SEQ ID NO: 2281 - RNA, 21 nt, Artificial Sequence
  Ebola virus siRNA sense strand
uuauugauugucaaaacagua

SEQ ID NO: 2282 - RNA, 21 nt, Artificial Sequence
  Ebola virus siRNA sense strand
uauugauugucaaaacaguac

SEQ ID NO: 2283 - RNA, 21 nt, Artificial Sequence
  Ebola virus siRNA sense strand
auugauugucaaaacaguacu

SEQ ID NO: 2284 - RNA, 21 nt, Artificial Sequence
  Ebola virus siRNA sense strand
uugauugucaaaacaguacuu

SEQ ID NO: 2285 - RNA, 21 nt, Artificial Sequence
  Ebola virus siRNA sense strand
ugauugucaaaacaguacuug

SEQ ID NO: 2286 - RNA, 21 nt, Artificial Sequence
  Ebola virus siRNA sense strand
gauugucaaaacaguacuuga

SEQ ID NO: 2287 - RNA, 21 nt, Artificial Sequence
  Ebola virus siRNA sense strand
auugucaaaacaguacuugau

SEQ ID NO: 2288 - RNA, 21 nt, Artificial Sequence
  Ebola virus siRNA sense strand
uugucaaaacaguacuugauc

SEQ ID NO: 2289 - RNA, 21 nt, Artificial Sequence
  Ebola virus siRNA sense strand
ugucaaaacaguacuugauca

SEQ ID NO: 2290 - RNA, 21 nt, Artificial Sequence
  Ebola virus siRNA sense strand
gucaaaacaguacuugaucau

SEQ ID NO: 2291 - RNA, 21 nt, Artificial Sequence
  Ebola virus siRNA sense strand
ucaaaacaguacuugaucaua

SEQ ID NO: 2292 - RNA, 21 nt, Artificial Sequence
  Ebola virus siRNA sense strand
caaaacaguacuugaucauau

SEQ ID NO: 2293 - RNA, 21 nt, Artificial Sequence
  Ebola virus siRNA sense strand
aaaacaguacuugaucauauc

SEQ ID NO: 2294 - RNA, 21 nt, Artificial Sequence
  Ebola virus siRNA sense strand
aaacaguacuugaucauaucc

SEQ ID NO: 2295 - RNA, 21 nt, Artificial Sequence
  Ebola virus siRNA sense strand
aacaguacuugaucauauccu

SEQ ID NO: 2296 - RNA, 21 nt, Artificial Sequence
  Ebola virus siRNA sense strand
acaguacuugaucauauccua

SEQ ID NO: 2297 - RNA, 21 nt, Artificial Sequence
  Ebola virus siRNA sense strand
caguacuugaucauauccuac

SEQ ID NO: 2298 - RNA, 21 nt, Artificial Sequence
  Ebola virus siRNA sense strand
aguacuugaucauauccuaca

SEQ ID NO: 2299 - RNA, 21 nt, Artificial Sequence
  Ebola virus siRNA sense strand
guacuugaucauauccuacaa

SEQ ID NO: 2300 - RNA, 21 nt, Artificial Sequence
  Ebola virus siRNA sense strand
uacuugaucauauccuacaaa

SEQ ID NO: 2301 - RNA, 21 nt, Artificial Sequence
  Ebola virus siRNA sense strand
acuugaucauauccuacaaaa

SEQ ID NO: 2302 - RNA, 21 nt, Artificial Sequence
  Ebola virus siRNA sense strand
cuugaucauauccuacaaaag

SEQ ID NO: 2303 - RNA, 21 nt, Artificial Sequence
  Ebola virus siRNA sense strand
uugaucauauccuacaaaaga

SEQ ID NO: 2304 - RNA, 21 nt, Artificial Sequence
  Ebola virus siRNA sense strand
ugaucauauccuacaaaagac

SEQ ID NO: 2305 - RNA, 21 nt, Artificial Sequence
  Ebola virus siRNA sense strand
gaucauauccuacaaaagaca

SEQ ID NO: 2306 - RNA, 21 nt, Artificial Sequence
  Ebola virus siRNA sense strand
aucauauccuacaaaagacag

SEQ ID NO: 2307 - RNA, 21 nt, Artificial Sequence
  Ebola virus siRNA sense strand
ucauauccuacaaaagacaga

SEQ ID NO: 2308 - RNA, 21 nt, Artificial Sequence
  Ebola virus siRNA sense strand
cauauccuacaaaagacagaa

SEQ ID NO: 2309 - RNA, 21 nt, Artificial Sequence
  Ebola virus siRNA sense strand
auauccuacaaaagacagaac

SEQ ID NO: 2310 - RNA, 21 nt, Artificial Sequence
  Ebola virus siRNA sense strand
uauccuacaaaagacagaacg

SEQ ID NO: 2311 - RNA, 21 nt, Artificial Sequence
  Ebola virus siRNA sense strand
auccuacaaaagacagaacga

SEQ ID NO: 2312 - RNA, 21 nt, Artificial Sequence
  Ebola virus siRNA sense strand
uccuacaaaagacagaacgag

SEQ ID NO: 2313 - RNA, 21 nt, Artificial Sequence
  Ebola virus siRNA sense strand
ccuacaaaagacagaacgagg

SEQ ID NO: 2314 - RNA, 21 nt, Artificial Sequence
  Ebola virus siRNA sense strand
cuacaaaagacagaacgagga

SEQ ID NO: 2315 - RNA, 21 nt, Artificial Sequence
  Ebola virus siRNA sense strand
uacaaaagacagaacgaggag

SEQ ID NO: 2316 - RNA, 21 nt, Artificial Sequence
  Ebola virus siRNA sense strand
acaaaagacagaacgaggagu

SEQ ID NO: 2317 - RNA, 21 nt, Artificial Sequence
  Ebola virus siRNA sense strand
caaaagacagaacgaggaguu

SEQ ID NO: 2318 - RNA, 21 nt, Artificial Sequence
  Ebola virus siRNA sense strand
aaaagacagaacgaggaguuc

SEQ ID NO: 2319 - RNA, 21 nt, Artificial Sequence
  Ebola virus siRNA sense strand
aaagacagaacgaggaguucg

SEQ ID NO: 2320 - RNA, 21 nt, Artificial Sequence
  Ebola virus siRNA sense strand
aagacagaacgaggaguucgu

SEQ ID NO: 2321 - RNA, 21 nt, Artificial Sequence
  Ebola virus siRNA sense strand
agacagaacgaggaguucguc

SEQ ID NO: 2322 - RNA, 21 nt, Artificial Sequence
  Ebola virus siRNA sense strand
gacagaacgaggaguucgucu

SEQ ID NO: 2323 - RNA, 21 nt, Artificial Sequence
  Ebola virus siRNA sense strand
acagaacgaggaguucgucuc

SEQ ID NO: 2324 - RNA, 21 nt, Artificial Sequence
  Ebola virus siRNA sense strand
cagaacgaggaguucgucucc

SEQ ID NO: 2325 - RNA, 21 nt, Artificial Sequence
  Ebola virus siRNA sense strand
agaacgaggaguucgucucca

SEQ ID NO: 2326 - RNA, 21 nt, Artificial Sequence
  Ebola virus siRNA sense strand
gaacgaggaguucgucuccau

SEQ ID NO: 2327 - RNA, 21 nt, Artificial Sequence
  Ebola virus siRNA sense strand
aacgaggaguucgucuccauc

SEQ ID NO: 2328 - RNA, 21 nt, Artificial Sequence
  Ebola virus siRNA sense strand
acgaggaguucgucuccaucc

SEQ ID NO: 2329 - RNA, 21 nt, Artificial Sequence
  Ebola virus siRNA sense strand
cgaggaguucgucuccauccu

SEQ ID NO: 2330 - RNA, 21 nt, Artificial Sequence
  Ebola virus siRNA sense strand
gaggaguucgucuccauccuc

SEQ ID NO: 2331 - RNA, 21 nt, Artificial Sequence
  Ebola virus siRNA sense strand
aggaguucgucuccauccucu

SEQ ID NO: 2332 - RNA, 21 nt, Artificial Sequence
  Ebola virus siRNA sense strand
ggaguucgucuccauccucuu

SEQ ID NO: 2333 - RNA, 21 nt, Artificial Sequence
  Ebola virus siRNA sense strand
gaguucgucuccauccucuug

SEQ ID NO: 2334 - RNA, 21 nt, Artificial Sequence
  Ebola virus siRNA sense strand
aguucgucuccauccucuugc

SEQ ID NO: 2335 - RNA, 21 nt, Artificial Sequence
  Ebola virus siRNA sense strand
guucgucuccauccucuugca

SEQ ID NO: 2336 - RNA, 21 nt, Artificial Sequence
  Ebola virus siRNA sense strand
uucgucuccauccucuugcaa

SEQ ID NO: 2337 - RNA, 21 nt, Artificial Sequence
  Ebola virus siRNA sense strand
ucgucuccauccucuugcaag

SEQ ID NO: 2338 - RNA, 21 nt, Artificial Sequence
  Ebola virus siRNA sense strand
cgucuccauccucuugcaagg

SEQ ID NO: 2339 - RNA, 21 nt, Artificial Sequence
  Ebola virus siRNA sense strand
gucuccauccucuugcaagga

SEQ ID NO: 2340 - RNA, 21 nt, Artificial Sequence
  Ebola virus siRNA sense strand
ucuccauccucuugcaaggac

SEQ ID NO: 2341 - RNA, 21 nt, Artificial Sequence
  Ebola virus siRNA sense strand
cuccauccucuugcaaggacc

SEQ ID NO: 2342 - RNA, 21 nt, Artificial Sequence
  Ebola virus siRNA sense strand
uccauccucuugcaaggaccg

SEQ ID NO: 2343 - RNA, 21 nt, Artificial Sequence
  Ebola virus siRNA sense strand
ccauccucuugcaaggaccgc

SEQ ID NO: 2344 - RNA, 21 nt, Artificial Sequence
  Ebola virus siRNA sense strand
cauccucuugcaaggaccgcc

SEQ ID NO: 2345 - RNA, 21 nt, Artificial Sequence
  Ebola virus siRNA sense strand
auccucuugcaaggaccgcca

SEQ ID NO: 2346 - RNA, 21 nt, Artificial Sequence
  Ebola virus siRNA sense strand
uccucuugcaaggaccgccaa

SEQ ID NO: 2347 - RNA, 21 nt, Artificial Sequence
  Ebola virus siRNA sense strand
ccucuugcaaggaccgccaag

SEQ ID NO: 2348 - RNA, 21 nt, Artificial Sequence
  Ebola virus siRNA sense strand
cucuugcaaggaccgccaagg

SEQ ID NO: 2349 - RNA, 21 nt, Artificial Sequence
  Ebola virus siRNA sense strand
ucuugcaaggaccgccaaggu

SEQ ID NO: 2350 - RNA, 21 nt, Artificial Sequence
  Ebola virus siRNA sense strand
cuugcaaggaccgccaaggua

SEQ ID NO: 2351 - RNA, 21 nt, Artificial Sequence
  Ebola virus siRNA sense strand
uugcaaggaccgccaagguaa

SEQ ID NO: 2352 - RNA, 21 nt, Artificial Sequence
  Ebola virus siRNA sense strand
ugcaaggaccgccaagguaaa

SEQ ID NO: 2353 - RNA, 21 nt, Artificial Sequence
  Ebola virus siRNA sense strand
gcaaggaccgccaagguaaaa

SEQ ID NO: 2354 - RNA, 21 nt, Artificial Sequence
  Ebola virus siRNA sense strand
caaggaccgccaagguaaaaa

SEQ ID NO: 2355 - RNA, 21 nt, Artificial Sequence
  Ebola virus siRNA sense strand
aaggaccgccaagguaaaaaa

SEQ ID NO: 2356 - RNA, 21 nt, Artificial Sequence
  Ebola virus siRNA sense strand
aggaccgccaagguaaaaaau

SEQ ID NO: 2357 - RNA, 21 nt, Artificial Sequence
  Ebola virus siRNA sense strand
ggaccgccaagguaaaaaaug

SEQ ID NO: 2358 - RNA, 21 nt, Artificial Sequence
  Ebola virus siRNA sense strand
gaccgccaagguaaaaaauga

SEQ ID NO: 2359 - RNA, 21 nt, Artificial Sequence
  Ebola virus siRNA sense strand
accgccaagguaaaaaaugag

SEQ ID NO: 2360 - RNA, 21 nt, Artificial Sequence
  Ebola virus siRNA sense strand
ccgccaagguaaaaaaugagg

SEQ ID NO: 2361 - RNA, 21 nt, Artificial Sequence
  Ebola virus siRNA sense strand
cgccaagguaaaaaaugaggu

SEQ ID NO: 2362 - RNA, 21 nt, Artificial Sequence
  Ebola virus siRNA sense strand
gccaagguaaaaaaugaggug

SEQ ID NO: 2363 - RNA, 21 nt, Artificial Sequence
  Ebola virus siRNA sense strand
ccaagguaaaaaaugagguga

SEQ ID NO: 2364 - RNA, 21 nt, Artificial Sequence
  Ebola virus siRNA sense strand
caagguaaaaaaugaggugaa

SEQ ID NO: 2365 - RNA, 21 nt, Artificial Sequence
  Ebola virus siRNA sense strand
aagguaaaaaaugaggugaac

SEQ ID NO: 2366 - RNA, 21 nt, Artificial Sequence
  Ebola virus siRNA sense strand
agguaaaaaaugaggugaacu

SEQ ID NO: 2367 - RNA, 21 nt, Artificial Sequence
  Ebola virus siRNA sense strand
gguaaaaaaugaggugaacuc

SEQ ID NO: 2368 - RNA, 21 nt, Artificial Sequence
  Ebola virus siRNA sense strand
guaaaaaaugaggugaacucc

SEQ ID NO: 2369 - RNA, 21 nt, Artificial Sequence
  Ebola virus siRNA sense strand
uaaaaaaugaggugaacuccu

SEQ ID NO: 2370 - RNA, 21 nt, Artificial Sequence
  Ebola virus siRNA sense strand
aaaaaaugaggugaacuccuu

SEQ ID NO: 2371 - RNA, 21 nt, Artificial Sequence
  Ebola virus siRNA sense strand
aaaaaugaggugaacuccuuu

SEQ ID NO: 2372 - RNA, 21 nt, Artificial Sequence
  Ebola virus siRNA sense strand
aaaaugaggugaacuccuuua

SEQ ID NO: 2373 - RNA, 21 nt, Artificial Sequence
  Ebola virus siRNA sense strand
aaaugaggugaacuccuuuaa

SEQ ID NO: 2374 - RNA, 21 nt, Artificial Sequence
  Ebola virus siRNA sense strand
aaugaggugaacuccuuuaag

SEQ ID NO: 2375 - RNA, 21 nt, Artificial Sequence
  Ebola virus siRNA sense strand
augaggugaacuccuuuaagg

SEQ ID NO: 2376 - RNA, 21 nt, Artificial Sequence
  Ebola virus siRNA sense strand
ugaggugaacuccuuuaaggc

SEQ ID NO: 2377 - RNA, 21 nt, Artificial Sequence
  Ebola virus siRNA sense strand
gaggugaacuccuuuaaggcu

SEQ ID NO: 2378 - RNA, 21 nt, Artificial Sequence
  Ebola virus siRNA sense strand
aggugaacuccuuuaaggcug

SEQ ID NO: 2379 - RNA, 21 nt, Artificial Sequence
  Ebola virus siRNA sense strand
ggugaacuccuuuaaggcugc

SEQ ID NO: 2380 - RNA, 21 nt, Artificial Sequence
  Ebola virus siRNA sense strand
gugaacuccuuuaaggcugca

SEQ ID NO: 2381 - RNA, 21 nt, Artificial Sequence
  Ebola virus siRNA sense strand
ugaacuccuuuaaggcugcac

SEQ ID NO: 2382 - RNA, 21 nt, Artificial Sequence
  Ebola virus siRNA sense strand
gaacuccuuuaaggcugcacu

SEQ ID NO: 2383 - RNA, 21 nt, Artificial Sequence
  Ebola virus siRNA sense strand
aacuccuuuaaggcugcacuc

SEQ ID NO: 2384 - RNA, 21 nt, Artificial Sequence
  Ebola virus siRNA sense strand
acuccuuuaaggcugcacuca

SEQ ID NO: 2385 - RNA, 21 nt, Artificial Sequence
  Ebola virus siRNA sense strand
cuccuuuaaggcugcacucag

SEQ ID NO: 2386 - RNA, 21 nt, Artificial Sequence
  Ebola virus siRNA sense strand
uccuuuaaggcugcacucagc

SEQ ID NO: 2387 - RNA, 21 nt, Artificial Sequence
  Ebola virus siRNA sense strand
ccuuuaaggcugcacucagcu

SEQ ID NO: 2388 - RNA, 21 nt, Artificial Sequence
  Ebola virus siRNA sense strand
cuuuaaggcugcacucagcuc

SEQ ID NO: 2389 - RNA, 21 nt, Artificial Sequence
  Ebola virus siRNA sense strand
uuuaaggcugcacucagcucc

SEQ ID NO: 2390 - RNA, 21 nt, Artificial Sequence
  Ebola virus siRNA sense strand
uuaaggcugcacucagcuccc

SEQ ID NO: 2391 - RNA, 21 nt, Artificial Sequence
  Ebola virus siRNA sense strand
uaaggcugcacucagcucccu

SEQ ID NO: 2392 - RNA, 21 nt, Artificial Sequence
  Ebola virus siRNA sense strand
aaggcugcacucagcucccug

SEQ ID NO: 2393 - RNA, 21 nt, Artificial Sequence
  Ebola virus siRNA sense strand
aggcugcacucagcucccugg

SEQ ID NO: 2394 - RNA, 21 nt, Artificial Sequence
  Ebola virus siRNA sense strand
ggcugcacucagcucccuggc

SEQ ID NO: 2395 - RNA, 21 nt, Artificial Sequence
  Ebola virus siRNA sense strand
gcugcacucagcucccuggcc

SEQ ID NO: 2396 - RNA, 21 nt, Artificial Sequence
  Ebola virus siRNA sense strand
cugcacucagcucccuggcca

SEQ ID NO: 2397 - RNA, 21 nt, Artificial Sequence
  Ebola virus siRNA sense strand
ugcacucagcucccuggccaa

SEQ ID NO: 2398 - RNA, 21 nt, Artificial Sequence
  Ebola virus siRNA sense strand
gcacucagcucccuggccaag

SEQ ID NO: 2399 - RNA, 21 nt, Artificial Sequence
  Ebola virus siRNA sense strand
cacucagcucccuggccaagc

SEQ ID NO: 2400 - RNA, 21 nt, Artificial Sequence
  Ebola virus siRNA sense strand
acucagcucccuggccaagca

SEQ ID NO: 2401 - RNA, 21 nt, Artificial Sequence
  Ebola virus siRNA sense strand
cucagcucccuggccaagcau

SEQ ID NO: 2402 - RNA, 21 nt, Artificial Sequence
  Ebola virus siRNA sense strand
ucagcucccuggccaagcaug

SEQ ID NO: 2403 - RNA, 21 nt, Artificial Sequence
  Ebola virus siRNA sense strand
cagcucccuggccaagcaugg

SEQ ID NO: 2404 - RNA, 21 nt, Artificial Sequence
  Ebola virus siRNA sense strand
agcucccuggccaagcaugga

SEQ ID NO: 2405 - RNA, 21 nt, Artificial Sequence
  Ebola virus siRNA sense strand
gcucccuggccaagcauggag

SEQ ID NO: 2406 - RNA, 21 nt, Artificial Sequence
  Ebola virus siRNA sense strand
cucccuggccaagcauggaga

SEQ ID NO: 2407 - RNA, 21 nt, Artificial Sequence
  Ebola virus siRNA sense strand
ucccuggccaagcauggagag

SEQ ID NO: 2408 - RNA, 21 nt, Artificial Sequence
  Ebola virus siRNA sense strand
cccuggccaagcauggagagu

SEQ ID NO: 2409 - RNA, 21 nt, Artificial Sequence
  Ebola virus siRNA sense strand
ccuggccaagcauggagagua

SEQ ID NO: 2410 - RNA, 21 nt, Artificial Sequence
  Ebola virus siRNA sense strand
cuggccaagcauggagaguau

SEQ ID NO: 2411 - RNA, 21 nt, Artificial Sequence
  Ebola virus siRNA sense strand
uggccaagcauggagaguaug

SEQ ID NO: 2412 - RNA, 21 nt, Artificial Sequence
  Ebola virus siRNA sense strand
ggccaagcauggagaguaugc

SEQ ID NO: 2413 - RNA, 21 nt, Artificial Sequence
  Ebola virus siRNA sense strand
gccaagcauggagaguaugcu

SEQ ID NO: 2414 - RNA, 21 nt, Artificial Sequence
  Ebola virus siRNA sense strand
ccaagcauggagaguaugcuc

SEQ ID NO: 2415 - RNA, 21 nt, Artificial Sequence
  Ebola virus siRNA sense strand
caagcauggagaguaugcucc

SEQ ID NO: 2416 - RNA, 21 nt, Artificial Sequence
  Ebola virus siRNA sense strand
aagcauggagaguaugcuccu

SEQ ID NO: 2417 - RNA, 21 nt, Artificial Sequence
  Ebola virus siRNA sense strand
agcauggagaguaugcuccuu

SEQ ID NO: 2418 - RNA, 21 nt, Artificial Sequence
  Ebola virus siRNA sense strand
gcauggagaguaugcuccuuu

SEQ ID NO: 2419 - RNA, 21 nt, Artificial Sequence
  Ebola virus siRNA sense strand
cauggagaguaugcuccuuuc

SEQ ID NO: 2420 - RNA, 21 nt, Artificial Sequence
  Ebola virus siRNA sense strand
auggagaguaugcuccuuucg

SEQ ID NO: 2421 - RNA, 21 nt, Artificial Sequence
  Ebola virus siRNA sense strand
uggagaguaugcuccuuucgc

SEQ ID NO: 2422 - RNA, 21 nt, Artificial Sequence
  Ebola virus siRNA sense strand
ggagaguaugcuccuuucgcc

SEQ ID NO: 2423 - RNA, 21 nt, Artificial Sequence
  Ebola virus siRNA sense strand
gagaguaugcuccuuucgccc

SEQ ID NO: 2424 - RNA, 21 nt, Artificial Sequence
  Ebola virus siRNA sense strand
agaguaugcuccuuucgcccg

SEQ ID NO: 2425 - RNA, 21 nt, Artificial Sequence
  Ebola virus siRNA sense strand
gaguaugcuccuuucgcccga

SEQ ID NO: 2426 - RNA, 21 nt, Artificial Sequence
  Ebola virus siRNA sense strand
aguaugcuccuuucgcccgac

SEQ ID NO: 2427 - RNA, 21 nt, Artificial Sequence
  Ebola virus siRNA sense strand
guaugcuccuuucgcccgacu

SEQ ID NO: 2428 - RNA, 21 nt, Artificial Sequence
  Ebola virus siRNA sense strand
uaugcuccuuucgcccgacuu

SEQ ID NO: 2429 - RNA, 21 nt, Artificial Sequence
  Ebola virus siRNA sense strand
augcuccuuucgcccgacuuu

SEQ ID NO: 2430 - RNA, 21 nt, Artificial Sequence
  Ebola virus siRNA sense strand
ugcuccuuucgcccgacuuuu

SEQ ID NO: 2431 - RNA, 21 nt, Artificial Sequence
  Ebola virus siRNA sense strand
gcuccuuucgcccgacuuuug

SEQ ID NO: 2432 - RNA, 21 nt, Artificial Sequence
  Ebola virus siRNA sense strand
cuccuuucgcccgacuuuuga

SEQ ID NO: 2433 - RNA, 21 nt, Artificial Sequence
  Ebola virus siRNA sense strand
uccuuucgcccgacuuuugaa

SEQ ID NO: 2434 - RNA, 21 nt, Artificial Sequence
  Ebola virus siRNA sense strand
ccuuucgcccgacuuuugaac

SEQ ID NO: 2435 - RNA, 21 nt, Artificial Sequence
  Ebola virus siRNA sense strand
cuuucgcccgacuuuugaacc

SEQ ID NO: 2436 - RNA, 21 nt, Artificial Sequence
  Ebola virus siRNA sense strand
uuucgcccgacuuuugaaccu

SEQ ID NO: 2437 - RNA, 21 nt, Artificial Sequence
  Ebola virus siRNA sense strand
uucgcccgacuuuugaaccuu

SEQ ID NO: 2438 - RNA, 21 nt, Artificial Sequence
  Ebola virus siRNA sense strand
ucgcccgacuuuugaaccuuu

SEQ ID NO: 2439 - RNA, 21 nt, Artificial Sequence
  Ebola virus siRNA sense strand
cgcccgacuuuugaaccuuuc

SEQ ID NO: 2440 - RNA, 21 nt, Artificial Sequence
  Ebola virus siRNA sense strand
gcccgacuuuugaaccuuucu

SEQ ID NO: 2441 - RNA, 21 nt, Artificial Sequence
  Ebola virus siRNA sense strand
cccgacuuuugaaccuuucug

SEQ ID NO: 2442 - RNA, 21 nt, Artificial Sequence
  Ebola virus siRNA sense strand
ccgacuuuugaaccuuucugg

SEQ ID NO: 2443 - RNA, 21 nt, Artificial Sequence
  Ebola virus siRNA sense strand
cgacuuuugaaccuuucugga

SEQ ID NO: 2444 - RNA, 21 nt, Artificial Sequence
  Ebola virus siRNA sense strand
gacuuuugaaccuuucuggag

SEQ ID NO: 2445 - RNA, 21 nt, Artificial Sequence
  Ebola virus siRNA sense strand
acuuuugaaccuuucuggagu

SEQ ID NO: 2446 - RNA, 21 nt, Artificial Sequence
  Ebola virus siRNA sense strand
cuuuugaaccuuucuggagua

SEQ ID NO: 2447 - RNA, 21 nt, Artificial Sequence
  Ebola virus siRNA sense strand
uuuugaaccuuucuggaguaa

SEQ ID NO: 2448 - RNA, 21 nt, Artificial Sequence
  Ebola virus siRNA sense strand
uuugaaccuuucuggaguaaa

SEQ ID NO: 2449 - RNA, 21 nt, Artificial Sequence
  Ebola virus siRNA sense strand
uugaaccuuucuggaguaaau

SEQ ID NO: 2450 - RNA, 21 nt, Artificial Sequence
  Ebola virus siRNA sense strand
ugaaccuuucuggaguaaaua

SEQ ID NO: 2451 - RNA, 21 nt, Artificial Sequence
  Ebola virus siRNA sense strand
gaaccuuucuggaguaaauaa

SEQ ID NO: 2452 - RNA, 21 nt, Artificial Sequence
  Ebola virus siRNA sense strand
aaccuuucuggaguaaauaau

SEQ ID NO: 2453 - RNA, 21 nt, Artificial Sequence
  Ebola virus siRNA sense strand
accuuucuggaguaaauaauc

SEQ ID NO: 2454 - RNA, 21 nt, Artificial Sequence
  Ebola virus siRNA sense strand
ccuuucuggaguaaauaaucu

SEQ ID NO: 2455 - RNA, 21 nt, Artificial Sequence
  Ebola virus siRNA sense strand
cuuucuggaguaaauaaucuu

SEQ ID NO: 2456 - RNA, 21 nt, Artificial Sequence
  Ebola virus siRNA sense strand
uuucuggaguaaauaaucuug

SEQ ID NO: 2457 - RNA, 21 nt, Artificial Sequence
  Ebola virus siRNA sense strand
uucuggaguaaauaaucuuga

SEQ ID NO: 2458 - RNA, 21 nt, Artificial Sequence
  Ebola virus siRNA sense strand
ucuggaguaaauaaucuugag

SEQ ID NO: 2459 - RNA, 21 nt, Artificial Sequence
  Ebola virus siRNA sense strand
cuggaguaaauaaucuugagc

SEQ ID NO: 2460 - RNA, 21 nt, Artificial Sequence
  Ebola virus siRNA sense strand
uggaguaaauaaucuugagca

SEQ ID NO: 2461 - RNA, 21 nt, Artificial Sequence
  Ebola virus siRNA sense strand
ggaguaaauaaucuugagcau

SEQ ID NO: 2462 - RNA, 21 nt, Artificial Sequence
  Ebola virus siRNA sense strand
gaguaaauaaucuugagcaug

SEQ ID NO: 2463 - RNA, 21 nt, Artificial Sequence
  Ebola virus siRNA sense strand
aguaaauaaucuugagcaugg

SEQ ID NO: 2464 - RNA, 21 nt, Artificial Sequence
  Ebola virus siRNA sense strand
guaaauaaucuugagcauggu

SEQ ID NO: 2465 - RNA, 21 nt, Artificial Sequence
  Ebola virus siRNA sense strand
uaaauaaucuugagcaugguc

SEQ ID NO: 2466 - RNA, 21 nt, Artificial Sequence
  Ebola virus siRNA sense strand
aaauaaucuugagcauggucu

SEQ ID NO: 2467 - RNA, 21 nt, Artificial Sequence
  Ebola virus siRNA sense strand
aauaaucuugagcauggucuu

SEQ ID NO: 2468 - RNA, 21 nt, Artificial Sequence
  Ebola virus siRNA sense strand
auaaucuugagcauggucuuu

SEQ ID NO: 2469 - RNA, 21 nt, Artificial Sequence
  Ebola virus siRNA sense strand
uaaucuugagcauggucuuuu

SEQ ID NO: 2470 - RNA, 21 nt, Artificial Sequence
  Ebola virus siRNA sense strand
aaucuugagcauggucuuuuc

SEQ ID NO: 2471 - RNA, 21 nt, Artificial Sequence
  Ebola virus siRNA sense strand
aucuugagcauggucuuuucc

SEQ ID NO: 2472 - RNA, 21 nt, Artificial Sequence
  Ebola virus siRNA sense strand
ucuugagcauggucuuuuccc

SEQ ID NO: 2473 - RNA, 21 nt, Artificial Sequence
  Ebola virus siRNA sense strand
cuugagcauggucuuuucccu

SEQ ID NO: 2474 - RNA, 21 nt, Artificial Sequence
  Ebola virus siRNA sense strand
uugagcauggucuuuucccuc

SEQ ID NO: 2475 - RNA, 21 nt, Artificial Sequence
  Ebola virus siRNA sense strand
ugagcauggucuuuucccuca

SEQ ID NO: 2476 - RNA, 21 nt, Artificial Sequence
  Ebola virus siRNA sense strand
gagcauggucuuuucccucaa

SEQ ID NO: 2477 - RNA, 21 nt, Artificial Sequence
  Ebola virus siRNA sense strand
agcauggucuuuucccucaac

SEQ ID NO: 2478 - RNA, 21 nt, Artificial Sequence
  Ebola virus siRNA sense strand
gcauggucuuuucccucaacu

SEQ ID NO: 2479 - RNA, 21 nt, Artificial Sequence
  Ebola virus siRNA sense strand
cauggucuuuucccucaacua

SEQ ID NO: 2480 - RNA, 21 nt, Artificial Sequence
  Ebola virus siRNA sense strand
auggucuuuucccucaacuau

SEQ ID NO: 2481 - RNA, 21 nt, Artificial Sequence
  Ebola virus siRNA sense strand
uggucuuuucccucaacuauc

SEQ ID NO: 2482 - RNA, 21 nt, Artificial Sequence
  Ebola virus siRNA sense strand
ggucuuuucccucaacuaucg

SEQ ID NO: 2483 - RNA, 21 nt, Artificial Sequence
  Ebola virus siRNA sense strand
gucuuuucccucaacuaucgg

SEQ ID NO: 2484 - RNA, 21 nt, Artificial Sequence
  Ebola virus siRNA sense strand
ucuuuucccucaacuaucggc

SEQ ID NO: 2485 - RNA, 21 nt, Artificial Sequence
  Ebola virus siRNA sense strand
cuuuucccucaacuaucggca

SEQ ID NO: 2486 - RNA, 21 nt, Artificial Sequence
  Ebola virus siRNA sense strand
uuuucccucaacuaucggcaa

SEQ ID NO: 2487 - RNA, 21 nt, Artificial Sequence
  Ebola virus siRNA sense strand
uuucccucaacuaucggcaau

SEQ ID NO: 2488 - RNA, 21 nt, Artificial Sequence
  Ebola virus siRNA sense strand
uucccucaacuaucggcaauu

SEQ ID NO: 2489 - RNA, 21 nt, Artificial Sequence
  Ebola virus siRNA sense strand
ucccucaacuaucggcaauug

SEQ ID NO: 2490 - RNA, 21 nt, Artificial Sequence
  Ebola virus siRNA sense strand
cccucaacuaucggcaauugc

SEQ ID NO: 2491 - RNA, 21 nt, Artificial Sequence
  Ebola virus siRNA sense strand
ccucaacuaucggcaauugca

SEQ ID NO: 2492 - RNA, 21 nt, Artificial Sequence
  Ebola virus siRNA sense strand
cucaacuaucggcaauugcac

SEQ ID NO: 2493 - RNA, 21 nt, Artificial Sequence
  Ebola virus siRNA sense strand
ucaacuaucggcaauugcacu

SEQ ID NO: 2494 - RNA, 21 nt, Artificial Sequence
  Ebola virus siRNA sense strand
caacuaucggcaauugcacuc

SEQ ID NO: 2495 - RNA, 21 nt, Artificial Sequence
  Ebola virus siRNA sense strand
aacuaucggcaauugcacucg

SEQ ID NO: 2496 - RNA, 21 nt, Artificial Sequence
  Ebola virus siRNA sense strand
acuaucggcaauugcacucgg

SEQ ID NO: 2497 - RNA, 21 nt, Artificial Sequence
  Ebola virus siRNA sense strand
cuaucggcaauugcacucgga

SEQ ID NO: 2498 - RNA, 21 nt, Artificial Sequence
  Ebola virus siRNA sense strand
uaucggcaauugcacucggag

SEQ ID NO: 2499 - RNA, 21 nt, Artificial Sequence
  Ebola virus siRNA sense strand
aucggcaauugcacucggagu

SEQ ID NO: 2500 - RNA, 21 nt, Artificial Sequence
  Ebola virus siRNA sense strand
ucggcaauugcacucggaguc

SEQ ID NO: 2501 - RNA, 21 nt, Artificial Sequence
  Ebola virus siRNA sense strand
cggcaauugcacucggagucg

SEQ ID NO: 2502 - RNA, 21 nt, Artificial Sequence
  Ebola virus siRNA sense strand
ggcaauugcacucggagucgc

SEQ ID NO: 2503 - RNA, 21 nt, Artificial Sequence
  Ebola virus siRNA sense strand
gcaauugcacucggagucgcc

SEQ ID NO: 2504 - RNA, 21 nt, Artificial Sequence
  Ebola virus siRNA sense strand
caauugcacucggagucgcca

SEQ ID NO: 2505 - RNA, 21 nt, Artificial Sequence
  Ebola virus siRNA sense strand
aauugcacucggagucgccac

SEQ ID NO: 2506 - RNA, 21 nt, Artificial Sequence
  Ebola virus siRNA sense strand
auugcacucggagucgccaca

SEQ ID NO: 2507 - RNA, 21 nt, Artificial Sequence
  Ebola virus siRNA sense strand
uugcacucggagucgccacag

SEQ ID NO: 2508 - RNA, 21 nt, Artificial Sequence
  Ebola virus siRNA sense strand
ugcacucggagucgccacagc

SEQ ID NO: 2509 - RNA, 21 nt, Artificial Sequence
  Ebola virus siRNA sense strand
gcacucggagucgccacagca

SEQ ID NO: 2510 - RNA, 21 nt, Artificial Sequence
  Ebola virus siRNA sense strand
cacucggagucgccacagcac

SEQ ID NO: 2511 - RNA, 21 nt, Artificial Sequence
  Ebola virus siRNA sense strand
acucggagucgccacagcaca

SEQ ID NO: 2512 - RNA, 21 nt, Artificial Sequence
  Ebola virus siRNA sense strand
cucggagucgccacagcacac

SEQ ID NO: 2513 - RNA, 21 nt, Artificial Sequence
  Ebola virus siRNA sense strand
ucggagucgccacagcacacg

SEQ ID NO: 2514 - RNA, 21 nt, Artificial Sequence
  Ebola virus siRNA sense strand
cggagucgccacagcacacgg

SEQ ID NO: 2515 - RNA, 21 nt, Artificial Sequence
  Ebola virus siRNA sense strand
ggagucgccacagcacacggg

SEQ ID NO: 2516 - RNA, 21 nt, Artificial Sequence
  Ebola virus siRNA sense strand
gagucgccacagcacacggga

SEQ ID NO: 2517 - RNA, 21 nt, Artificial Sequence
  Ebola virus siRNA sense strand
agucgccacagcacacgggag

SEQ ID NO: 2518 - RNA, 21 nt, Artificial Sequence
  Ebola virus siRNA sense strand
gucgccacagcacacgggagu

SEQ ID NO: 2519 - RNA, 21 nt, Artificial Sequence
  Ebola virus siRNA sense strand
ucgccacagcacacgggagua

SEQ ID NO: 2520 - RNA, 21 nt, Artificial Sequence
  Ebola virus siRNA sense strand
cgccacagcacacgggaguac

SEQ ID NO: 2521 - RNA, 21 nt, Artificial Sequence
  Ebola virus siRNA sense strand
gccacagcacacgggaguacc

SEQ ID NO: 2522 - RNA, 21 nt, Artificial Sequence
  Ebola virus siRNA sense strand
ccacagcacacgggaguaccc

SEQ ID NO: 2523 - RNA, 21 nt, Artificial Sequence
  Ebola virus siRNA sense strand
cacagcacacgggaguacccu

SEQ ID NO: 2524 - RNA, 21 nt, Artificial Sequence
  Ebola virus siRNA sense strand
acagcacacgggaguacccuc

SEQ ID NO: 2525 - RNA, 21 nt, Artificial Sequence
  Ebola virus siRNA sense strand
cagcacacgggaguacccucg

SEQ ID NO: 2526 - RNA, 21 nt, Artificial Sequence
  Ebola virus siRNA sense strand
agcacacgggaguacccucgc

SEQ ID NO: 2527 - RNA, 21 nt, Artificial Sequence
  Ebola virus siRNA sense strand
gcacacgggaguacccucgca

SEQ ID NO: 2528 - RNA, 21 nt, Artificial Sequence
  Ebola virus siRNA sense strand
cacacgggaguacccucgcag

SEQ ID NO: 2529 - RNA, 21 nt, Artificial Sequence
  Ebola virus siRNA sense strand
acacgggaguacccucgcagg

SEQ ID NO: 2530 - RNA, 21 nt, Artificial Sequence
  Ebola virus siRNA sense strand
cacgggaguacccucgcagga

SEQ ID NO: 2531 - RNA, 21 nt, Artificial Sequence
  Ebola virus siRNA sense strand
acgggaguacccucgcaggag

SEQ ID NO: 2532 - RNA, 21 nt, Artificial Sequence
  Ebola virus siRNA sense strand
cgggaguacccucgcaggagu

SEQ ID NO: 2533 - RNA, 21 nt, Artificial Sequence
  Ebola virus siRNA sense strand
gggaguacccucgcaggagua

SEQ ID NO: 2534 - RNA, 21 nt, Artificial Sequence
  Ebola virus siRNA sense strand
ggaguacccucgcaggaguaa

SEQ ID NO: 2535 - RNA, 21 nt, Artificial Sequence
  Ebola virus siRNA sense strand
gaguacccucgcaggaguaaa

SEQ ID NO: 2536 - RNA, 21 nt, Artificial Sequence
  Ebola virus siRNA sense strand
aguacccucgcaggaguaaau

SEQ ID NO: 2537 - RNA, 21 nt, Artificial Sequence
  Ebola virus siRNA sense strand
guacccucgcaggaguaaaug

SEQ ID NO: 2538 - RNA, 21 nt, Artificial Sequence
  Ebola virus siRNA sense strand
uacccucgcaggaguaaaugu

SEQ ID NO: 2539 - RNA, 21 nt, Artificial Sequence
  Ebola virus siRNA sense strand
acccucgcaggaguaaauguu

SEQ ID NO: 2540 - RNA, 21 nt, Artificial Sequence
  Ebola virus siRNA sense strand
cccucgcaggaguaaauguug

SEQ ID NO: 2541 - RNA, 21 nt, Artificial Sequence
  Ebola virus siRNA sense strand
ccucgcaggaguaaauguugg

SEQ ID NO: 2542 - RNA, 21 nt, Artificial Sequence
  Ebola virus siRNA sense strand
cucgcaggaguaaauguugga

SEQ ID NO: 2543 - RNA, 21 nt, Artificial Sequence
  Ebola virus siRNA sense strand
ucgcaggaguaaauguuggag

SEQ ID NO: 2544 - RNA, 21 nt, Artificial Sequence
  Ebola virus siRNA sense strand
cgcaggaguaaauguuggaga

SEQ ID NO: 2545 - RNA, 21 nt, Artificial Sequence
  Ebola virus siRNA sense strand
gcaggaguaaauguuggagaa

SEQ ID NO: 2546 - RNA, 21 nt, Artificial Sequence
  Ebola virus siRNA sense strand
caggaguaaauguuggagaac

SEQ ID NO: 2547 - RNA, 21 nt, Artificial Sequence
  Ebola virus siRNA sense strand
aggaguaaauguuggagaaca

SEQ ID NO: 2548 - RNA, 21 nt, Artificial Sequence
  Ebola virus siRNA sense strand
ggaguaaauguuggagaacag

SEQ ID NO: 2549 - RNA, 21 nt, Artificial Sequence
  Ebola virus siRNA sense strand
gaguaaauguuggagaacagu

SEQ ID NO: 2550 - RNA, 21 nt, Artificial Sequence
  Ebola virus siRNA sense strand
aguaaauguuggagaacagua

SEQ ID NO: 2551 - RNA, 21 nt, Artificial Sequence
  Ebola virus siRNA sense strand
guaaauguuggagaacaguau

SEQ ID NO: 2552 - RNA, 21 nt, Artificial Sequence
  Ebola virus siRNA sense strand
uaaauguuggagaacaguauc

SEQ ID NO: 2553 - RNA, 21 nt, Artificial Sequence
  Ebola virus siRNA sense strand
aaauguuggagaacaguauca

SEQ ID NO: 2554 - RNA, 21 nt, Artificial Sequence
  Ebola virus siRNA sense strand
aauguuggagaacaguaucaa

SEQ ID NO: 2555 - RNA, 21 nt, Artificial Sequence
  Ebola virus siRNA sense strand
auguuggagaacaguaucaac

SEQ ID NO: 2556 - RNA, 21 nt, Artificial Sequence
  Ebola virus siRNA sense strand
uguuggagaacaguaucaaca

SEQ ID NO: 2557 - RNA, 21 nt, Artificial Sequence
  Ebola virus siRNA sense strand
guuggagaacaguaucaacaa

SEQ ID NO: 2558 - RNA, 21 nt, Artificial Sequence
  Ebola virus siRNA sense strand
uuggagaacaguaucaacaac

SEQ ID NO: 2559 - RNA, 21 nt, Artificial Sequence
  Ebola virus siRNA sense strand
uggagaacaguaucaacaacu

SEQ ID NO: 2560 - RNA, 21 nt, Artificial Sequence
  Ebola virus siRNA sense strand
ggagaacaguaucaacaacuc

SEQ ID NO: 2561 - RNA, 21 nt, Artificial Sequence
  Ebola virus siRNA sense strand
gagaacaguaucaacaacuca

SEQ ID NO: 2562 - RNA, 21 nt, Artificial Sequence
  Ebola virus siRNA sense strand
agaacaguaucaacaacucag

SEQ ID NO: 2563 - RNA, 21 nt, Artificial Sequence
  Ebola virus siRNA sense strand
gaacaguaucaacaacucaga

SEQ ID NO: 2564 - RNA, 21 nt, Artificial Sequence
  Ebola virus siRNA sense strand
aacaguaucaacaacucagag

SEQ ID NO: 2565 - RNA, 21 nt, Artificial Sequence
  Ebola virus siRNA sense strand
acaguaucaacaacucagaga

SEQ ID NO: 2566 - RNA, 21 nt, Artificial Sequence
  Ebola virus siRNA sense strand
caguaucaacaacucagagag

SEQ ID NO: 2567 - RNA, 21 nt, Artificial Sequence
  Ebola virus siRNA sense strand
aguaucaacaacucagagagg

SEQ ID NO: 2568 - RNA, 21 nt, Artificial Sequence
  Ebola virus siRNA sense strand
guaucaacaacucagagaggc

SEQ ID NO: 2569 - RNA, 21 nt, Artificial Sequence
  Ebola virus siRNA sense strand
uaucaacaacucagagaggcu

SEQ ID NO: 2570 - RNA, 21 nt, Artificial Sequence
  Ebola virus siRNA sense strand
aucaacaacucagagaggcug

SEQ ID NO: 2571 - RNA, 21 nt, Artificial Sequence
  Ebola virus siRNA sense strand
ucaacaacucagagaggcugc

SEQ ID NO: 2572 - RNA, 21 nt, Artificial Sequence
  Ebola virus siRNA sense strand
caacaacucagagaggcugcc

SEQ ID NO: 2573 - RNA, 21 nt, Artificial Sequence
  Ebola virus siRNA sense strand
aacaacucagagaggcugcca

SEQ ID NO: 2574 - RNA, 21 nt, Artificial Sequence
  Ebola virus siRNA sense strand
acaacucagagaggcugccac

SEQ ID NO: 2575 - RNA, 21 nt, Artificial Sequence
  Ebola virus siRNA sense strand
caacucagagaggcugccacu

SEQ ID NO: 2576 - RNA, 21 nt, Artificial Sequence
  Ebola virus siRNA sense strand
aacucagagaggcugccacug

SEQ ID NO: 2577 - RNA, 21 nt, Artificial Sequence
  Ebola virus siRNA sense strand
acucagagaggcugccacuga

SEQ ID NO: 2578 - RNA, 21 nt, Artificial Sequence
  Ebola virus siRNA sense strand
cucagagaggcugccacugag

SEQ ID NO: 2579 - RNA, 21 nt, Artificial Sequence
  Ebola virus siRNA sense strand
ucagagaggcugccacugagg

SEQ ID NO: 2580 - RNA, 21 nt, Artificial Sequence
  Ebola virus siRNA sense strand
cagagaggcugccacugaggc

SEQ ID NO: 2581 - RNA, 21 nt, Artificial Sequence
  Ebola virus siRNA sense strand
agagaggcugccacugaggcu

SEQ ID NO: 2582 - RNA, 21 nt, Artificial Sequence
  Ebola virus siRNA sense strand
gagaggcugccacugaggcug

SEQ ID NO: 2583 - RNA, 21 nt, Artificial Sequence
  Ebola virus siRNA sense strand
agaggcugccacugaggcuga

SEQ ID NO: 2584 - RNA, 21 nt, Artificial Sequence
  Ebola virus siRNA sense strand
gaggcugccacugaggcugag

SEQ ID NO: 2585 - RNA, 21 nt, Artificial Sequence
  Ebola virus siRNA sense strand
aggcugccacugaggcugaga

SEQ ID NO: 2586 - RNA, 21 nt, Artificial Sequence
  Ebola virus siRNA sense strand
ggcugccacugaggcugagaa

SEQ ID NO: 2587 - RNA, 21 nt, Artificial Sequence
  Ebola virus siRNA sense strand
gcugccacugaggcugagaag

SEQ ID NO: 2588 - RNA, 21 nt, Artificial Sequence
  Ebola virus siRNA sense strand
cugccacugaggcugagaagc

SEQ ID NO: 2589 - RNA, 21 nt, Artificial Sequence
  Ebola virus siRNA sense strand
ugccacugaggcugagaagca

SEQ ID NO: 2590 - RNA, 21 nt, Artificial Sequence
  Ebola virus siRNA sense strand
gccacugaggcugagaagcaa

SEQ ID NO: 2591 - RNA, 21 nt, Artificial Sequence
  Ebola virus siRNA sense strand
ccacugaggcugagaagcaac

SEQ ID NO: 2592 - RNA, 21 nt, Artificial Sequence
  Ebola virus siRNA sense strand
cacugaggcugagaagcaacu

SEQ ID NO: 2593 - RNA, 21 nt, Artificial Sequence
  Ebola virus siRNA sense strand
acugaggcugagaagcaacuc

SEQ ID NO: 2594 - RNA, 21 nt, Artificial Sequence
  Ebola virus siRNA sense strand
cugaggcugagaagcaacucc

SEQ ID NO: 2595 - RNA, 21 nt, Artificial Sequence
  Ebola virus siRNA sense strand
ugaggcugagaagcaacucca

SEQ ID NO: 2596 - RNA, 21 nt, Artificial Sequence
  Ebola virus siRNA sense strand
gaggcugagaagcaacuccaa

SEQ ID NO: 2597 - RNA, 21 nt, Artificial Sequence
  Ebola virus siRNA sense strand
aggcugagaagcaacuccaac

SEQ ID NO: 2598 - RNA, 21 nt, Artificial Sequence
  Ebola virus siRNA sense strand
ggcugagaagcaacuccaaca

SEQ ID NO: 2599 - RNA, 21 nt, Artificial Sequence
  Ebola virus siRNA sense strand
gcugagaagcaacuccaacaa

SEQ ID NO: 2600 - RNA, 21 nt, Artificial Sequence
  Ebola virus siRNA sense strand
cugagaagcaacuccaacaau

SEQ ID NO: 2601 - RNA, 21 nt, Artificial Sequence
  Ebola virus siRNA sense strand
ugagaagcaacuccaacaaua

SEQ ID NO: 2602 - RNA, 21 nt, Artificial Sequence
  Ebola virus siRNA sense strand
gagaagcaacuccaacaauau

SEQ ID NO: 2603 - RNA, 21 nt, Artificial Sequence
  Ebola virus siRNA sense strand
agaagcaacuccaacaauaug

SEQ ID NO: 2604 - RNA, 21 nt, Artificial Sequence
  Ebola virus siRNA sense strand
gaagcaacuccaacaauaugc

SEQ ID NO: 2605 - RNA, 21 nt, Artificial Sequence
  Ebola virus siRNA sense strand
aagcaacuccaacaauaugca

SEQ ID NO: 2606 - RNA, 21 nt, Artificial Sequence
  Ebola virus siRNA sense strand
agcaacuccaacaauaugcag

SEQ ID NO: 2607 - RNA, 21 nt, Artificial Sequence
  Ebola virus siRNA sense strand
gcaacuccaacaauaugcaga

SEQ ID NO: 2608 - RNA, 21 nt, Artificial Sequence
  Ebola virus siRNA sense strand
caacuccaacaauaugcagag

SEQ ID NO: 2609 - RNA, 21 nt, Artificial Sequence
  Ebola virus siRNA sense strand
aacuccaacaauaugcagagu

SEQ ID NO: 2610 - RNA, 21 nt, Artificial Sequence
  Ebola virus siRNA sense strand
acuccaacaauaugcagaguc

SEQ ID NO: 2611 - RNA, 21 nt, Artificial Sequence
  Ebola virus siRNA sense strand
cuccaacaauaugcagagucu

SEQ ID NO: 2612 - RNA, 21 nt, Artificial Sequence
  Ebola virus siRNA sense strand
uccaacaauaugcagagucuc

SEQ ID NO: 2613 - RNA, 21 nt, Artificial Sequence
  Ebola virus siRNA sense strand
ccaacaauaugcagagucucg

SEQ ID NO: 2614 - RNA, 21 nt, Artificial Sequence
  Ebola virus siRNA sense strand
caacaauaugcagagucucgc

SEQ ID NO: 2615 - RNA, 21 nt, Artificial Sequence
  Ebola virus siRNA sense strand
aacaauaugcagagucucgcg

SEQ ID NO: 2616 - RNA, 21 nt, Artificial Sequence
  Ebola virus siRNA sense strand
acaauaugcagagucucgcga

SEQ ID NO: 2617 - RNA, 21 nt, Artificial Sequence
  Ebola virus siRNA sense strand
caauaugcagagucucgcgaa

SEQ ID NO: 2618 - RNA, 21 nt, Artificial Sequence
  Ebola virus siRNA sense strand
aauaugcagagucucgcgaac

SEQ ID NO: 2619 - RNA, 21 nt, Artificial Sequence
  Ebola virus siRNA sense strand
auaugcagagucucgcgaacu

SEQ ID NO: 2620 - RNA, 21 nt, Artificial Sequence
  Ebola virus siRNA sense strand
uaugcagagucucgcgaacuu

SEQ ID NO: 2621 - RNA, 21 nt, Artificial Sequence
  Ebola virus siRNA sense strand
augcagagucucgcgaacuug

SEQ ID NO: 2622 - RNA, 21 nt, Artificial Sequence
  Ebola virus siRNA sense strand
ugcagagucucgcgaacuuga

SEQ ID NO: 2623 - RNA, 21 nt, Artificial Sequence
  Ebola virus siRNA sense strand
gcagagucucgcgaacuugac

SEQ ID NO: 2624 - RNA, 21 nt, Artificial Sequence
  Ebola virus siRNA sense strand
cagagucucgcgaacuugacc

SEQ ID NO: 2625 - RNA, 21 nt, Artificial Sequence
  Ebola virus siRNA sense strand
agagucucgcgaacuugacca

SEQ ID NO: 2626 - RNA, 21 nt, Artificial Sequence
  Ebola virus siRNA sense strand
gagucucgcgaacuugaccau

SEQ ID NO: 2627 - RNA, 21 nt, Artificial Sequence
  Ebola virus siRNA sense strand
agucucgcgaacuugaccauc

SEQ ID NO: 2628 - RNA, 21 nt, Artificial Sequence
  Ebola virus siRNA sense strand
gucucgcgaacuugaccaucu

SEQ ID NO: 2629 - RNA, 21 nt, Artificial Sequence
  Ebola virus siRNA sense strand
ucucgcgaacuugaccaucuu

SEQ ID NO: 2630 - RNA, 21 nt, Artificial Sequence
  Ebola virus siRNA sense strand
cucgcgaacuugaccaucuug

SEQ ID NO: 2631 - RNA, 21 nt, Artificial Sequence
  Ebola virus siRNA sense strand
ucgcgaacuugaccaucuugg

SEQ ID NO: 2632 - RNA, 21 nt, Artificial Sequence
  Ebola virus siRNA sense strand
cgcgaacuugaccaucuugga

SEQ ID NO: 2633 - RNA, 21 nt, Artificial Sequence
  Ebola virus siRNA sense strand
gcgaacuugaccaucuuggac

SEQ ID NO: 2634 - RNA, 21 nt, Artificial Sequence
  Ebola virus siRNA sense strand
cgaacuugaccaucuuggacu

SEQ ID NO: 2635 - RNA, 21 nt, Artificial Sequence
  Ebola virus siRNA sense strand
gaacuugaccaucuuggacuu

SEQ ID NO: 2636 - RNA, 21 nt, Artificial Sequence
  Ebola virus siRNA sense strand
aacuugaccaucuuggacuug

SEQ ID NO: 2637 - RNA, 21 nt, Artificial Sequence
  Ebola virus siRNA sense strand
acuugaccaucuuggacuuga

SEQ ID NO: 2638 - RNA, 21 nt, Artificial Sequence
  Ebola virus siRNA sense strand
cuugaccaucuuggacuugau

SEQ ID NO: 2639 - RNA, 21 nt, Artificial Sequence
  Ebola virus siRNA sense strand
uugaccaucuuggacuugaug

SEQ ID NO: 2640 - RNA, 21 nt, Artificial Sequence
  Ebola virus siRNA sense strand
ugaccaucuuggacuugauga

SEQ ID NO: 2641 - RNA, 21 nt, Artificial Sequence
  Ebola virus siRNA sense strand
gaccaucuuggacuugaugau

SEQ ID NO: 2642 - RNA, 21 nt, Artificial Sequence
  Ebola virus siRNA sense strand
accaucuuggacuugaugauc

SEQ ID NO: 2643 - RNA, 21 nt, Artificial Sequence
  Ebola virus siRNA sense strand
ccaucuuggacuugaugauca

SEQ ID NO: 2644 - RNA, 21 nt, Artificial Sequence
  Ebola virus siRNA sense strand
caucuuggacuugaugaucag

SEQ ID NO: 2645 - RNA, 21 nt, Artificial Sequence
  Ebola virus siRNA sense strand
aucuuggacuugaugaucagg

SEQ ID NO: 2646 - RNA, 21 nt, Artificial Sequence
  Ebola virus siRNA sense strand
ucuuggacuugaugaucagga

SEQ ID NO: 2647 - RNA, 21 nt, Artificial Sequence
  Ebola virus siRNA sense strand
cuuggacuugaugaucaggaa

SEQ ID NO: 2648 - RNA, 21 nt, Artificial Sequence
  Ebola virus siRNA sense strand
uuggacuugaugaucaggaaa

SEQ ID NO: 2649 - RNA, 21 nt, Artificial Sequence
  Ebola virus siRNA sense strand
uggacuugaugaucaggaaaa

SEQ ID NO: 2650 - RNA, 21 nt, Artificial Sequence
  Ebola virus siRNA sense strand
ggacuugaugaucaggaaaag

SEQ ID NO: 2651 - RNA, 21 nt, Artificial Sequence
  Ebola virus siRNA sense strand
gacuugaugaucaggaaaaga

SEQ ID NO: 2652 - RNA, 21 nt, Artificial Sequence
  Ebola virus siRNA sense strand
acuugaugaucaggaaaagaa

SEQ ID NO: 2653 - RNA, 21 nt, Artificial Sequence
  Ebola virus siRNA sense strand
cuugaugaucaggaaaagaaa

SEQ ID NO: 2654 - RNA, 21 nt, Artificial Sequence
  Ebola virus siRNA sense strand
uugaugaucaggaaaagaaaa

SEQ ID NO: 2655 - RNA, 21 nt, Artificial Sequence
  Ebola virus siRNA sense strand
ugaugaucaggaaaagaaaau

SEQ ID NO: 2656 - RNA, 21 nt, Artificial Sequence
  Ebola virus siRNA sense strand
gaugaucaggaaaagaaaauu

SEQ ID NO: 2657 - RNA, 21 nt, Artificial Sequence
  Ebola virus siRNA sense strand
augaucaggaaaagaaaauuc

SEQ ID NO: 2658 - RNA, 21 nt, Artificial Sequence
  Ebola virus siRNA sense strand
ugaucaggaaaagaaaauucu

SEQ ID NO: 2659 - RNA, 21 nt, Artificial Sequence
  Ebola virus siRNA sense strand
gaucaggaaaagaaaauucuu

SEQ ID NO: 2660 - RNA, 21 nt, Artificial Sequence
  Ebola virus siRNA sense strand
aucaggaaaagaaaauucuua

SEQ ID NO: 2661 - RNA, 21 nt, Artificial Sequence
  Ebola virus siRNA sense strand
ucaggaaaagaaaauucuuau

SEQ ID NO: 2662 - RNA, 21 nt, Artificial Sequence
  Ebola virus siRNA sense strand
caggaaaagaaaauucuuaug

SEQ ID NO: 2663 - RNA, 21 nt, Artificial Sequence
  Ebola virus siRNA sense strand
aggaaaagaaaauucuuauga

SEQ ID NO: 2664 - RNA, 21 nt, Artificial Sequence
  Ebola virus siRNA sense strand
ggaaaagaaaauucuuaugaa

SEQ ID NO: 2665 - RNA, 21 nt, Artificial Sequence
  Ebola virus siRNA sense strand
gaaaagaaaauucuuaugaac

SEQ ID NO: 2666 - RNA, 21 nt, Artificial Sequence
  Ebola virus siRNA sense strand
aaaagaaaauucuuaugaacu

SEQ ID NO: 2667 - RNA, 21 nt, Artificial Sequence
  Ebola virus siRNA sense strand
aaagaaaauucuuaugaacuu

SEQ ID NO: 2668 - RNA, 21 nt, Artificial Sequence
  Ebola virus siRNA sense strand
aagaaaauucuuaugaacuuc

SEQ ID NO: 2669 - RNA, 21 nt, Artificial Sequence
  Ebola virus siRNA sense strand
agaaaauucuuaugaacuucc

SEQ ID NO: 2670 - RNA, 21 nt, Artificial Sequence
  Ebola virus siRNA sense strand
gaaaauucuuaugaacuucca

SEQ ID NO: 2671 - RNA, 21 nt, Artificial Sequence
  Ebola virus siRNA sense strand
aaaauucuuaugaacuuccau

SEQ ID NO: 2672 - RNA, 21 nt, Artificial Sequence
  Ebola virus siRNA sense strand
aaauucuuaugaacuuccauc

SEQ ID NO: 2673 - RNA, 21 nt, Artificial Sequence
  Ebola virus siRNA sense strand
aauucuuaugaacuuccauca

SEQ ID NO: 2674 - RNA, 21 nt, Artificial Sequence
  Ebola virus siRNA sense strand
auucuuaugaacuuccaucag

SEQ ID NO: 2675 - RNA, 21 nt, Artificial Sequence
  Ebola virus siRNA sense strand
uucuuaugaacuuccaucaga

SEQ ID NO: 2676 - RNA, 21 nt, Artificial Sequence
  Ebola virus siRNA sense strand
ucuuaugaacuuccaucagaa

SEQ ID NO: 2677 - RNA, 21 nt, Artificial Sequence
  Ebola virus siRNA sense strand
cuuaugaacuuccaucagaaa

SEQ ID NO: 2678 - RNA, 21 nt, Artificial Sequence
  Ebola virus siRNA sense strand
uuaugaacuuccaucagaaaa

SEQ ID NO: 2679 - RNA, 21 nt, Artificial Sequence
  Ebola virus siRNA sense strand
uaugaacuuccaucagaaaaa

SEQ ID NO: 2680 - RNA, 21 nt, Artificial Sequence
  Ebola virus siRNA sense strand
augaacuuccaucagaaaaag

SEQ ID NO: 2681 - RNA, 21 nt, Artificial Sequence
  Ebola virus siRNA sense strand
ugaacuuccaucagaaaaaga

SEQ ID NO: 2682 - RNA, 21 nt, Artificial Sequence
  Ebola virus siRNA sense strand
gaacuuccaucagaaaaagaa

SEQ ID NO: 2683 - RNA, 21 nt, Artificial Sequence
  Ebola virus siRNA sense strand
aacuuccaucagaaaaagaac

SEQ ID NO: 2684 - RNA, 21 nt, Artificial Sequence
  Ebola virus siRNA sense strand
acuuccaucagaaaaagaacg

SEQ ID NO: 2685 - RNA, 21 nt, Artificial Sequence
  Ebola virus siRNA sense strand
cuuccaucagaaaaagaacga

SEQ ID NO: 2686 - RNA, 21 nt, Artificial Sequence
  Ebola virus siRNA sense strand
uuccaucagaaaaagaacgaa

SEQ ID NO: 2687 - RNA, 21 nt, Artificial Sequence
  Ebola virus siRNA sense strand
uccaucagaaaaagaacgaaa

SEQ ID NO: 2688 - RNA, 21 nt, Artificial Sequence
  Ebola virus siRNA sense strand
ccaucagaaaaagaacgaaau

SEQ ID NO: 2689 - RNA, 21 nt, Artificial Sequence
  Ebola virus siRNA sense strand
caucagaaaaagaacgaaauc

SEQ ID NO: 2690 - RNA, 21 nt, Artificial Sequence
  Ebola virus siRNA sense strand
aucagaaaaagaacgaaauca

SEQ ID NO: 2691 - RNA, 21 nt, Artificial Sequence
  Ebola virus siRNA sense strand
ucagaaaaagaacgaaaucag

SEQ ID NO: 2692 - RNA, 21 nt, Artificial Sequence
  Ebola virus siRNA sense strand
cagaaaaagaacgaaaucagc

SEQ ID NO: 2693 - RNA, 21 nt, Artificial Sequence
  Ebola virus siRNA sense strand
agaaaaagaacgaaaucagcu

SEQ ID NO: 2694 - RNA, 21 nt, Artificial Sequence
  Ebola virus siRNA sense strand
gaaaaagaacgaaaucagcuu

SEQ ID NO: 2695 - RNA, 21 nt, Artificial Sequence
  Ebola virus siRNA sense strand
aaaaagaacgaaaucagcuuc

SEQ ID NO: 2696 - RNA, 21 nt, Artificial Sequence
  Ebola virus siRNA sense strand
aaaagaacgaaaucagcuucc

SEQ ID NO: 2697 - RNA, 21 nt, Artificial Sequence
  Ebola virus siRNA sense strand
aaagaacgaaaucagcuucca

SEQ ID NO: 2698 - RNA, 21 nt, Artificial Sequence
  Ebola virus siRNA sense strand
aagaacgaaaucagcuuccag

SEQ ID NO: 2699 - RNA, 21 nt, Artificial Sequence
  Ebola virus siRNA sense strand
agaacgaaaucagcuuccagc

SEQ ID NO: 2700 - RNA, 21 nt, Artificial Sequence
  Ebola virus siRNA sense strand
gaacgaaaucagcuuccagca

SEQ ID NO: 2701 - RNA, 21 nt, Artificial Sequence
  Ebola virus siRNA sense strand
aacgaaaucagcuuccagcaa

SEQ ID NO: 2702 - RNA, 21 nt, Artificial Sequence
  Ebola virus siRNA sense strand
acgaaaucagcuuccagcaaa

SEQ ID NO: 2703 - RNA, 21 nt, Artificial Sequence
  Ebola virus siRNA sense strand
cgaaaucagcuuccagcaaac

SEQ ID NO: 2704 - RNA, 21 nt, Artificial Sequence
  Ebola virus siRNA sense strand
gaaaucagcuuccagcaaaca

SEQ ID NO: 2705 - RNA, 21 nt, Artificial Sequence
  Ebola virus siRNA sense strand
aaaucagcuuccagcaaacaa

SEQ ID NO: 2706 - RNA, 21 nt, Artificial Sequence
  Ebola virus siRNA sense strand
aaucagcuuccagcaaacaaa

SEQ ID NO: 2707 - RNA, 21 nt, Artificial Sequence
  Ebola virus siRNA sense strand
aucagcuuccagcaaacaaac

SEQ ID NO: 2708 - RNA, 21 nt, Artificial Sequence
  Ebola virus siRNA sense strand
ucagcuuccagcaaacaaacg

SEQ ID NO: 2709 - RNA, 21 nt, Artificial Sequence
  Ebola virus siRNA sense strand
cagcuuccagcaaacaaacgc

SEQ ID NO: 2710 - RNA, 21 nt, Artificial Sequence
  Ebola virus siRNA sense strand
agcuuccagcaaacaaacgcu

SEQ ID NO: 2711 - RNA, 21 nt, Artificial Sequence
  Ebola virus siRNA sense strand
gcuuccagcaaacaaacgcua

SEQ ID NO: 2712 - RNA, 21 nt, Artificial Sequence
  Ebola virus siRNA sense strand
cuuccagcaaacaaacgcuau

SEQ ID NO: 2713 - RNA, 21 nt, Artificial Sequence
  Ebola virus siRNA sense strand
uuccagcaaacaaacgcuaug

SEQ ID NO: 2714 - RNA, 21 nt, Artificial Sequence
  Ebola virus siRNA sense strand
uccagcaaacaaacgcuaugg

SEQ ID NO: 2715 - RNA, 21 nt, Artificial Sequence
  Ebola virus siRNA sense strand
ccagcaaacaaacgcuauggu

SEQ ID NO: 2716 - RNA, 21 nt, Artificial Sequence
  Ebola virus siRNA sense strand
cagcaaacaaacgcuauggua

SEQ ID NO: 2717 - RNA, 21 nt, Artificial Sequence
  Ebola virus siRNA sense strand
agcaaacaaacgcuaugguaa

SEQ ID NO: 2718 - RNA, 21 nt, Artificial Sequence
  Ebola virus siRNA sense strand
gcaaacaaacgcuaugguaac

SEQ ID NO: 2719 - RNA, 21 nt, Artificial Sequence
  Ebola virus siRNA sense strand
caaacaaacgcuaugguaacu

SEQ ID NO: 2720 - RNA, 21 nt, Artificial Sequence
  Ebola virus siRNA sense strand
aaacaaacgcuaugguaacuc

SEQ ID NO: 2721 - RNA, 21 nt, Artificial Sequence
  Ebola virus siRNA sense strand
aacaaacgcuaugguaacucu

SEQ ID NO: 2722 - RNA, 21 nt, Artificial Sequence
  Ebola virus siRNA sense strand
acaaacgcuaugguaacucua

SEQ ID NO: 2723 - RNA, 21 nt, Artificial Sequence
  Ebola virus siRNA sense strand
caaacgcuaugguaacucuaa

SEQ ID NO: 2724 - RNA, 21 nt, Artificial Sequence
  Ebola virus siRNA sense strand
aaacgcuaugguaacucuaag

SEQ ID NO: 2725 - RNA, 21 nt, Artificial Sequence
  Ebola virus siRNA sense strand
aacgcuaugguaacucuaaga

SEQ ID NO: 2726 - RNA, 21 nt, Artificial Sequence
  Ebola virus siRNA sense strand
acgcuaugguaacucuaagaa

SEQ ID NO: 2727 - RNA, 21 nt, Artificial Sequence
  Ebola virus siRNA sense strand
cgcuaugguaacucuaagaaa

SEQ ID NO: 2728 - RNA, 21 nt, Artificial Sequence
  Ebola virus siRNA sense strand
gcuaugguaacucuaagaaaa

SEQ ID NO: 2729 - RNA, 21 nt, Artificial Sequence
  Ebola virus siRNA sense strand
cuaugguaacucuaagaaaag

SEQ ID NO: 2730 - RNA, 21 nt, Artificial Sequence
  Ebola virus siRNA sense strand
uaugguaacucuaagaaaaga

SEQ ID NO: 2731 - RNA, 21 nt, Artificial Sequence
  Ebola virus siRNA sense strand
augguaacucuaagaaaagag

SEQ ID NO: 2732 - RNA, 21 nt, Artificial Sequence
  Ebola virus siRNA sense strand
ugguaacucuaagaaaagagc

SEQ ID NO: 2733 - RNA, 21 nt, Artificial Sequence
  Ebola virus siRNA sense strand
gguaacucuaagaaaagagcg

SEQ ID NO: 2734 - RNA, 21 nt, Artificial Sequence
  Ebola virus siRNA sense strand
guaacucuaagaaaagagcgc

SEQ ID NO: 2735 - RNA, 21 nt, Artificial Sequence
  Ebola virus siRNA sense strand
uaacucuaagaaaagagcgcc

SEQ ID NO: 2736 - RNA, 21 nt, Artificial Sequence
  Ebola virus siRNA sense strand
aacucuaagaaaagagcgccu

SEQ ID NO: 2737 - RNA, 21 nt, Artificial Sequence
  Ebola virus siRNA sense strand
acucuaagaaaagagcgccug

SEQ ID NO: 2738 - RNA, 21 nt, Artificial Sequence
  Ebola virus siRNA sense strand
cucuaagaaaagagcgccugg

SEQ ID NO: 2739 - RNA, 21 nt, Artificial Sequence
  Ebola virus siRNA sense strand
ucuaagaaaagagcgccuggc

SEQ ID NO: 2740 - RNA, 21 nt, Artificial Sequence
  Ebola virus siRNA sense strand
cuaagaaaagagcgccuggcc

SEQ ID NO: 2741 - RNA, 21 nt, Artificial Sequence
  Ebola virus siRNA sense strand
uaagaaaagagcgccuggcca

SEQ ID NO: 2742 - RNA, 21 nt, Artificial Sequence
  Ebola virus siRNA sense strand
aagaaaagagcgccuggccaa

SEQ ID NO: 2743 - RNA, 21 nt, Artificial Sequence
  Ebola virus siRNA sense strand
agaaaagagcgccuggccaag

SEQ ID NO: 2744 - RNA, 21 nt, Artificial Sequence
  Ebola virus siRNA sense strand
gaaaagagcgccuggccaagc

SEQ ID NO: 2745 - RNA, 21 nt, Artificial Sequence
  Ebola virus siRNA sense strand
aaaagagcgccuggccaagcu

SEQ ID NO: 2746 - RNA, 21 nt, Artificial Sequence
  Ebola virus siRNA sense strand
aaagagcgccuggccaagcug

SEQ ID NO: 2747 - RNA, 21 nt, Artificial Sequence
  Ebola virus siRNA sense strand
aagagcgccuggccaagcuga

SEQ ID NO: 2748 - RNA, 21 nt, Artificial Sequence
  Ebola virus siRNA sense strand
agagcgccuggccaagcugac

SEQ ID NO: 2749 - RNA, 21 nt, Artificial Sequence
  Ebola virus siRNA sense strand
gagcgccuggccaagcugaca

SEQ ID NO: 2750 - RNA, 21 nt, Artificial Sequence
  Ebola virus siRNA sense strand
agcgccuggccaagcugacag

SEQ ID NO: 2751 - RNA, 21 nt, Artificial Sequence
  Ebola virus siRNA sense strand
gcgccuggccaagcugacaga

SEQ ID NO: 2752 - RNA, 21 nt, Artificial Sequence
  Ebola virus siRNA sense strand
cgccuggccaagcugacagaa

SEQ ID NO: 2753 - RNA, 21 nt, Artificial Sequence
  Ebola virus siRNA sense strand
gccuggccaagcugacagaag

SEQ ID NO: 2754 - RNA, 21 nt, Artificial Sequence
  Ebola virus siRNA sense strand
ccuggccaagcugacagaagc

SEQ ID NO: 2755 - RNA, 21 nt, Artificial Sequence
  Ebola virus siRNA sense strand
cuggccaagcugacagaagcu

SEQ ID NO: 2756 - RNA, 21 nt, Artificial Sequence
  Ebola virus siRNA sense strand
uggccaagcugacagaagcua

SEQ ID NO: 2757 - RNA, 21 nt, Artificial Sequence
  Ebola virus siRNA sense strand
ggccaagcugacagaagcuau

SEQ ID NO: 2758 - RNA, 21 nt, Artificial Sequence
  Ebola virus siRNA sense strand
gccaagcugacagaagcuauc

SEQ ID NO: 2759 - RNA, 21 nt, Artificial Sequence
  Ebola virus siRNA sense strand
ccaagcugacagaagcuauca

SEQ ID NO: 2760 - RNA, 21 nt, Artificial Sequence
  Ebola virus siRNA sense strand
caagcugacagaagcuaucac

SEQ ID NO: 2761 - RNA, 21 nt, Artificial Sequence
  Ebola virus siRNA sense strand
aagcugacagaagcuaucacu

SEQ ID NO: 2762 - RNA, 21 nt, Artificial Sequence
  Ebola virus siRNA sense strand
agcugacagaagcuaucacug

SEQ ID NO: 2763 - RNA, 21 nt, Artificial Sequence
  Ebola virus siRNA sense strand
gcugacagaagcuaucacugc

SEQ ID NO: 2764 - RNA, 21 nt, Artificial Sequence
  Ebola virus siRNA sense strand
cugacagaagcuaucacugcu

SEQ ID NO: 2765 - RNA, 21 nt, Artificial Sequence
  Ebola virus siRNA sense strand
ugacagaagcuaucacugcug

SEQ ID NO: 2766 - RNA, 21 nt, Artificial Sequence
  Ebola virus siRNA sense strand
gacagaagcuaucacugcugc

SEQ ID NO: 2767 - RNA, 21 nt, Artificial Sequence
  Ebola virus siRNA sense strand
acagaagcuaucacugcugcg

SEQ ID NO: 2768 - RNA, 21 nt, Artificial Sequence
  Ebola virus siRNA sense strand
cagaagcuaucacugcugcgu

SEQ ID NO: 2769 - RNA, 21 nt, Artificial Sequence
  Ebola virus siRNA sense strand
agaagcuaucacugcugcguc

SEQ ID NO: 2770 - RNA, 21 nt, Artificial Sequence
  Ebola virus siRNA sense strand
gaagcuaucacugcugcguca

SEQ ID NO: 2771 - RNA, 21 nt, Artificial Sequence
  Ebola virus siRNA sense strand
aagcuaucacugcugcgucac

SEQ ID NO: 2772 - RNA, 21 nt, Artificial Sequence
  Ebola virus siRNA sense strand
agcuaucacugcugcgucacu

SEQ ID NO: 2773 - RNA, 21 nt, Artificial Sequence
  Ebola virus siRNA sense strand
gcuaucacugcugcgucacug

SEQ ID NO: 2774 - RNA, 21 nt, Artificial Sequence
  Ebola virus siRNA sense strand
cuaucacugcugcgucacugc

SEQ ID NO: 2775 - RNA, 21 nt, Artificial Sequence
  Ebola virus siRNA sense strand
uaucacugcugcgucacugcc

SEQ ID NO: 2776 - RNA, 21 nt, Artificial Sequence
  Ebola virus siRNA sense strand
aucacugcugcgucacugccc

SEQ ID NO: 2777 - RNA, 21 nt, Artificial Sequence
  Ebola virus siRNA sense strand
ucacugcugcgucacugccca

SEQ ID NO: 2778 - RNA, 21 nt, Artificial Sequence
  Ebola virus siRNA sense strand
cacugcugcgucacugcccaa

SEQ ID NO: 2779 - RNA, 21 nt, Artificial Sequence
  Ebola virus siRNA sense strand
acugcugcgucacugcccaaa

SEQ ID NO: 2780 - RNA, 21 nt, Artificial Sequence
  Ebola virus siRNA sense strand
cugcugcgucacugcccaaaa

SEQ ID NO: 2781 - RNA, 21 nt, Artificial Sequence
  Ebola virus siRNA sense strand
ugcugcgucacugcccaaaac

SEQ ID NO: 2782 - RNA, 21 nt, Artificial Sequence
  Ebola virus siRNA sense strand
gcugcgucacugcccaaaaca

SEQ ID NO: 2783 - RNA, 21 nt, Artificial Sequence
  Ebola virus siRNA sense strand
cugcgucacugcccaaaacaa

SEQ ID NO: 2784 - RNA, 21 nt, Artificial Sequence
  Ebola virus siRNA sense strand
ugcgucacugcccaaaacaag

SEQ ID NO: 2785 - RNA, 21 nt, Artificial Sequence
  Ebola virus siRNA sense strand
gcgucacugcccaaaacaagu

SEQ ID NO: 2786 - RNA, 21 nt, Artificial Sequence
  Ebola virus siRNA sense strand
cgucacugcccaaaacaagug

SEQ ID NO: 2787 - RNA, 21 nt, Artificial Sequence
  Ebola virus siRNA sense strand
gucacugcccaaaacaagugg

SEQ ID NO: 2788 - RNA, 21 nt, Artificial Sequence
  Ebola virus siRNA sense strand
ucacugcccaaaacaagugga

SEQ ID NO: 2789 - RNA, 21 nt, Artificial Sequence
  Ebola virus siRNA sense strand
cacugcccaaaacaaguggac

SEQ ID NO: 2790 - RNA, 21 nt, Artificial Sequence
  Ebola virus siRNA sense strand
acugcccaaaacaaguggaca

SEQ ID NO: 2791 - RNA, 21 nt, Artificial Sequence
  Ebola virus siRNA sense strand
cugcccaaaacaaguggacau

SEQ ID NO: 2792 - RNA, 21 nt, Artificial Sequence
  Ebola virus siRNA sense strand
ugcccaaaacaaguggacauu

SEQ ID NO: 2793 - RNA, 21 nt, Artificial Sequence
  Ebola virus siRNA sense strand
gcccaaaacaaguggacauua

SEQ ID NO: 2794 - RNA, 21 nt, Artificial Sequence
  Ebola virus siRNA sense strand
cccaaaacaaguggacauuac

SEQ ID NO: 2795 - RNA, 21 nt, Artificial Sequence
  Ebola virus siRNA sense strand
ccaaaacaaguggacauuacg

SEQ ID NO: 2796 - RNA, 21 nt, Artificial Sequence
  Ebola virus siRNA sense strand
caaaacaaguggacauuacga

SEQ ID NO: 2797 - RNA, 21 nt, Artificial Sequence
  Ebola virus siRNA sense strand
aaaacaaguggacauuacgau

SEQ ID NO: 2798 - RNA, 21 nt, Artificial Sequence
  Ebola virus siRNA sense strand
aaacaaguggacauuacgaug

SEQ ID NO: 2799 - RNA, 21 nt, Artificial Sequence
  Ebola virus siRNA sense strand
aacaaguggacauuacgauga

SEQ ID NO: 2800 - RNA, 21 nt, Artificial Sequence
  Ebola virus siRNA sense strand
acaaguggacauuacgaugau

SEQ ID NO: 2801 - RNA, 21 nt, Artificial Sequence
  Ebola virus siRNA sense strand
caaguggacauuacgaugaug

SEQ ID NO: 2802 - RNA, 21 nt, Artificial Sequence
  Ebola virus siRNA sense strand
aaguggacauuacgaugauga

SEQ ID NO: 2803 - RNA, 21 nt, Artificial Sequence
  Ebola virus siRNA sense strand
aguggacauuacgaugaugau

SEQ ID NO: 2804 - RNA, 21 nt, Artificial Sequence
  Ebola virus siRNA sense strand
guggacauuacgaugaugaug

SEQ ID NO: 2805 - RNA, 21 nt, Artificial Sequence
  Ebola virus siRNA sense strand
uggacauuacgaugaugauga

SEQ ID NO: 2806 - RNA, 21 nt, Artificial Sequence
  Ebola virus siRNA sense strand
ggacauuacgaugaugaugac

SEQ ID NO: 2807 - RNA, 21 nt, Artificial Sequence
  Ebola virus siRNA sense strand
gacauuacgaugaugaugacg

SEQ ID NO: 2808 - RNA, 21 nt, Artificial Sequence
  Ebola virus siRNA sense strand
acauuacgaugaugaugacga

SEQ ID NO: 2809 - RNA, 21 nt, Artificial Sequence
  Ebola virus siRNA sense strand
cauuacgaugaugaugacgac

SEQ ID NO: 2810 - RNA, 21 nt, Artificial Sequence
  Ebola virus siRNA sense strand
auuacgaugaugaugacgaca

SEQ ID NO: 2811 - RNA, 21 nt, Artificial Sequence
  Ebola virus siRNA sense strand
uuacgaugaugaugacgacau

SEQ ID NO: 2812 - RNA, 21 nt, Artificial Sequence
  Ebola virus siRNA sense strand
uacgaugaugaugacgacauu

SEQ ID NO: 2813 - RNA, 21 nt, Artificial Sequence
  Ebola virus siRNA sense strand
acgaugaugaugacgacauuc

SEQ ID NO: 2814 - RNA, 21 nt, Artificial Sequence
  Ebola virus siRNA sense strand
cgaugaugaugacgacauucc

SEQ ID NO: 2815 - RNA, 21 nt, Artificial Sequence
  Ebola virus siRNA sense strand
gaugaugaugacgacauuccc

SEQ ID NO: 2816 - RNA, 21 nt, Artificial Sequence
  Ebola virus siRNA sense strand
augaugaugacgacauucccu

SEQ ID NO: 2817 - RNA, 21 nt, Artificial Sequence
  Ebola virus siRNA sense strand
ugaugaugacgacauucccuu

SEQ ID NO: 2818 - RNA, 21 nt, Artificial Sequence
  Ebola virus siRNA sense strand
gaugaugacgacauucccuuu

SEQ ID NO: 2819 - RNA, 21 nt, Artificial Sequence
  Ebola virus siRNA sense strand
augaugacgacauucccuuuc

SEQ ID NO: 2820 - RNA, 21 nt, Artificial Sequence
  Ebola virus siRNA sense strand
ugaugacgacauucccuuucc

SEQ ID NO: 2821 - RNA, 21 nt, Artificial Sequence
  Ebola virus siRNA sense strand
gaugacgacauucccuuucca

SEQ ID NO: 2822 - RNA, 21 nt, Artificial Sequence
  Ebola virus siRNA sense strand
augacgacauucccuuuccag

SEQ ID NO: 2823 - RNA, 21 nt, Artificial Sequence
  Ebola virus siRNA sense strand
ugacgacauucccuuuccagg

SEQ ID NO: 2824 - RNA, 21 nt, Artificial Sequence
  Ebola virus siRNA sense strand
gacgacauucccuuuccagga

SEQ ID NO: 2825 - RNA, 21 nt, Artificial Sequence
  Ebola virus siRNA sense strand
acgacauucccuuuccaggac

SEQ ID NO: 2826 - RNA, 21 nt, Artificial Sequence
  Ebola virus siRNA sense strand
cgacauucccuuuccaggacc

SEQ ID NO: 2827 - RNA, 21 nt, Artificial Sequence
  Ebola virus siRNA sense strand
gacauucccuuuccaggaccc

SEQ ID NO: 2828 - RNA, 21 nt, Artificial Sequence
  Ebola virus siRNA sense strand
acauucccuuuccaggaccca

SEQ ID NO: 2829 - RNA, 21 nt, Artificial Sequence
  Ebola virus siRNA sense strand
cauucccuuuccaggacccau

SEQ ID NO: 2830 - RNA, 21 nt, Artificial Sequence
  Ebola virus siRNA sense strand
auucccuuuccaggacccauc

SEQ ID NO: 2831 - RNA, 21 nt, Artificial Sequence
  Ebola virus siRNA sense strand
uucccuuuccaggacccauca

SEQ ID NO: 2832 - RNA, 21 nt, Artificial Sequence
  Ebola virus siRNA sense strand
ucccuuuccaggacccaucaa

SEQ ID NO: 2833 - RNA, 21 nt, Artificial Sequence
  Ebola virus siRNA sense strand
cccuuuccaggacccaucaau

SEQ ID NO: 2834 - RNA, 21 nt, Artificial Sequence
  Ebola virus siRNA sense strand
ccuuuccaggacccaucaaug

SEQ ID NO: 2835 - RNA, 21 nt, Artificial Sequence
  Ebola virus siRNA sense strand
cuuuccaggacccaucaauga

SEQ ID NO: 2836 - RNA, 21 nt, Artificial Sequence
  Ebola virus siRNA sense strand
uuuccaggacccaucaaugau

SEQ ID NO: 2837 - RNA, 21 nt, Artificial Sequence
  Ebola virus siRNA sense strand
uuccaggacccaucaaugaug

SEQ ID NO: 2838 - RNA, 21 nt, Artificial Sequence
  Ebola virus siRNA sense strand
uccaggacccaucaaugauga

SEQ ID NO: 2839 - RNA, 21 nt, Artificial Sequence
  Ebola virus siRNA sense strand
ccaggacccaucaaugaugac

SEQ ID NO: 2840 - RNA, 21 nt, Artificial Sequence
  Ebola virus siRNA sense strand
caggacccaucaaugaugacg

SEQ ID NO: 2841 - RNA, 21 nt, Artificial Sequence
  Ebola virus siRNA sense strand
aggacccaucaaugaugacga

SEQ ID NO: 2842 - RNA, 21 nt, Artificial Sequence
  Ebola virus siRNA sense strand
ggacccaucaaugaugacgac

SEQ ID NO: 2843 - RNA, 21 nt, Artificial Sequence
  Ebola virus siRNA sense strand
gacccaucaaugaugacgaca

SEQ ID NO: 2844 - RNA, 21 nt, Artificial Sequence
  Ebola virus siRNA sense strand
acccaucaaugaugacgacaa

SEQ ID NO: 2845 - RNA, 21 nt, Artificial Sequence
  Ebola virus siRNA sense strand
cccaucaaugaugacgacaau

SEQ ID NO: 2846 - RNA, 21 nt, Artificial Sequence
  Ebola virus siRNA sense strand
ccaucaaugaugacgacaauc

SEQ ID NO: 2847 - RNA, 21 nt, Artificial Sequence
  Ebola virus siRNA sense strand
caucaaugaugacgacaaucc

SEQ ID NO: 2848 - RNA, 21 nt, Artificial Sequence
  Ebola virus siRNA sense strand
aucaaugaugacgacaauccu

SEQ ID NO: 2849 - RNA, 21 nt, Artificial Sequence
  Ebola virus siRNA sense strand
ucaaugaugacgacaauccug

SEQ ID NO: 2850 - RNA, 21 nt, Artificial Sequence
  Ebola virus siRNA sense strand
caaugaugacgacaauccugg

SEQ ID NO: 2851 - RNA, 21 nt, Artificial Sequence
  Ebola virus siRNA sense strand
aaugaugacgacaauccuggc

SEQ ID NO: 2852 - RNA, 21 nt, Artificial Sequence
  Ebola virus siRNA sense strand
augaugacgacaauccuggcc

SEQ ID NO: 2853 - RNA, 21 nt, Artificial Sequence
  Ebola virus siRNA sense strand
ugaugacgacaauccuggcca

SEQ ID NO: 2854 - RNA, 21 nt, Artificial Sequence
  Ebola virus siRNA sense strand
gaugacgacaauccuggccau

SEQ ID NO: 2855 - RNA, 21 nt, Artificial Sequence
  Ebola virus siRNA sense strand
augacgacaauccuggccauc

SEQ ID NO: 2856 - RNA, 21 nt, Artificial Sequence
  Ebola virus siRNA sense strand
ugacgacaauccuggccauca

SEQ ID NO: 2857 - RNA, 21 nt, Artificial Sequence
  Ebola virus siRNA sense strand
gacgacaauccuggccaucaa

SEQ ID NO: 2858 - RNA, 21 nt, Artificial Sequence
  Ebola virus siRNA sense strand
acgacaauccuggccaucaag

SEQ ID NO: 2859 - RNA, 21 nt, Artificial Sequence
  Ebola virus siRNA sense strand
cgacaauccuggccaucaaga

SEQ ID NO: 2860 - RNA, 21 nt, Artificial Sequence
  Ebola virus siRNA sense strand
gacaauccuggccaucaagau

SEQ ID NO: 2861 - RNA, 21 nt, Artificial Sequence
  Ebola virus siRNA sense strand
acaauccuggccaucaagaug

SEQ ID NO: 2862 - RNA, 21 nt, Artificial Sequence
  Ebola virus siRNA sense strand
caauccuggccaucaagauga

SEQ ID NO: 2863 - RNA, 21 nt, Artificial Sequence
  Ebola virus siRNA sense strand
aauccuggccaucaagaugau

SEQ ID NO: 2864 - RNA, 21 nt, Artificial Sequence
  Ebola virus siRNA sense strand
auccuggccaucaagaugaug

SEQ ID NO: 2865 - RNA, 21 nt, Artificial Sequence
  Ebola virus siRNA sense strand
uccuggccaucaagaugauga

SEQ ID NO: 2866 - RNA, 21 nt, Artificial Sequence
  Ebola virus siRNA sense strand
ccuggccaucaagaugaugau

SEQ ID NO: 2867 - RNA, 21 nt, Artificial Sequence
  Ebola virus siRNA sense strand
cuggccaucaagaugaugauc

SEQ ID NO: 2868 - RNA, 21 nt, Artificial Sequence
  Ebola virus siRNA sense strand
uggccaucaagaugaugaucc

SEQ ID NO: 2869 - RNA, 21 nt, Artificial Sequence
  Ebola virus siRNA sense strand
ggccaucaagaugaugauccg

SEQ ID NO: 2870 - RNA, 21 nt, Artificial Sequence
  Ebola virus siRNA sense strand
gccaucaagaugaugauccga

SEQ ID NO: 2871 - RNA, 21 nt, Artificial Sequence
  Ebola virus siRNA sense strand
ccaucaagaugaugauccgac

SEQ ID NO: 2872 - RNA, 21 nt, Artificial Sequence
  Ebola virus siRNA sense strand
caucaagaugaugauccgacu

SEQ ID NO: 2873 - RNA, 21 nt, Artificial Sequence
  Ebola virus siRNA sense strand
aucaagaugaugauccgacug

SEQ ID NO: 2874 - RNA, 21 nt, Artificial Sequence
  Ebola virus siRNA sense strand
ucaagaugaugauccgacuga

SEQ ID NO: 2875 - RNA, 21 nt, Artificial Sequence
  Ebola virus siRNA sense strand
caagaugaugauccgacugac

SEQ ID NO: 2876 - RNA, 21 nt, Artificial Sequence
  Ebola virus siRNA sense strand
aagaugaugauccgacugacu

SEQ ID NO: 2877 - RNA, 21 nt, Artificial Sequence
  Ebola virus siRNA sense strand
agaugaugauccgacugacuc

SEQ ID NO: 2878 - RNA, 21 nt, Artificial Sequence
  Ebola virus siRNA sense strand
gaugaugauccgacugacuca

SEQ ID NO: 2879 - RNA, 21 nt, Artificial Sequence
  Ebola virus siRNA sense strand
augaugauccgacugacucac

SEQ ID NO: 2880 - RNA, 21 nt, Artificial Sequence
  Ebola virus siRNA sense strand
ugaugauccgacugacucaca

SEQ ID NO: 2881 - RNA, 21 nt, Artificial Sequence
  Ebola virus siRNA sense strand
gaugauccgacugacucacag

SEQ ID NO: 2882 - RNA, 21 nt, Artificial Sequence
  Ebola virus siRNA sense strand
augauccgacugacucacagg

SEQ ID NO: 2883 - RNA, 21 nt, Artificial Sequence
  Ebola virus siRNA sense strand
ugauccgacugacucacagga

SEQ ID NO: 2884 - RNA, 21 nt, Artificial Sequence
  Ebola virus siRNA sense strand
gauccgacugacucacaggau

SEQ ID NO: 2885 - RNA, 21 nt, Artificial Sequence
  Ebola virus siRNA sense strand
auccgacugacucacaggaua

SEQ ID NO: 2886 - RNA, 21 nt, Artificial Sequence
  Ebola virus siRNA sense strand
uccgacugacucacaggauac

SEQ ID NO: 2887 - RNA, 21 nt, Artificial Sequence
  Ebola virus siRNA sense strand
ccgacugacucacaggauacg

SEQ ID NO: 2888 - RNA, 21 nt, Artificial Sequence
  Ebola virus siRNA sense strand
cgacugacucacaggauacga

SEQ ID NO: 2889 - RNA, 21 nt, Artificial Sequence
  Ebola virus siRNA sense strand
gacugacucacaggauacgac

SEQ ID NO: 2890 - RNA, 21 nt, Artificial Sequence
  Ebola virus siRNA sense strand
acugacucacaggauacgacc

SEQ ID NO: 2891 - RNA, 21 nt, Artificial Sequence
  Ebola virus siRNA sense strand
cugacucacaggauacgacca

SEQ ID NO: 2892 - RNA, 21 nt, Artificial Sequence
  Ebola virus siRNA sense strand
ugacucacaggauacgaccau

SEQ ID NO: 2893 - RNA, 21 nt, Artificial Sequence
  Ebola virus siRNA sense strand
gacucacaggauacgaccauu

SEQ ID NO: 2894 - RNA, 21 nt, Artificial Sequence
  Ebola virus siRNA sense strand
acucacaggauacgaccauuc

SEQ ID NO: 2895 - RNA, 21 nt, Artificial Sequence
  Ebola virus siRNA sense strand
cucacaggauacgaccauucc

SEQ ID NO: 2896 - RNA, 21 nt, Artificial Sequence
  Ebola virus siRNA sense strand
ucacaggauacgaccauuccc

SEQ ID NO: 2897 - RNA, 21 nt, Artificial Sequence
  Ebola virus siRNA sense strand
cacaggauacgaccauucccg

SEQ ID NO: 2898 - RNA, 21 nt, Artificial Sequence
  Ebola virus siRNA sense strand
acaggauacgaccauucccga

SEQ ID NO: 2899 - RNA, 21 nt, Artificial Sequence
  Ebola virus siRNA sense strand
caggauacgaccauucccgau

SEQ ID NO: 2900 - RNA, 21 nt, Artificial Sequence
  Ebola virus siRNA sense strand
aggauacgaccauucccgaug

SEQ ID NO: 2901 - RNA, 21 nt, Artificial Sequence
  Ebola virus siRNA sense strand
ggauacgaccauucccgaugu

SEQ ID NO: 2902 - RNA, 21 nt, Artificial Sequence
  Ebola virus siRNA sense strand
gauacgaccauucccgaugug

SEQ ID NO: 2903 - RNA, 21 nt, Artificial Sequence
  Ebola virus siRNA sense strand
auacgaccauucccgaugugg

SEQ ID NO: 2904 - RNA, 21 nt, Artificial Sequence
  Ebola virus siRNA sense strand
uacgaccauucccgauguggu

SEQ ID NO: 2905 - RNA, 21 nt, Artificial Sequence
  Ebola virus siRNA sense strand
acgaccauucccgauguggug

SEQ ID NO: 2906 - RNA, 21 nt, Artificial Sequence
  Ebola virus siRNA sense strand
cgaccauucccgauguggugg

SEQ ID NO: 2907 - RNA, 21 nt, Artificial Sequence
  Ebola virus siRNA sense strand
gaccauucccgaugugguggu

SEQ ID NO: 2908 - RNA, 21 nt, Artificial Sequence
  Ebola virus siRNA sense strand
accauucccgauguggugguu

SEQ ID NO: 2909 - RNA, 21 nt, Artificial Sequence
  Ebola virus siRNA sense strand
ccauucccgauguggugguug

SEQ ID NO: 2910 - RNA, 21 nt, Artificial Sequence
  Ebola virus siRNA sense strand
cauucccgauguggugguuga

SEQ ID NO: 2911 - RNA, 21 nt, Artificial Sequence
  Ebola virus siRNA sense strand
auucccgauguggugguugau

SEQ ID NO: 2912 - RNA, 21 nt, Artificial Sequence
  Ebola virus siRNA sense strand
uucccgauguggugguugauc

SEQ ID NO: 2913 - RNA, 21 nt, Artificial Sequence
  Ebola virus siRNA sense strand
ucccgauguggugguugaucc

SEQ ID NO: 2914 - RNA, 21 nt, Artificial Sequence
  Ebola virus siRNA sense strand
cccgauguggugguugauccc

SEQ ID NO: 2915 - RNA, 21 nt, Artificial Sequence
  Ebola virus siRNA sense strand
ccgauguggugguugaucccg

SEQ ID NO: 2916 - RNA, 21 nt, Artificial Sequence
  Ebola virus siRNA sense strand
cgauguggugguugaucccga

SEQ ID NO: 2917 - RNA, 21 nt, Artificial Sequence
  Ebola virus siRNA sense strand
gauguggugguugaucccgau

SEQ ID NO: 2918 - RNA, 21 nt, Artificial Sequence
  Ebola virus siRNA sense strand
auguggugguugaucccgaug

SEQ ID NO: 2919 - RNA, 21 nt, Artificial Sequence
  Ebola virus siRNA sense strand
uguggugguugaucccgauga

SEQ ID NO: 2920 - RNA, 21 nt, Artificial Sequence
  Ebola virus siRNA sense strand
guggugguugaucccgaugau

SEQ ID NO: 2921 - RNA, 21 nt, Artificial Sequence
  Ebola virus siRNA sense strand
uggugguugaucccgaugaug

SEQ ID NO: 2922 - RNA, 21 nt, Artificial Sequence
  Ebola virus siRNA sense strand
ggugguugaucccgaugaugg

SEQ ID NO: 2923 - RNA, 21 nt, Artificial Sequence
  Ebola virus siRNA sense strand
gugguugaucccgaugaugga

SEQ ID NO: 2924 - RNA, 21 nt, Artificial Sequence
  Ebola virus siRNA sense strand
ugguugaucccgaugauggaa

SEQ ID NO: 2925 - RNA, 21 nt, Artificial Sequence
  Ebola virus siRNA sense strand
gguugaucccgaugauggaag

SEQ ID NO: 2926 - RNA, 21 nt, Artificial Sequence
  Ebola virus siRNA sense strand
guugaucccgaugauggaagc

SEQ ID NO: 2927 - RNA, 21 nt, Artificial Sequence
  Ebola virus siRNA sense strand
uugaucccgaugauggaagcu

SEQ ID NO: 2928 - RNA, 21 nt, Artificial Sequence
  Ebola virus siRNA sense strand
ugaucccgaugauggaagcua

SEQ ID NO: 2929 - RNA, 21 nt, Artificial Sequence
  Ebola virus siRNA sense strand
gaucccgaugauggaagcuac

SEQ ID NO: 2930 - RNA, 21 nt, Artificial Sequence
  Ebola virus siRNA sense strand
aucccgaugauggaagcuacg

SEQ ID NO: 2931 - RNA, 21 nt, Artificial Sequence
  Ebola virus siRNA sense strand
ucccgaugauggaagcuacgg

SEQ ID NO: 2932 - RNA, 21 nt, Artificial Sequence
  Ebola virus siRNA sense strand
cccgaugauggaagcuacggc

SEQ ID NO: 2933 - RNA, 21 nt, Artificial Sequence
  Ebola virus siRNA sense strand
ccgaugauggaagcuacggcg

SEQ ID NO: 2934 - RNA, 21 nt, Artificial Sequence
  Ebola virus siRNA sense strand
cgaugauggaagcuacggcga

SEQ ID NO: 2935 - RNA, 21 nt, Artificial Sequence
  Ebola virus siRNA sense strand
gaugauggaagcuacggcgaa

SEQ ID NO: 2936 - RNA, 21 nt, Artificial Sequence
  Ebola virus siRNA sense strand
augauggaagcuacggcgaau

SEQ ID NO: 2937 - RNA, 21 nt, Artificial Sequence
  Ebola virus siRNA sense strand
ugauggaagcuacggcgaaua

SEQ ID NO: 2938 - RNA, 21 nt, Artificial Sequence
  Ebola virus siRNA sense strand
gauggaagcuacggcgaauac

SEQ ID NO: 2939 - RNA, 21 nt, Artificial Sequence
  Ebola virus siRNA sense strand
auggaagcuacggcgaauacc

SEQ ID NO: 2940 - RNA, 21 nt, Artificial Sequence
  Ebola virus siRNA sense strand
uggaagcuacggcgaauacca

SEQ ID NO: 2941 - RNA, 21 nt, Artificial Sequence
  Ebola virus siRNA sense strand
ggaagcuacggcgaauaccag

SEQ ID NO: 2942 - RNA, 21 nt, Artificial Sequence
  Ebola virus siRNA sense strand
gaagcuacggcgaauaccaga

SEQ ID NO: 2943 - RNA, 21 nt, Artificial Sequence
  Ebola virus siRNA sense strand
aagcuacggcgaauaccagag

SEQ ID NO: 2944 - RNA, 21 nt, Artificial Sequence
  Ebola virus siRNA sense strand
agcuacggcgaauaccagagu

SEQ ID NO: 2945 - RNA, 21 nt, Artificial Sequence
  Ebola virus siRNA sense strand
gcuacggcgaauaccagaguu

SEQ ID NO: 2946 - RNA, 21 nt, Artificial Sequence
  Ebola virus siRNA sense strand
cuacggcgaauaccagaguua

SEQ ID NO: 2947 - RNA, 21 nt, Artificial Sequence
  Ebola virus siRNA sense strand
uacggcgaauaccagaguuac

SEQ ID NO: 2948 - RNA, 21 nt, Artificial Sequence
  Ebola virus siRNA sense strand
acggcgaauaccagaguuacu

SEQ ID NO: 2949 - RNA, 21 nt, Artificial Sequence
  Ebola virus siRNA sense strand
cggcgaauaccagaguuacuc

SEQ ID NO: 2950 - RNA, 21 nt, Artificial Sequence
  Ebola virus siRNA sense strand
ggcgaauaccagaguuacucg

SEQ ID NO: 2951 - RNA, 21 nt, Artificial Sequence
  Ebola virus siRNA sense strand
gcgaauaccagaguuacucgg

SEQ ID NO: 2952 - RNA, 21 nt, Artificial Sequence
  Ebola virus siRNA sense strand
cgaauaccagaguuacucgga

SEQ ID NO: 2953 - RNA, 21 nt, Artificial Sequence
  Ebola virus siRNA sense strand
gaauaccagaguuacucggaa

SEQ ID NO: 2954 - RNA, 21 nt, Artificial Sequence
  Ebola virus siRNA sense strand
aauaccagaguuacucggaaa

SEQ ID NO: 2955 - RNA, 21 nt, Artificial Sequence
  Ebola virus siRNA sense strand
auaccagaguuacucggaaaa

SEQ ID NO: 2956 - RNA, 21 nt, Artificial Sequence
  Ebola virus siRNA sense strand
uaccagaguuacucggaaaac

SEQ ID NO: 2957 - RNA, 21 nt, Artificial Sequence
  Ebola virus siRNA sense strand
accagaguuacucggaaaacg

SEQ ID NO: 2958 - RNA, 21 nt, Artificial Sequence
  Ebola virus siRNA sense strand
ccagaguuacucggaaaacgg

SEQ ID NO: 2959 - RNA, 21 nt, Artificial Sequence
  Ebola virus siRNA sense strand
cagaguuacucggaaaacggc

SEQ ID NO: 2960 - RNA, 21 nt, Artificial Sequence
  Ebola virus siRNA sense strand
agaguuacucggaaaacggca

SEQ ID NO: 2961 - RNA, 21 nt, Artificial Sequence
  Ebola virus siRNA sense strand
gaguuacucggaaaacggcau

SEQ ID NO: 2962 - RNA, 21 nt, Artificial Sequence
  Ebola virus siRNA sense strand
aguuacucggaaaacggcaug

SEQ ID NO: 2963 - RNA, 21 nt, Artificial Sequence
  Ebola virus siRNA sense strand
guuacucggaaaacggcauga

SEQ ID NO: 2964 - RNA, 21 nt, Artificial Sequence
  Ebola virus siRNA sense strand
uuacucggaaaacggcaugaa

SEQ ID NO: 2965 - RNA, 21 nt, Artificial Sequence
  Ebola virus siRNA sense strand
uacucggaaaacggcaugaau

SEQ ID NO: 2966 - RNA, 21 nt, Artificial Sequence
  Ebola virus siRNA sense strand
acucggaaaacggcaugaaug

SEQ ID NO: 2967 - RNA, 21 nt, Artificial Sequence
  Ebola virus siRNA sense strand
cucggaaaacggcaugaaugc

SEQ ID NO: 2968 - RNA, 21 nt, Artificial Sequence
  Ebola virus siRNA sense strand
ucggaaaacggcaugaaugca

SEQ ID NO: 2969 - RNA, 21 nt, Artificial Sequence
  Ebola virus siRNA sense strand
cggaaaacggcaugaaugcac

SEQ ID NO: 2970 - RNA, 21 nt, Artificial Sequence
  Ebola virus siRNA sense strand
ggaaaacggcaugaaugcacc

SEQ ID NO: 2971 - RNA, 21 nt, Artificial Sequence
  Ebola virus siRNA sense strand
gaaaacggcaugaaugcacca

SEQ ID NO: 2972 - RNA, 21 nt, Artificial Sequence
  Ebola virus siRNA sense strand
aaaacggcaugaaugcaccag

SEQ ID NO: 2973 - RNA, 21 nt, Artificial Sequence
  Ebola virus siRNA sense strand
aaacggcaugaaugcaccaga

SEQ ID NO: 2974 - RNA, 21 nt, Artificial Sequence
  Ebola virus siRNA sense strand
aacggcaugaaugcaccagau

SEQ ID NO: 2975 - RNA, 21 nt, Artificial Sequence
  Ebola virus siRNA sense strand
acggcaugaaugcaccagaug

SEQ ID NO: 2976 - RNA, 21 nt, Artificial Sequence
  Ebola virus siRNA sense strand
cggcaugaaugcaccagauga

SEQ ID NO: 2977 - RNA, 21 nt, Artificial Sequence
  Ebola virus siRNA sense strand
ggcaugaaugcaccagaugac

SEQ ID NO: 2978 - RNA, 21 nt, Artificial Sequence
  Ebola virus siRNA sense strand
gcaugaaugcaccagaugacu

SEQ ID NO: 2979 - RNA, 21 nt, Artificial Sequence
  Ebola virus siRNA sense strand
caugaaugcaccagaugacuu

SEQ ID NO: 2980 - RNA, 21 nt, Artificial Sequence
  Ebola virus siRNA sense strand
augaaugcaccagaugacuug

SEQ ID NO: 2981 - RNA, 21 nt, Artificial Sequence
  Ebola virus siRNA sense strand
ugaaugcaccagaugacuugg

SEQ ID NO: 2982 - RNA, 21 nt, Artificial Sequence
  Ebola virus siRNA sense strand
gaaugcaccagaugacuuggu

SEQ ID NO: 2983 - RNA, 21 nt, Artificial Sequence
  Ebola virus siRNA sense strand
aaugcaccagaugacuugguc

SEQ ID NO: 2984 - RNA, 21 nt, Artificial Sequence
  Ebola virus siRNA sense strand
augcaccagaugacuuggucc

SEQ ID NO: 2985 - RNA, 21 nt, Artificial Sequence
  Ebola virus siRNA sense strand
ugcaccagaugacuugguccu

SEQ ID NO: 2986 - RNA, 21 nt, Artificial Sequence
  Ebola virus siRNA sense strand
gcaccagaugacuugguccua

SEQ ID NO: 2987 - RNA, 21 nt, Artificial Sequence
  Ebola virus siRNA sense strand
caccagaugacuugguccuau

SEQ ID NO: 2988 - RNA, 21 nt, Artificial Sequence
  Ebola virus siRNA sense strand
accagaugacuugguccuauu

SEQ ID NO: 2989 - RNA, 21 nt, Artificial Sequence
  Ebola virus siRNA sense strand
ccagaugacuugguccuauuc

SEQ ID NO: 2990 - RNA, 21 nt, Artificial Sequence
  Ebola virus siRNA sense strand
cagaugacuugguccuauucg

SEQ ID NO: 2991 - RNA, 21 nt, Artificial Sequence
  Ebola virus siRNA sense strand
agaugacuugguccuauucga

SEQ ID NO: 2992 - RNA, 21 nt, Artificial Sequence
  Ebola virus siRNA sense strand
gaugacuugguccuauucgau

SEQ ID NO: 2993 - RNA, 21 nt, Artificial Sequence
  Ebola virus siRNA sense strand
augacuugguccuauucgauc

SEQ ID NO: 2994 - RNA, 21 nt, Artificial Sequence
  Ebola virus siRNA sense strand
ugacuugguccuauucgaucu

SEQ ID NO: 2995 - RNA, 21 nt, Artificial Sequence
  Ebola virus siRNA sense strand
gacuugguccuauucgaucua

SEQ ID NO: 2996 - RNA, 21 nt, Artificial Sequence
  Ebola virus siRNA sense strand
acuugguccuauucgaucuag

SEQ ID NO: 2997 - RNA, 21 nt, Artificial Sequence
  Ebola virus siRNA sense strand
cuugguccuauucgaucuaga

SEQ ID NO: 2998 - RNA, 21 nt, Artificial Sequence
  Ebola virus siRNA sense strand
uugguccuauucgaucuagac

SEQ ID NO: 2999 - RNA, 21 nt, Artificial Sequence
  Ebola virus siRNA sense strand
ugguccuauucgaucuagacg

SEQ ID NO: 3000 - RNA, 21 nt, Artificial Sequence
  Ebola virus siRNA sense strand
gguccuauucgaucuagacga

SEQ ID NO: 3001 - RNA, 21 nt, Artificial Sequence
  Ebola virus siRNA sense strand
guccuauucgaucuagacgag

SEQ ID NO: 3002 - RNA, 21 nt, Artificial Sequence
  Ebola virus siRNA sense strand
uccuauucgaucuagacgagg

SEQ ID NO: 3003 - RNA, 21 nt, Artificial Sequence
  Ebola virus siRNA sense strand
ccuauucgaucuagacgagga

SEQ ID NO: 3004 - RNA, 21 nt, Artificial Sequence
  Ebola virus siRNA sense strand
cuauucgaucuagacgaggac

SEQ ID NO: 3005 - RNA, 21 nt, Artificial Sequence
  Ebola virus siRNA sense strand
uauucgaucuagacgaggacg

SEQ ID NO: 3006 - RNA, 21 nt, Artificial Sequence
  Ebola virus siRNA sense strand
auucgaucuagacgaggacga

SEQ ID NO: 3007 - RNA, 21 nt, Artificial Sequence
  Ebola virus siRNA sense strand
uucgaucuagacgaggacgac

SEQ ID NO: 3008 - RNA, 21 nt, Artificial Sequence
  Ebola virus siRNA sense strand
ucgaucuagacgaggacgacg

SEQ ID NO: 3009 - RNA, 21 nt, Artificial Sequence
  Ebola virus siRNA sense strand
cgaucuagacgaggacgacga

SEQ ID NO: 3010 - RNA, 21 nt, Artificial Sequence
  Ebola virus siRNA sense strand
gaucuagacgaggacgacgag

SEQ ID NO: 3011 - RNA, 21 nt, Artificial Sequence
  Ebola virus siRNA sense strand
aucuagacgaggacgacgagg

SEQ ID NO: 3012 - RNA, 21 nt, Artificial Sequence
  Ebola virus siRNA sense strand
ucuagacgaggacgacgagga

SEQ ID NO: 3013 - RNA, 21 nt, Artificial Sequence
  Ebola virus siRNA sense strand
cuagacgaggacgacgaggac

SEQ ID NO: 3014 - RNA, 21 nt, Artificial Sequence
  Ebola virus siRNA sense strand
uagacgaggacgacgaggaca

SEQ ID NO: 3015 - RNA, 21 nt, Artificial Sequence
  Ebola virus siRNA sense strand
agacgaggacgacgaggacac

SEQ ID NO: 3016 - RNA, 21 nt, Artificial Sequence
  Ebola virus siRNA sense strand
gacgaggacgacgaggacacu

SEQ ID NO: 3017 - RNA, 21 nt, Artificial Sequence
  Ebola virus siRNA sense strand
acgaggacgacgaggacacua

SEQ ID NO: 3018 - RNA, 21 nt, Artificial Sequence
  Ebola virus siRNA sense strand
cgaggacgacgaggacacuaa

SEQ ID NO: 3019 - RNA, 21 nt, Artificial Sequence
  Ebola virus siRNA sense strand
gaggacgacgaggacacuaag

SEQ ID NO: 3020 - RNA, 21 nt, Artificial Sequence
  Ebola virus siRNA sense strand
aggacgacgaggacacuaagc

SEQ ID NO: 3021 - RNA, 21 nt, Artificial Sequence
  Ebola virus siRNA sense strand
ggacgacgaggacacuaagcc

SEQ ID NO: 3022 - RNA, 21 nt, Artificial Sequence
  Ebola virus siRNA sense strand
gacgacgaggacacuaagcca

SEQ ID NO: 3023 - RNA, 21 nt, Artificial Sequence
  Ebola virus siRNA sense strand
acgacgaggacacuaagccag

SEQ ID NO: 3024 - RNA, 21 nt, Artificial Sequence
  Ebola virus siRNA sense strand
cgacgaggacacuaagccagu

SEQ ID NO: 3025 - RNA, 21 nt, Artificial Sequence
  Ebola virus siRNA sense strand
gacgaggacacuaagccagug

SEQ ID NO: 3026 - RNA, 21 nt, Artificial Sequence
  Ebola virus siRNA sense strand
acgaggacacuaagccagugc

SEQ ID NO: 3027 - RNA, 21 nt, Artificial Sequence
  Ebola virus siRNA sense strand
cgaggacacuaagccagugcc

SEQ ID NO: 3028 - RNA, 21 nt, Artificial Sequence
  Ebola virus siRNA sense strand
gaggacacuaagccagugccu

SEQ ID NO: 3029 - RNA, 21 nt, Artificial Sequence
  Ebola virus siRNA sense strand
aggacacuaagccagugccua

SEQ ID NO: 3030 - RNA, 21 nt, Artificial Sequence
  Ebola virus siRNA sense strand
ggacacuaagccagugccuaa

SEQ ID NO: 3031 - RNA, 21 nt, Artificial Sequence
  Ebola virus siRNA sense strand
gacacuaagccagugccuaau

SEQ ID NO: 3032 - RNA, 21 nt, Artificial Sequence
  Ebola virus siRNA sense strand
acacuaagccagugccuaaua

SEQ ID NO: 3033 - RNA, 21 nt, Artificial Sequence
  Ebola virus siRNA sense strand
cacuaagccagugccuaauag

SEQ ID NO: 3034 - RNA, 21 nt, Artificial Sequence
  Ebola virus siRNA sense strand
acuaagccagugccuaauaga

SEQ ID NO: 3035 - RNA, 21 nt, Artificial Sequence
  Ebola virus siRNA sense strand
cuaagccagugccuaauagau

SEQ ID NO: 3036 - RNA, 21 nt, Artificial Sequence
  Ebola virus siRNA sense strand
uaagccagugccuaauagauc

SEQ ID NO: 3037 - RNA, 21 nt, Artificial Sequence
  Ebola virus siRNA sense strand
aagccagugccuaauagaucg

SEQ ID NO: 3038 - RNA, 21 nt, Artificial Sequence
  Ebola virus siRNA sense strand
agccagugccuaauagaucga

SEQ ID NO: 3039 - RNA, 21 nt, Artificial Sequence
  Ebola virus siRNA sense strand
gccagugccuaauagaucgac

SEQ ID NO: 3040 - RNA, 21 nt, Artificial Sequence
  Ebola virus siRNA sense strand
ccagugccuaauagaucgacc

SEQ ID NO: 3041 - RNA, 21 nt, Artificial Sequence
  Ebola virus siRNA sense strand
cagugccuaauagaucgacca

SEQ ID NO: 3042 - RNA, 21 nt, Artificial Sequence
  Ebola virus siRNA sense strand
agugccuaauagaucgaccaa

SEQ ID NO: 3043 - RNA, 21 nt, Artificial Sequence
  Ebola virus siRNA sense strand
gugccuaauagaucgaccaag

SEQ ID NO: 3044 - RNA, 21 nt, Artificial Sequence
  Ebola virus siRNA sense strand
ugccuaauagaucgaccaagg

SEQ ID NO: 3045 - RNA, 21 nt, Artificial Sequence
  Ebola virus siRNA sense strand
gccuaauagaucgaccaaggg

SEQ ID NO: 3046 - RNA, 21 nt, Artificial Sequence
  Ebola virus siRNA sense strand
ccuaauagaucgaccaagggu

SEQ ID NO: 3047 - RNA, 21 nt, Artificial Sequence
  Ebola virus siRNA sense strand
cuaauagaucgaccaagggug

SEQ ID NO: 3048 - RNA, 21 nt, Artificial Sequence
  Ebola virus siRNA sense strand
uaauagaucgaccaagggugg

SEQ ID NO: 3049 - RNA, 21 nt, Artificial Sequence
  Ebola virus siRNA sense strand
aauagaucgaccaagggugga

SEQ ID NO: 3050 - RNA, 21 nt, Artificial Sequence
  Ebola virus siRNA sense strand
auagaucgaccaaggguggac

SEQ ID NO: 3051 - RNA, 21 nt, Artificial Sequence
  Ebola virus siRNA sense strand
uagaucgaccaaggguggaca

SEQ ID NO: 3052 - RNA, 21 nt, Artificial Sequence
  Ebola virus siRNA sense strand
agaucgaccaaggguggacaa

SEQ ID NO: 3053 - RNA, 21 nt, Artificial Sequence
  Ebola virus siRNA sense strand
gaucgaccaaggguggacaac

SEQ ID NO: 3054 - RNA, 21 nt, Artificial Sequence
  Ebola virus siRNA sense strand
aucgaccaaggguggacaaca

SEQ ID NO: 3055 - RNA, 21 nt, Artificial Sequence
  Ebola virus siRNA sense strand
ucgaccaaggguggacaacag

SEQ ID NO: 3056 - RNA, 21 nt, Artificial Sequence
  Ebola virus siRNA sense strand
cgaccaaggguggacaacaga

SEQ ID NO: 3057 - RNA, 21 nt, Artificial Sequence
  Ebola virus siRNA sense strand
gaccaaggguggacaacagaa

SEQ ID NO: 3058 - RNA, 21 nt, Artificial Sequence
  Ebola virus siRNA sense strand
accaaggguggacaacagaag

SEQ ID NO: 3059 - RNA, 21 nt, Artificial Sequence
  Ebola virus siRNA sense strand
ccaaggguggacaacagaaga

SEQ ID NO: 3060 - RNA, 21 nt, Artificial Sequence
  Ebola virus siRNA sense strand
caaggguggacaacagaagaa

SEQ ID NO: 3061 - RNA, 21 nt, Artificial Sequence
  Ebola virus siRNA sense strand
aaggguggacaacagaagaac

SEQ ID NO: 3062 - RNA, 21 nt, Artificial Sequence
  Ebola virus siRNA sense strand
aggguggacaacagaagaaca

SEQ ID NO: 3063 - RNA, 21 nt, Artificial Sequence
  Ebola virus siRNA sense strand
ggguggacaacagaagaacag

SEQ ID NO: 3064 - RNA, 21 nt, Artificial Sequence
  Ebola virus siRNA sense strand
gguggacaacagaagaacagu

SEQ ID NO: 3065 - RNA, 21 nt, Artificial Sequence
  Ebola virus siRNA sense strand
guggacaacagaagaacaguc

SEQ ID NO: 3066 - RNA, 21 nt, Artificial Sequence
  Ebola virus siRNA sense strand
uggacaacagaagaacaguca

SEQ ID NO: 3067 - RNA, 21 nt, Artificial Sequence
  Ebola virus siRNA sense strand
ggacaacagaagaacagucaa

SEQ ID NO: 3068 - RNA, 21 nt, Artificial Sequence
  Ebola virus siRNA sense strand
gacaacagaagaacagucaaa

SEQ ID NO: 3069 - RNA, 21 nt, Artificial Sequence
  Ebola virus siRNA sense strand
acaacagaagaacagucaaaa

SEQ ID NO: 3070 - RNA, 21 nt, Artificial Sequence
  Ebola virus siRNA sense strand
caacagaagaacagucaaaag

SEQ ID NO: 3071 - RNA, 21 nt, Artificial Sequence
  Ebola virus siRNA sense strand
aacagaagaacagucaaaagg

SEQ ID NO: 3072 - RNA, 21 nt, Artificial Sequence
  Ebola virus siRNA sense strand
acagaagaacagucaaaaggg

SEQ ID NO: 3073 - RNA, 21 nt, Artificial Sequence
  Ebola virus siRNA sense strand
cagaagaacagucaaaagggc

SEQ ID NO: 3074 - RNA, 21 nt, Artificial Sequence
  Ebola virus siRNA sense strand
agaagaacagucaaaagggcc

SEQ ID NO: 3075 - RNA, 21 nt, Artificial Sequence
  Ebola virus siRNA sense strand
gaagaacagucaaaagggcca

SEQ ID NO: 3076 - RNA, 21 nt, Artificial Sequence
  Ebola virus siRNA sense strand
aagaacagucaaaagggccag

SEQ ID NO: 3077 - RNA, 21 nt, Artificial Sequence
  Ebola virus siRNA sense strand
agaacagucaaaagggccagc

SEQ ID NO: 3078 - RNA, 21 nt, Artificial Sequence
  Ebola virus siRNA sense strand
gaacagucaaaagggccagca

SEQ ID NO: 3079 - RNA, 21 nt, Artificial Sequence
  Ebola virus siRNA sense strand
aacagucaaaagggccagcau

SEQ ID NO: 3080 - RNA, 21 nt, Artificial Sequence
  Ebola virus siRNA sense strand
acagucaaaagggccagcaua

SEQ ID NO: 3081 - RNA, 21 nt, Artificial Sequence
  Ebola virus siRNA sense strand
cagucaaaagggccagcauau

SEQ ID NO: 3082 - RNA, 21 nt, Artificial Sequence
  Ebola virus siRNA sense strand
agucaaaagggccagcauaua

SEQ ID NO: 3083 - RNA, 21 nt, Artificial Sequence
  Ebola virus siRNA sense strand
gucaaaagggccagcauauag

SEQ ID NO: 3084 - RNA, 21 nt, Artificial Sequence
  Ebola virus siRNA sense strand
ucaaaagggccagcauauaga

SEQ ID NO: 3085 - RNA, 21 nt, Artificial Sequence
  Ebola virus siRNA sense strand
caaaagggccagcauauagag

SEQ ID NO: 3086 - RNA, 21 nt, Artificial Sequence
  Ebola virus siRNA sense strand
aaaagggccagcauauagagg

SEQ ID NO: 3087 - RNA, 21 nt, Artificial Sequence
  Ebola virus siRNA sense strand
aaagggccagcauauagaggg

SEQ ID NO: 3088 - RNA, 21 nt, Artificial Sequence
  Ebola virus siRNA sense strand
aagggccagcauauagagggc

SEQ ID NO: 3089 - RNA, 21 nt, Artificial Sequence
  Ebola virus siRNA sense strand
agggccagcauauagagggca

SEQ ID NO: 3090 - RNA, 21 nt, Artificial Sequence
  Ebola virus siRNA sense strand
gggccagcauauagagggcag

SEQ ID NO: 3091 - RNA, 21 nt, Artificial Sequence
  Ebola virus siRNA sense strand
ggccagcauauagagggcaga

SEQ ID NO: 3092 - RNA, 21 nt, Artificial Sequence
  Ebola virus siRNA sense strand
gccagcauauagagggcagac

SEQ ID NO: 3093 - RNA, 21 nt, Artificial Sequence
  Ebola virus siRNA sense strand
ccagcauauagagggcagaca

SEQ ID NO: 3094 - RNA, 21 nt, Artificial Sequence
  Ebola virus siRNA sense strand
cagcauauagagggcagacag

SEQ ID NO: 3095 - RNA, 21 nt, Artificial Sequence
  Ebola virus siRNA sense strand
agcauauagagggcagacaga

SEQ ID NO: 3096 - RNA, 21 nt, Artificial Sequence
  Ebola virus siRNA sense strand
gcauauagagggcagacagac

SEQ ID NO: 3097 - RNA, 21 nt, Artificial Sequence
  Ebola virus siRNA sense strand
cauauagagggcagacagaca

SEQ ID NO: 3098 - RNA, 21 nt, Artificial Sequence
  Ebola virus siRNA sense strand
auauagagggcagacagacac

SEQ ID NO: 3099 - RNA, 21 nt, Artificial Sequence
  Ebola virus siRNA sense strand
uauagagggcagacagacaca

SEQ ID NO: 3100 - RNA, 21 nt, Artificial Sequence
  Ebola virus siRNA sense strand
auagagggcagacagacacaa

SEQ ID NO: 3101 - RNA, 21 nt, Artificial Sequence
  Ebola virus siRNA sense strand
uagagggcagacagacacaau

SEQ ID NO: 3102 - RNA, 21 nt, Artificial Sequence
  Ebola virus siRNA sense strand
agagggcagacagacacaauc

SEQ ID NO: 3103 - RNA, 21 nt, Artificial Sequence
  Ebola virus siRNA sense strand
gagggcagacagacacaaucc

SEQ ID NO: 3104 - RNA, 21 nt, Artificial Sequence
  Ebola virus siRNA sense strand
agggcagacagacacaaucca

SEQ ID NO: 3105 - RNA, 21 nt, Artificial Sequence
  Ebola virus siRNA sense strand
gggcagacagacacaauccag

SEQ ID NO: 3106 - RNA, 21 nt, Artificial Sequence
  Ebola virus siRNA sense strand
ggcagacagacacaauccagg

SEQ ID NO: 3107 - RNA, 21 nt, Artificial Sequence
  Ebola virus siRNA sense strand
gcagacagacacaauccaggc

SEQ ID NO: 3108 - RNA, 21 nt, Artificial Sequence
  Ebola virus siRNA sense strand
cagacagacacaauccaggcc

SEQ ID NO: 3109 - RNA, 21 nt, Artificial Sequence
  Ebola virus siRNA sense strand
agacagacacaauccaggcca

SEQ ID NO: 3110 - RNA, 21 nt, Artificial Sequence
  Ebola virus siRNA sense strand
gacagacacaauccaggccaa

SEQ ID NO: 3111 - RNA, 21 nt, Artificial Sequence
  Ebola virus siRNA sense strand
acagacacaauccaggccaau

SEQ ID NO: 3112 - RNA, 21 nt, Artificial Sequence
  Ebola virus siRNA sense strand
cagacacaauccaggccaauu

SEQ ID NO: 3113 - RNA, 21 nt, Artificial Sequence
  Ebola virus siRNA sense strand
agacacaauccaggccaauuc

SEQ ID NO: 3114 - RNA, 21 nt, Artificial Sequence
  Ebola virus siRNA sense strand
gacacaauccaggccaauuca

SEQ ID NO: 3115 - RNA, 21 nt, Artificial Sequence
  Ebola virus siRNA sense strand
acacaauccaggccaauucaa

SEQ ID NO: 3116 - RNA, 21 nt, Artificial Sequence
  Ebola virus siRNA sense strand
cacaauccaggccaauucaaa

SEQ ID NO: 3117 - RNA, 21 nt, Artificial Sequence
  Ebola virus siRNA sense strand
acaauccaggccaauucaaaa

SEQ ID NO: 3118 - RNA, 21 nt, Artificial Sequence
  Ebola virus siRNA sense strand
caauccaggccaauucaaaau

SEQ ID NO: 3119 - RNA, 21 nt, Artificial Sequence
  Ebola virus siRNA sense strand
aauccaggccaauucaaaaug

SEQ ID NO: 3120 - RNA, 21 nt, Artificial Sequence
  Ebola virus siRNA sense strand
auccaggccaauucaaaaugu

SEQ ID NO: 3121 - RNA, 21 nt, Artificial Sequence
  Ebola virus siRNA sense strand
uccaggccaauucaaaauguc

SEQ ID NO: 3122 - RNA, 21 nt, Artificial Sequence
  Ebola virus siRNA sense strand
ccaggccaauucaaaaugucc

SEQ ID NO: 3123 - RNA, 21 nt, Artificial Sequence
  Ebola virus siRNA sense strand
caggccaauucaaaauguccc

SEQ ID NO: 3124 - RNA, 21 nt, Artificial Sequence
  Ebola virus siRNA sense strand
aggccaauucaaaauguccca

SEQ ID NO: 3125 - RNA, 21 nt, Artificial Sequence
  Ebola virus siRNA sense strand
ggccaauucaaaaugucccag

SEQ ID NO: 3126 - RNA, 21 nt, Artificial Sequence
  Ebola virus siRNA sense strand
gccaauucaaaaugucccagg

SEQ ID NO: 3127 - RNA, 21 nt, Artificial Sequence
  Ebola virus siRNA sense strand
ccaauucaaaaugucccaggc

SEQ ID NO: 3128 - RNA, 21 nt, Artificial Sequence
  Ebola virus siRNA sense strand
caauucaaaaugucccaggcc

SEQ ID NO: 3129 - RNA, 21 nt, Artificial Sequence
  Ebola virus siRNA sense strand
aauucaaaaugucccaggccc

SEQ ID NO: 3130 - RNA, 21 nt, Artificial Sequence
  Ebola virus siRNA sense strand
auucaaaaugucccaggcccu

SEQ ID NO: 3131 - RNA, 21 nt, Artificial Sequence
  Ebola virus siRNA sense strand
uucaaaaugucccaggcccuc

SEQ ID NO: 3132 - RNA, 21 nt, Artificial Sequence
  Ebola virus siRNA sense strand
ucaaaaugucccaggcccuca

SEQ ID NO: 3133 - RNA, 21 nt, Artificial Sequence
  Ebola virus siRNA sense strand
caaaaugucccaggcccucac

SEQ ID NO: 3134 - RNA, 21 nt, Artificial Sequence
  Ebola virus siRNA sense strand
aaaaugucccaggcccucaca

SEQ ID NO: 3135 - RNA, 21 nt, Artificial Sequence
  Ebola virus siRNA sense strand
aaaugucccaggcccucacag

SEQ ID NO: 3136 - RNA, 21 nt, Artificial Sequence
  Ebola virus siRNA sense strand
aaugucccaggcccucacaga

SEQ ID NO: 3137 - RNA, 21 nt, Artificial Sequence
  Ebola virus siRNA sense strand
augucccaggcccucacagaa

SEQ ID NO: 3138 - RNA, 21 nt, Artificial Sequence
  Ebola virus siRNA sense strand
ugucccaggcccucacagaac

SEQ ID NO: 3139 - RNA, 21 nt, Artificial Sequence
  Ebola virus siRNA sense strand
gucccaggcccucacagaaca

SEQ ID NO: 3140 - RNA, 21 nt, Artificial Sequence
  Ebola virus siRNA sense strand
ucccaggcccucacagaacaa

SEQ ID NO: 3141 - RNA, 21 nt, Artificial Sequence
  Ebola virus siRNA sense strand
cccaggcccucacagaacaau

SEQ ID NO: 3142 - RNA, 21 nt, Artificial Sequence
  Ebola virus siRNA sense strand
ccaggcccucacagaacaauc

SEQ ID NO: 3143 - RNA, 21 nt, Artificial Sequence
  Ebola virus siRNA sense strand
caggcccucacagaacaaucc

SEQ ID NO: 3144 - RNA, 21 nt, Artificial Sequence
  Ebola virus siRNA sense strand
aggcccucacagaacaaucca

SEQ ID NO: 3145 - RNA, 21 nt, Artificial Sequence
  Ebola virus siRNA sense strand
ggcccucacagaacaauccac

SEQ ID NO: 3146 - RNA, 21 nt, Artificial Sequence
  Ebola virus siRNA sense strand
gcccucacagaacaauccacc

SEQ ID NO: 3147 - RNA, 21 nt, Artificial Sequence
  Ebola virus siRNA sense strand
cccucacagaacaauccacca

SEQ ID NO: 3148 - RNA, 21 nt, Artificial Sequence
  Ebola virus siRNA sense strand
ccucacagaacaauccaccac

SEQ ID NO: 3149 - RNA, 21 nt, Artificial Sequence
  Ebola virus siRNA sense strand
cucacagaacaauccaccacg

SEQ ID NO: 3150 - RNA, 21 nt, Artificial Sequence
  Ebola virus siRNA sense strand
ucacagaacaauccaccacgc

SEQ ID NO: 3151 - RNA, 21 nt, Artificial Sequence
  Ebola virus siRNA sense strand
cacagaacaauccaccacgcc

SEQ ID NO: 3152 - RNA, 21 nt, Artificial Sequence
  Ebola virus siRNA sense strand
acagaacaauccaccacgcca

SEQ ID NO: 3153 - RNA, 21 nt, Artificial Sequence
  Ebola virus siRNA sense strand
cagaacaauccaccacgccag

SEQ ID NO: 3154 - RNA, 21 nt, Artificial Sequence
  Ebola virus siRNA sense strand
agaacaauccaccacgccagu

SEQ ID NO: 3155 - RNA, 21 nt, Artificial Sequence
  Ebola virus siRNA sense strand
gaacaauccaccacgccagug

SEQ ID NO: 3156 - RNA, 21 nt, Artificial Sequence
  Ebola virus siRNA sense strand
aacaauccaccacgccagugc

SEQ ID NO: 3157 - RNA, 21 nt, Artificial Sequence
  Ebola virus siRNA sense strand
acaauccaccacgccagugcg

SEQ ID NO: 3158 - RNA, 21 nt, Artificial Sequence
  Ebola virus siRNA sense strand
caauccaccacgccagugcgc

SEQ ID NO: 3159 - RNA, 21 nt, Artificial Sequence
  Ebola virus siRNA sense strand
aauccaccacgccagugcgcc

SEQ ID NO: 3160 - RNA, 21 nt, Artificial Sequence
  Ebola virus siRNA sense strand
auccaccacgccagugcgcca

SEQ ID NO: 3161 - RNA, 21 nt, Artificial Sequence
  Ebola virus siRNA sense strand
uccaccacgccagugcgccac

SEQ ID NO: 3162 - RNA, 21 nt, Artificial Sequence
  Ebola virus siRNA sense strand
ccaccacgccagugcgccacu

SEQ ID NO: 3163 - RNA, 21 nt, Artificial Sequence
  Ebola virus siRNA sense strand
caccacgccagugcgccacuc

SEQ ID NO: 3164 - RNA, 21 nt, Artificial Sequence
  Ebola virus siRNA sense strand
accacgccagugcgccacuca

SEQ ID NO: 3165 - RNA, 21 nt, Artificial Sequence
  Ebola virus siRNA sense strand
ccacgccagugcgccacucac

SEQ ID NO: 3166 - RNA, 21 nt, Artificial Sequence
  Ebola virus siRNA sense strand
cacgccagugcgccacucacg

SEQ ID NO: 3167 - RNA, 21 nt, Artificial Sequence
  Ebola virus siRNA sense strand
acgccagugcgccacucacgg

SEQ ID NO: 3168 - RNA, 21 nt, Artificial Sequence
  Ebola virus siRNA sense strand
cgccagugcgccacucacgga

SEQ ID NO: 3169 - RNA, 21 nt, Artificial Sequence
  Ebola virus siRNA sense strand
gccagugcgccacucacggac

SEQ ID NO: 3170 - RNA, 21 nt, Artificial Sequence
  Ebola virus siRNA sense strand
ccagugcgccacucacggaca

SEQ ID NO: 3171 - RNA, 21 nt, Artificial Sequence
  Ebola virus siRNA sense strand
cagugcgccacucacggacaa

SEQ ID NO: 3172 - RNA, 21 nt, Artificial Sequence
  Ebola virus siRNA sense strand
agugcgccacucacggacaau

SEQ ID NO: 3173 - RNA, 21 nt, Artificial Sequence
  Ebola virus siRNA sense strand
gugcgccacucacggacaaug

SEQ ID NO: 3174 - RNA, 21 nt, Artificial Sequence
  Ebola virus siRNA sense strand
ugcgccacucacggacaauga

SEQ ID NO: 3175 - RNA, 21 nt, Artificial Sequence
  Ebola virus siRNA sense strand
gcgccacucacggacaaugac

SEQ ID NO: 3176 - RNA, 21 nt, Artificial Sequence
  Ebola virus siRNA sense strand
cgccacucacggacaaugaca

SEQ ID NO: 3177 - RNA, 21 nt, Artificial Sequence
  Ebola virus siRNA sense strand
gccacucacggacaaugacag

SEQ ID NO: 3178 - RNA, 21 nt, Artificial Sequence
  Ebola virus siRNA sense strand
ccacucacggacaaugacaga

SEQ ID NO: 3179 - RNA, 21 nt, Artificial Sequence
  Ebola virus siRNA sense strand
cacucacggacaaugacagaa

SEQ ID NO: 3180 - RNA, 21 nt, Artificial Sequence
  Ebola virus siRNA sense strand
acucacggacaaugacagaag

SEQ ID NO: 3181 - RNA, 21 nt, Artificial Sequence
  Ebola virus siRNA sense strand
cucacggacaaugacagaaga

SEQ ID NO: 3182 - RNA, 21 nt, Artificial Sequence
  Ebola virus siRNA sense strand
ucacggacaaugacagaagaa

SEQ ID NO: 3183 - RNA, 21 nt, Artificial Sequence
  Ebola virus siRNA sense strand
cacggacaaugacagaagaaa

SEQ ID NO: 3184 - RNA, 21 nt, Artificial Sequence
  Ebola virus siRNA sense strand
acggacaaugacagaagaaau

SEQ ID NO: 3185 - RNA, 21 nt, Artificial Sequence
  Ebola virus siRNA sense strand
cggacaaugacagaagaaaug

SEQ ID NO: 3186 - RNA, 21 nt, Artificial Sequence
  Ebola virus siRNA sense strand
ggacaaugacagaagaaauga

SEQ ID NO: 3187 - RNA, 21 nt, Artificial Sequence
  Ebola virus siRNA sense strand
gacaaugacagaagaaaugaa

SEQ ID NO: 3188 - RNA, 21 nt, Artificial Sequence
  Ebola virus siRNA sense strand
acaaugacagaagaaaugaac

SEQ ID NO: 3189 - RNA, 21 nt, Artificial Sequence
  Ebola virus siRNA sense strand
caaugacagaagaaaugaacc

SEQ ID NO: 3190 - RNA, 21 nt, Artificial Sequence
  Ebola virus siRNA sense strand
aaugacagaagaaaugaaccc

SEQ ID NO: 3191 - RNA, 21 nt, Artificial Sequence
  Ebola virus siRNA sense strand
augacagaagaaaugaacccu

SEQ ID NO: 3192 - RNA, 21 nt, Artificial Sequence
  Ebola virus siRNA sense strand
ugacagaagaaaugaacccuc

SEQ ID NO: 3193 - RNA, 21 nt, Artificial Sequence
  Ebola virus siRNA sense strand
gacagaagaaaugaacccucc

SEQ ID NO: 3194 - RNA, 21 nt, Artificial Sequence
  Ebola virus siRNA sense strand
acagaagaaaugaacccuccg

SEQ ID NO: 3195 - RNA, 21 nt, Artificial Sequence
  Ebola virus siRNA sense strand
cagaagaaaugaacccuccgg

SEQ ID NO: 3196 - RNA, 21 nt, Artificial Sequence
  Ebola virus siRNA sense strand
agaagaaaugaacccuccggc

SEQ ID NO: 3197 - RNA, 21 nt, Artificial Sequence
  Ebola virus siRNA sense strand
gaagaaaugaacccuccggcu

SEQ ID NO: 3198 - RNA, 21 nt, Artificial Sequence
  Ebola virus siRNA sense strand
aagaaaugaacccuccggcuc

SEQ ID NO: 3199 - RNA, 21 nt, Artificial Sequence
  Ebola virus siRNA sense strand
agaaaugaacccuccggcuca

SEQ ID NO: 3200 - RNA, 21 nt, Artificial Sequence
  Ebola virus siRNA sense strand
gaaaugaacccuccggcucaa

SEQ ID NO: 3201 - RNA, 21 nt, Artificial Sequence
  Ebola virus siRNA sense strand
aaaugaacccuccggcucaac

SEQ ID NO: 3202 - RNA, 21 nt, Artificial Sequence
  Ebola virus siRNA sense strand
aaugaacccuccggcucaacc

SEQ ID NO: 3203 - RNA, 21 nt, Artificial Sequence
  Ebola virus siRNA sense strand
augaacccuccggcucaacca

SEQ ID NO: 3204 - RNA, 21 nt, Artificial Sequence
  Ebola virus siRNA sense strand
ugaacccuccggcucaaccag

SEQ ID NO: 3205 - RNA, 21 nt, Artificial Sequence
  Ebola virus siRNA sense strand
gaacccuccggcucaaccagc

SEQ ID NO: 3206 - RNA, 21 nt, Artificial Sequence
  Ebola virus siRNA sense strand
aacccuccggcucaaccagcc

SEQ ID NO: 3207 - RNA, 21 nt, Artificial Sequence
  Ebola virus siRNA sense strand
acccuccggcucaaccagccc

SEQ ID NO: 3208 - RNA, 21 nt, Artificial Sequence
  Ebola virus siRNA sense strand
cccuccggcucaaccagcccu

SEQ ID NO: 3209 - RNA, 21 nt, Artificial Sequence
  Ebola virus siRNA sense strand
ccuccggcucaaccagcccuc

SEQ ID NO: 3210 - RNA, 21 nt, Artificial Sequence
  Ebola virus siRNA sense strand
cuccggcucaaccagcccucg

SEQ ID NO: 3211 - RNA, 21 nt, Artificial Sequence
  Ebola virus siRNA sense strand
uccggcucaaccagcccucgc

SEQ ID NO: 3212 - RNA, 21 nt, Artificial Sequence
  Ebola virus siRNA sense strand
ccggcucaaccagcccucgca

SEQ ID NO: 3213 - RNA, 21 nt, Artificial Sequence
  Ebola virus siRNA sense strand
cggcucaaccagcccucgcau

SEQ ID NO: 3214 - RNA, 21 nt, Artificial Sequence
  Ebola virus siRNA sense strand
ggcucaaccagcccucgcaug

SEQ ID NO: 3215 - RNA, 21 nt, Artificial Sequence
  Ebola virus siRNA sense strand
gcucaaccagcccucgcaugc

SEQ ID NO: 3216 - RNA, 21 nt, Artificial Sequence
  Ebola virus siRNA sense strand
cucaaccagcccucgcaugcu

SEQ ID NO: 3217 - RNA, 21 nt, Artificial Sequence
  Ebola virus siRNA sense strand
ucaaccagcccucgcaugcug

SEQ ID NO: 3218 - RNA, 21 nt, Artificial Sequence
  Ebola virus siRNA sense strand
caaccagcccucgcaugcuga

SEQ ID NO: 3219 - RNA, 21 nt, Artificial Sequence
  Ebola virus siRNA sense strand
aaccagcccucgcaugcugac

SEQ ID NO: 3220 - RNA, 21 nt, Artificial Sequence
  Ebola virus siRNA sense strand
accagcccucgcaugcugaca

SEQ ID NO: 3221 - RNA, 21 nt, Artificial Sequence
  Ebola virus siRNA sense strand
ccagcccucgcaugcugacac

SEQ ID NO: 3222 - RNA, 21 nt, Artificial Sequence
  Ebola virus siRNA sense strand
cagcccucgcaugcugacacc

SEQ ID NO: 3223 - RNA, 21 nt, Artificial Sequence
  Ebola virus siRNA sense strand
agcccucgcaugcugacacca

SEQ ID NO: 3224 - RNA, 21 nt, Artificial Sequence
  Ebola virus siRNA sense strand
gcccucgcaugcugacaccaa

SEQ ID NO: 3225 - RNA, 21 nt, Artificial Sequence
  Ebola virus siRNA sense strand
cccucgcaugcugacaccaau

SEQ ID NO: 3226 - RNA, 21 nt, Artificial Sequence
  Ebola virus siRNA sense strand
ccucgcaugcugacaccaauu

SEQ ID NO: 3227 - RNA, 21 nt, Artificial Sequence
  Ebola virus siRNA sense strand
cucgcaugcugacaccaauua

SEQ ID NO: 3228 - RNA, 21 nt, Artificial Sequence
  Ebola virus siRNA sense strand
ucgcaugcugacaccaauuaa

SEQ ID NO: 3229 - RNA, 21 nt, Artificial Sequence
  Ebola virus siRNA sense strand
cgcaugcugacaccaauuaac

SEQ ID NO: 3230 - RNA, 21 nt, Artificial Sequence
  Ebola virus siRNA sense strand
gcaugcugacaccaauuaacg

SEQ ID NO: 3231 - RNA, 21 nt, Artificial Sequence
  Ebola virus siRNA sense strand
caugcugacaccaauuaacga

SEQ ID NO: 3232 - RNA, 21 nt, Artificial Sequence
  Ebola virus siRNA sense strand
augcugacaccaauuaacgaa

SEQ ID NO: 3233 - RNA, 21 nt, Artificial Sequence
  Ebola virus siRNA sense strand
ugcugacaccaauuaacgaag

SEQ ID NO: 3234 - RNA, 21 nt, Artificial Sequence
  Ebola virus siRNA sense strand
gcugacaccaauuaacgaaga

SEQ ID NO: 3235 - RNA, 21 nt, Artificial Sequence
  Ebola virus siRNA sense strand
cugacaccaauuaacgaagag

SEQ ID NO: 3236 - RNA, 21 nt, Artificial Sequence
  Ebola virus siRNA sense strand
ugacaccaauuaacgaagagg

SEQ ID NO: 3237 - RNA, 21 nt, Artificial Sequence
  Ebola virus siRNA sense strand
gacaccaauuaacgaagaggc

SEQ ID NO: 3238 - RNA, 21 nt, Artificial Sequence
  Ebola virus siRNA sense strand
acaccaauuaacgaagaggca

SEQ ID NO: 3239 - RNA, 21 nt, Artificial Sequence
  Ebola virus siRNA sense strand
caccaauuaacgaagaggcag

SEQ ID NO: 3240 - RNA, 21 nt, Artificial Sequence
  Ebola virus siRNA sense strand
accaauuaacgaagaggcaga

SEQ ID NO: 3241 - RNA, 21 nt, Artificial Sequence
  Ebola virus siRNA sense strand
ccaauuaacgaagaggcagac

SEQ ID NO: 3242 - RNA, 21 nt, Artificial Sequence
  Ebola virus siRNA sense strand
caauuaacgaagaggcagacc

SEQ ID NO: 3243 - RNA, 21 nt, Artificial Sequence
  Ebola virus siRNA sense strand
aauuaacgaagaggcagaccc

SEQ ID NO: 3244 - RNA, 21 nt, Artificial Sequence
  Ebola virus siRNA sense strand
auuaacgaagaggcagaccca

SEQ ID NO: 3245 - RNA, 21 nt, Artificial Sequence
  Ebola virus siRNA sense strand
uuaacgaagaggcagacccac

SEQ ID NO: 3246 - RNA, 21 nt, Artificial Sequence
  Ebola virus siRNA sense strand
uaacgaagaggcagacccacu

SEQ ID NO: 3247 - RNA, 21 nt, Artificial Sequence
  Ebola virus siRNA sense strand
aacgaagaggcagacccacug

SEQ ID NO: 3248 - RNA, 21 nt, Artificial Sequence
  Ebola virus siRNA sense strand
acgaagaggcagacccacugg

SEQ ID NO: 3249 - RNA, 21 nt, Artificial Sequence
  Ebola virus siRNA sense strand
cgaagaggcagacccacugga

SEQ ID NO: 3250 - RNA, 21 nt, Artificial Sequence
  Ebola virus siRNA sense strand
gaagaggcagacccacuggac

SEQ ID NO: 3251 - RNA, 21 nt, Artificial Sequence
  Ebola virus siRNA sense strand
aagaggcagacccacuggacg

SEQ ID NO: 3252 - RNA, 21 nt, Artificial Sequence
  Ebola virus siRNA sense strand
agaggcagacccacuggacga

SEQ ID NO: 3253 - RNA, 21 nt, Artificial Sequence
  Ebola virus siRNA sense strand
gaggcagacccacuggacgau

SEQ ID NO: 3254 - RNA, 21 nt, Artificial Sequence
  Ebola virus siRNA sense strand
aggcagacccacuggacgaug

SEQ ID NO: 3255 - RNA, 21 nt, Artificial Sequence
  Ebola virus siRNA sense strand
ggcagacccacuggacgaugc

SEQ ID NO: 3256 - RNA, 21 nt, Artificial Sequence
  Ebola virus siRNA sense strand
gcagacccacuggacgaugcc

SEQ ID NO: 3257 - RNA, 21 nt, Artificial Sequence
  Ebola virus siRNA sense strand
cagacccacuggacgaugccg

SEQ ID NO: 3258 - RNA, 21 nt, Artificial Sequence
  Ebola virus siRNA sense strand
agacccacuggacgaugccga

SEQ ID NO: 3259 - RNA, 21 nt, Artificial Sequence
  Ebola virus siRNA sense strand
gacccacuggacgaugccgac

SEQ ID NO: 3260 - RNA, 21 nt, Artificial Sequence
  Ebola virus siRNA sense strand
acccacuggacgaugccgacg

SEQ ID NO: 3261 - RNA, 21 nt, Artificial Sequence
  Ebola virus siRNA sense strand
cccacuggacgaugccgacga

SEQ ID NO: 3262 - RNA, 21 nt, Artificial Sequence
  Ebola virus siRNA sense strand
ccacuggacgaugccgacgac

SEQ ID NO: 3263 - RNA, 21 nt, Artificial Sequence
  Ebola virus siRNA sense strand
cacuggacgaugccgacgacg

SEQ ID NO: 3264 - RNA, 21 nt, Artificial Sequence
  Ebola virus siRNA sense strand
acuggacgaugccgacgacga

SEQ ID NO: 3265 - RNA, 21 nt, Artificial Sequence
  Ebola virus siRNA sense strand
cuggacgaugccgacgacgag

SEQ ID NO: 3266 - RNA, 21 nt, Artificial Sequence
  Ebola virus siRNA sense strand
uggacgaugccgacgacgaga

SEQ ID NO: 3267 - RNA, 21 nt, Artificial Sequence
  Ebola virus siRNA sense strand
ggacgaugccgacgacgagac

SEQ ID NO: 3268 - RNA, 21 nt, Artificial Sequence
  Ebola virus siRNA sense strand
gacgaugccgacgacgagacg

SEQ ID NO: 3269 - RNA, 21 nt, Artificial Sequence
  Ebola virus siRNA sense strand
acgaugccgacgacgagacgu

SEQ ID NO: 3270 - RNA, 21 nt, Artificial Sequence
  Ebola virus siRNA sense strand
cgaugccgacgacgagacguc

SEQ ID NO: 3271 - RNA, 21 nt, Artificial Sequence
  Ebola virus siRNA sense strand
gaugccgacgacgagacgucu

SEQ ID NO: 3272 - RNA, 21 nt, Artificial Sequence
  Ebola virus siRNA sense strand
augccgacgacgagacgucua

SEQ ID NO: 3273 - RNA, 21 nt, Artificial Sequence
  Ebola virus siRNA sense strand
ugccgacgacgagacgucuag

SEQ ID NO: 3274 - RNA, 21 nt, Artificial Sequence
  Ebola virus siRNA sense strand
gccgacgacgagacgucuagc

SEQ ID NO: 3275 - RNA, 21 nt, Artificial Sequence
  Ebola virus siRNA sense strand
ccgacgacgagacgucuagcc

SEQ ID NO: 3276 - RNA, 21 nt, Artificial Sequence
  Ebola virus siRNA sense strand
cgacgacgagacgucuagccu

SEQ ID NO: 3277 - RNA, 21 nt, Artificial Sequence
  Ebola virus siRNA sense strand
gacgacgagacgucuagccuu

SEQ ID NO: 3278 - RNA, 21 nt, Artificial Sequence
  Ebola virus siRNA sense strand
acgacgagacgucuagccuuc

SEQ ID NO: 3279 - RNA, 21 nt, Artificial Sequence
  Ebola virus siRNA sense strand
cgacgagacgucuagccuucc

SEQ ID NO: 3280 - RNA, 21 nt, Artificial Sequence
  Ebola virus siRNA sense strand
gacgagacgucuagccuuccg

SEQ ID NO: 3281 - RNA, 21 nt, Artificial Sequence
  Ebola virus siRNA sense strand
acgagacgucuagccuuccgc

SEQ ID NO: 3282 - RNA, 21 nt, Artificial Sequence
  Ebola virus siRNA sense strand
cgagacgucuagccuuccgcc

SEQ ID NO: 3283 - RNA, 21 nt, Artificial Sequence
  Ebola virus siRNA sense strand
gagacgucuagccuuccgccc

SEQ ID NO: 3284 - RNA, 21 nt, Artificial Sequence
  Ebola virus siRNA sense strand
agacgucuagccuuccgcccu

SEQ ID NO: 3285 - RNA, 21 nt, Artificial Sequence
  Ebola virus siRNA sense strand
gacgucuagccuuccgcccuu

SEQ ID NO: 3286 - RNA, 21 nt, Artificial Sequence
  Ebola virus siRNA sense strand
acgucuagccuuccgcccuug

SEQ ID NO: 3287 - RNA, 21 nt, Artificial Sequence
  Ebola virus siRNA sense strand
cgucuagccuuccgcccuugg

SEQ ID NO: 3288 - RNA, 21 nt, Artificial Sequence
  Ebola virus siRNA sense strand
gucuagccuuccgcccuugga

SEQ ID NO: 3289 - RNA, 21 nt, Artificial Sequence
  Ebola virus siRNA sense strand
ucuagccuuccgcccuuggag

SEQ ID NO: 3290 - RNA, 21 nt, Artificial Sequence
  Ebola virus siRNA sense strand
cuagccuuccgcccuuggagu

SEQ ID NO: 3291 - RNA, 21 nt, Artificial Sequence
  Ebola virus siRNA sense strand
uagccuuccgcccuuggaguc

SEQ ID NO: 3292 - RNA, 21 nt, Artificial Sequence
  Ebola virus siRNA sense strand
agccuuccgcccuuggaguca

SEQ ID NO: 3293 - RNA, 21 nt, Artificial Sequence
  Ebola virus siRNA sense strand
gccuuccgcccuuggagucag

SEQ ID NO: 3294 - RNA, 21 nt, Artificial Sequence
  Ebola virus siRNA sense strand
ccuuccgcccuuggagucaga

SEQ ID NO: 3295 - RNA, 21 nt, Artificial Sequence
  Ebola virus siRNA sense strand
cuuccgcccuuggagucagau

SEQ ID NO: 3296 - RNA, 21 nt, Artificial Sequence
  Ebola virus siRNA sense strand
uuccgcccuuggagucagaug

SEQ ID NO: 3297 - RNA, 21 nt, Artificial Sequence
  Ebola virus siRNA sense strand
uccgcccuuggagucagauga

SEQ ID NO: 3298 - RNA, 21 nt, Artificial Sequence
  Ebola virus siRNA sense strand
ccgcccuuggagucagaugau

SEQ ID NO: 3299 - RNA, 21 nt, Artificial Sequence
  Ebola virus siRNA sense strand
cgcccuuggagucagaugaug

SEQ ID NO: 3300 - RNA, 21 nt, Artificial Sequence
  Ebola virus siRNA sense strand
gcccuuggagucagaugauga

SEQ ID NO: 3301 - RNA, 21 nt, Artificial Sequence
  Ebola virus siRNA sense strand
cccuuggagucagaugaugaa

SEQ ID NO: 3302 - RNA, 21 nt, Artificial Sequence
  Ebola virus siRNA sense strand
ccuuggagucagaugaugaag

SEQ ID NO: 3303 - RNA, 21 nt, Artificial Sequence
  Ebola virus siRNA sense strand
cuuggagucagaugaugaaga

SEQ ID NO: 3304 - RNA, 21 nt, Artificial Sequence
  Ebola virus siRNA sense strand
uuggagucagaugaugaagag

SEQ ID NO: 3305 - RNA, 21 nt, Artificial Sequence
  Ebola virus siRNA sense strand
uggagucagaugaugaagagc

SEQ ID NO: 3306 - RNA, 21 nt, Artificial Sequence
  Ebola virus siRNA sense strand
ggagucagaugaugaagagca

SEQ ID NO: 3307 - RNA, 21 nt, Artificial Sequence
  Ebola virus siRNA sense strand
gagucagaugaugaagagcag

SEQ ID NO: 3308 - RNA, 21 nt, Artificial Sequence
  Ebola virus siRNA sense strand
agucagaugaugaagagcagg

SEQ ID NO: 3309 - RNA, 21 nt, Artificial Sequence
  Ebola virus siRNA sense strand
gucagaugaugaagagcagga

SEQ ID NO: 3310 - RNA, 21 nt, Artificial Sequence
  Ebola virus siRNA sense strand
ucagaugaugaagagcaggac

SEQ ID NO: 3311 - RNA, 21 nt, Artificial Sequence
  Ebola virus siRNA sense strand
cagaugaugaagagcaggaca

SEQ ID NO: 3312 - RNA, 21 nt, Artificial Sequence
  Ebola virus siRNA sense strand
agaugaugaagagcaggacag

SEQ ID NO: 3313 - RNA, 21 nt, Artificial Sequence
  Ebola virus siRNA sense strand
gaugaugaagagcaggacagg

SEQ ID NO: 3314 - RNA, 21 nt, Artificial Sequence
  Ebola virus siRNA sense strand
augaugaagagcaggacaggg

SEQ ID NO: 3315 - RNA, 21 nt, Artificial Sequence
  Ebola virus siRNA sense strand
ugaugaagagcaggacaggga

SEQ ID NO: 3316 - RNA, 21 nt, Artificial Sequence
  Ebola virus siRNA sense strand
gaugaagagcaggacagggac

SEQ ID NO: 3317 - RNA, 21 nt, Artificial Sequence
  Ebola virus siRNA sense strand
augaagagcaggacagggacg

SEQ ID NO: 3318 - RNA, 21 nt, Artificial Sequence
  Ebola virus siRNA sense strand
ugaagagcaggacagggacgg

SEQ ID NO: 3319 - RNA, 21 nt, Artificial Sequence
  Ebola virus siRNA sense strand
gaagagcaggacagggacgga

SEQ ID NO: 3320 - RNA, 21 nt, Artificial Sequence
  Ebola virus siRNA sense strand
aagagcaggacagggacggaa

SEQ ID NO: 3321 - RNA, 21 nt, Artificial Sequence
  Ebola virus siRNA sense strand
agagcaggacagggacggaac

SEQ ID NO: 3322 - RNA, 21 nt, Artificial Sequence
  Ebola virus siRNA sense strand
gagcaggacagggacggaacu

SEQ ID NO: 3323 - RNA, 21 nt, Artificial Sequence
  Ebola virus siRNA sense strand
agcaggacagggacggaacuu

SEQ ID NO: 3324 - RNA, 21 nt, Artificial Sequence
  Ebola virus siRNA sense strand
gcaggacagggacggaacuuc

SEQ ID NO: 3325 - RNA, 21 nt, Artificial Sequence
  Ebola virus siRNA sense strand
caggacagggacggaacuucc

SEQ ID NO: 3326 - RNA, 21 nt, Artificial Sequence
  Ebola virus siRNA sense strand
aggacagggacggaacuucca

SEQ ID NO: 3327 - RNA, 21 nt, Artificial Sequence
  Ebola virus siRNA sense strand
ggacagggacggaacuuccaa

SEQ ID NO: 3328 - RNA, 21 nt, Artificial Sequence
  Ebola virus siRNA sense strand
gacagggacggaacuuccaac

SEQ ID NO: 3329 - RNA, 21 nt, Artificial Sequence
  Ebola virus siRNA sense strand
acagggacggaacuuccaacc

SEQ ID NO: 3330 - RNA, 21 nt, Artificial Sequence
  Ebola virus siRNA sense strand
cagggacggaacuuccaaccg

SEQ ID NO: 3331 - RNA, 21 nt, Artificial Sequence
  Ebola virus siRNA sense strand
agggacggaacuuccaaccgc

SEQ ID NO: 3332 - RNA, 21 nt, Artificial Sequence
  Ebola virus siRNA sense strand
gggacggaacuuccaaccgca

SEQ ID NO: 3333 - RNA, 21 nt, Artificial Sequence
  Ebola virus siRNA sense strand
ggacggaacuuccaaccgcac

SEQ ID NO: 3334 - RNA, 21 nt, Artificial Sequence
  Ebola virus siRNA sense strand
gacggaacuuccaaccgcaca

SEQ ID NO: 3335 - RNA, 21 nt, Artificial Sequence
  Ebola virus siRNA sense strand
acggaacuuccaaccgcacac

SEQ ID NO: 3336 - RNA, 21 nt, Artificial Sequence
  Ebola virus siRNA sense strand
cggaacuuccaaccgcacacc

SEQ ID NO: 3337 - RNA, 21 nt, Artificial Sequence
  Ebola virus siRNA sense strand
ggaacuuccaaccgcacaccc

SEQ ID NO: 3338 - RNA, 21 nt, Artificial Sequence
  Ebola virus siRNA sense strand
gaacuuccaaccgcacaccca

SEQ ID NO: 3339 - RNA, 21 nt, Artificial Sequence
  Ebola virus siRNA sense strand
aacuuccaaccgcacacccac

SEQ ID NO: 3340 - RNA, 21 nt, Artificial Sequence
  Ebola virus siRNA sense strand
acuuccaaccgcacacccacu

SEQ ID NO: 3341 - RNA, 21 nt, Artificial Sequence
  Ebola virus siRNA sense strand
cuuccaaccgcacacccacug

SEQ ID NO: 3342 - RNA, 21 nt, Artificial Sequence
  Ebola virus siRNA sense strand
uuccaaccgcacacccacugu

SEQ ID NO: 3343 - RNA, 21 nt, Artificial Sequence
  Ebola virus siRNA sense strand
uccaaccgcacacccacuguc

SEQ ID NO: 3344 - RNA, 21 nt, Artificial Sequence
  Ebola virus siRNA sense strand
ccaaccgcacacccacugucg

SEQ ID NO: 3345 - RNA, 21 nt, Artificial Sequence
  Ebola virus siRNA sense strand
caaccgcacacccacugucgc

SEQ ID NO: 3346 - RNA, 21 nt, Artificial Sequence
  Ebola virus siRNA sense strand
aaccgcacacccacugucgcc

SEQ ID NO: 3347 - RNA, 21 nt, Artificial Sequence
  Ebola virus siRNA sense strand
accgcacacccacugucgccc

SEQ ID NO: 3348 - RNA, 21 nt, Artificial Sequence
  Ebola virus siRNA sense strand
ccgcacacccacugucgcccc

SEQ ID NO: 3349 - RNA, 21 nt, Artificial Sequence
  Ebola virus siRNA sense strand
cgcacacccacugucgcccca

SEQ ID NO: 3350 - RNA, 21 nt, Artificial Sequence
  Ebola virus siRNA sense strand
gcacacccacugucgccccac

SEQ ID NO: 3351 - RNA, 21 nt, Artificial Sequence
  Ebola virus siRNA sense strand
cacacccacugucgccccacc

SEQ ID NO: 3352 - RNA, 21 nt, Artificial Sequence
  Ebola virus siRNA sense strand
acacccacugucgccccaccg

SEQ ID NO: 3353 - RNA, 21 nt, Artificial Sequence
  Ebola virus siRNA sense strand
cacccacugucgccccaccgg

SEQ ID NO: 3354 - RNA, 21 nt, Artificial Sequence
  Ebola virus siRNA sense strand
acccacugucgccccaccggc

SEQ ID NO: 3355 - RNA, 21 nt, Artificial Sequence
  Ebola virus siRNA sense strand
cccacugucgccccaccggcu

SEQ ID NO: 3356 - RNA, 21 nt, Artificial Sequence
  Ebola virus siRNA sense strand
ccacugucgccccaccggcuc

SEQ ID NO: 3357 - RNA, 21 nt, Artificial Sequence
  Ebola virus siRNA sense strand
cacugucgccccaccggcucc

SEQ ID NO: 3358 - RNA, 21 nt, Artificial Sequence
  Ebola virus siRNA sense strand
acugucgccccaccggcuccc

SEQ ID NO: 3359 - RNA, 21 nt, Artificial Sequence
  Ebola virus siRNA sense strand
cugucgccccaccggcucccg

SEQ ID NO: 3360 - RNA, 21 nt, Artificial Sequence
  Ebola virus siRNA sense strand
ugucgccccaccggcucccgu

SEQ ID NO: 3361 - RNA, 21 nt, Artificial Sequence
  Ebola virus siRNA sense strand
gucgccccaccggcucccgua

SEQ ID NO: 3362 - RNA, 21 nt, Artificial Sequence
  Ebola virus siRNA sense strand
ucgccccaccggcucccguau

SEQ ID NO: 3363 - RNA, 21 nt, Artificial Sequence
  Ebola virus siRNA sense strand
cgccccaccggcucccguaua

SEQ ID NO: 3364 - RNA, 21 nt, Artificial Sequence
  Ebola virus siRNA sense strand
gccccaccggcucccguauac

SEQ ID NO: 3365 - RNA, 21 nt, Artificial Sequence
  Ebola virus siRNA sense strand
ccccaccggcucccguauaca

SEQ ID NO: 3366 - RNA, 21 nt, Artificial Sequence
  Ebola virus siRNA sense strand
cccaccggcucccguauacag

SEQ ID NO: 3367 - RNA, 21 nt, Artificial Sequence
  Ebola virus siRNA sense strand
ccaccggcucccguauacaga

SEQ ID NO: 3368 - RNA, 21 nt, Artificial Sequence
  Ebola virus siRNA sense strand
caccggcucccguauacagag

SEQ ID NO: 3369 - RNA, 21 nt, Artificial Sequence
  Ebola virus siRNA sense strand
accggcucccguauacagaga

SEQ ID NO: 3370 - RNA, 21 nt, Artificial Sequence
  Ebola virus siRNA sense strand
ccggcucccguauacagagau

SEQ ID NO: 3371 - RNA, 21 nt, Artificial Sequence
  Ebola virus siRNA sense strand
cggcucccguauacagagauc

SEQ ID NO: 3372 - RNA, 21 nt, Artificial Sequence
  Ebola virus siRNA sense strand
ggcucccguauacagagauca

SEQ ID NO: 3373 - RNA, 21 nt, Artificial Sequence
  Ebola virus siRNA sense strand
gcucccguauacagagaucac

SEQ ID NO: 3374 - RNA, 21 nt, Artificial Sequence
  Ebola virus siRNA sense strand
cucccguauacagagaucacu

SEQ ID NO: 3375 - RNA, 21 nt, Artificial Sequence
  Ebola virus siRNA sense strand
ucccguauacagagaucacuc

SEQ ID NO: 3376 - RNA, 21 nt, Artificial Sequence
  Ebola virus siRNA sense strand
cccguauacagagaucacucu

SEQ ID NO: 3377 - RNA, 21 nt, Artificial Sequence
  Ebola virus siRNA sense strand
ccguauacagagaucacucug

SEQ ID NO: 3378 - RNA, 21 nt, Artificial Sequence
  Ebola virus siRNA sense strand
cguauacagagaucacucuga

SEQ ID NO: 3379 - RNA, 21 nt, Artificial Sequence
  Ebola virus siRNA sense strand
guauacagagaucacucugaa

SEQ ID NO: 3380 - RNA, 21 nt, Artificial Sequence
  Ebola virus siRNA sense strand
uauacagagaucacucugaaa

SEQ ID NO: 3381 - RNA, 21 nt, Artificial Sequence
  Ebola virus siRNA sense strand
auacagagaucacucugaaaa

SEQ ID NO: 3382 - RNA, 21 nt, Artificial Sequence
  Ebola virus siRNA sense strand
uacagagaucacucugaaaag

SEQ ID NO: 3383 - RNA, 21 nt, Artificial Sequence
  Ebola virus siRNA sense strand
acagagaucacucugaaaaga

SEQ ID NO: 3384 - RNA, 21 nt, Artificial Sequence
  Ebola virus siRNA sense strand
cagagaucacucugaaaagaa

SEQ ID NO: 3385 - RNA, 21 nt, Artificial Sequence
  Ebola virus siRNA sense strand
agagaucacucugaaaagaaa

SEQ ID NO: 3386 - RNA, 21 nt, Artificial Sequence
  Ebola virus siRNA sense strand
gagaucacucugaaaagaaag

SEQ ID NO: 3387 - RNA, 21 nt, Artificial Sequence
  Ebola virus siRNA sense strand
agaucacucugaaaagaaaga

SEQ ID NO: 3388 - RNA, 21 nt, Artificial Sequence
  Ebola virus siRNA sense strand
gaucacucugaaaagaaagaa

SEQ ID NO: 3389 - RNA, 21 nt, Artificial Sequence
  Ebola virus siRNA sense strand
aucacucugaaaagaaagaac

SEQ ID NO: 3390 - RNA, 21 nt, Artificial Sequence
  Ebola virus siRNA sense strand
ucacucugaaaagaaagaacu

SEQ ID NO: 3391 - RNA, 21 nt, Artificial Sequence
  Ebola virus siRNA sense strand
cacucugaaaagaaagaacuc

SEQ ID NO: 3392 - RNA, 21 nt, Artificial Sequence
  Ebola virus siRNA sense strand
acucugaaaagaaagaacucc

SEQ ID NO: 3393 - RNA, 21 nt, Artificial Sequence
  Ebola virus siRNA sense strand
cucugaaaagaaagaacuccc

SEQ ID NO: 3394 - RNA, 21 nt, Artificial Sequence
  Ebola virus siRNA sense strand
ucugaaaagaaagaacucccg

SEQ ID NO: 3395 - RNA, 21 nt, Artificial Sequence
  Ebola virus siRNA sense strand
cugaaaagaaagaacucccgc

SEQ ID NO: 3396 - RNA, 21 nt, Artificial Sequence
  Ebola virus siRNA sense strand
ugaaaagaaagaacucccgca

SEQ ID NO: 3397 - RNA, 21 nt, Artificial Sequence
  Ebola virus siRNA sense strand
gaaaagaaagaacucccgcaa

SEQ ID NO: 3398 - RNA, 21 nt, Artificial Sequence
  Ebola virus siRNA sense strand
aaaagaaagaacucccgcaag

SEQ ID NO: 3399 - RNA, 21 nt, Artificial Sequence
  Ebola virus siRNA sense strand
aaagaaagaacucccgcaaga

SEQ ID NO: 3400 - RNA, 21 nt, Artificial Sequence
  Ebola virus siRNA sense strand
aagaaagaacucccgcaagac

SEQ ID NO: 3401 - RNA, 21 nt, Artificial Sequence
  Ebola virus siRNA sense strand
agaaagaacucccgcaagacg

SEQ ID NO: 3402 - RNA, 21 nt, Artificial Sequence
  Ebola virus siRNA sense strand
gaaagaacucccgcaagacga

SEQ ID NO: 3403 - RNA, 21 nt, Artificial Sequence
  Ebola virus siRNA sense strand
aaagaacucccgcaagacgag

SEQ ID NO: 3404 - RNA, 21 nt, Artificial Sequence
  Ebola virus siRNA sense strand
aagaacucccgcaagacgagc

SEQ ID NO: 3405 - RNA, 21 nt, Artificial Sequence
  Ebola virus siRNA sense strand
agaacucccgcaagacgagca

SEQ ID NO: 3406 - RNA, 21 nt, Artificial Sequence
  Ebola virus siRNA sense strand
gaacucccgcaagacgagcaa

SEQ ID NO: 3407 - RNA, 21 nt, Artificial Sequence
  Ebola virus siRNA sense strand
aacucccgcaagacgagcaac

SEQ ID NO: 3408 - RNA, 21 nt, Artificial Sequence
  Ebola virus siRNA sense strand
acucccgcaagacgagcaaca

SEQ ID NO: 3409 - RNA, 21 nt, Artificial Sequence
  Ebola virus siRNA sense strand
cucccgcaagacgagcaacaa

SEQ ID NO: 3410 - RNA, 21 nt, Artificial Sequence
  Ebola virus siRNA sense strand
ucccgcaagacgagcaacaag

SEQ ID NO: 3411 - RNA, 21 nt, Artificial Sequence
  Ebola virus siRNA sense strand
cccgcaagacgagcaacaaga

SEQ ID NO: 3412 - RNA, 21 nt, Artificial Sequence
  Ebola virus siRNA sense strand
ccgcaagacgagcaacaagau

SEQ ID NO: 3413 - RNA, 21 nt, Artificial Sequence
  Ebola virus siRNA sense strand
cgcaagacgagcaacaagauc

SEQ ID NO: 3414 - RNA, 21 nt, Artificial Sequence
  Ebola virus siRNA sense strand
gcaagacgagcaacaagauca

SEQ ID NO: 3415 - RNA, 21 nt, Artificial Sequence
  Ebola virus siRNA sense strand
caagacgagcaacaagaucag

SEQ ID NO: 3416 - RNA, 21 nt, Artificial Sequence
  Ebola virus siRNA sense strand
aagacgagcaacaagaucagg

SEQ ID NO: 3417 - RNA, 21 nt, Artificial Sequence
  Ebola virus siRNA sense strand
agacgagcaacaagaucagga

SEQ ID NO: 3418 - RNA, 21 nt, Artificial Sequence
  Ebola virus siRNA sense strand
gacgagcaacaagaucaggac

SEQ ID NO: 3419 - RNA, 21 nt, Artificial Sequence
  Ebola virus siRNA sense strand
acgagcaacaagaucaggacc

SEQ ID NO: 3420 - RNA, 21 nt, Artificial Sequence
  Ebola virus siRNA sense strand
cgagcaacaagaucaggacca

SEQ ID NO: 3421 - RNA, 21 nt, Artificial Sequence
  Ebola virus siRNA sense strand
gagcaacaagaucaggaccac

SEQ ID NO: 3422 - RNA, 21 nt, Artificial Sequence
  Ebola virus siRNA sense strand
agcaacaagaucaggaccaca

SEQ ID NO: 3423 - RNA, 21 nt, Artificial Sequence
  Ebola virus siRNA sense strand
gcaacaagaucaggaccacac

SEQ ID NO: 3424 - RNA, 21 nt, Artificial Sequence
  Ebola virus siRNA sense strand
caacaagaucaggaccacacu

SEQ ID NO: 3425 - RNA, 21 nt, Artificial Sequence
  Ebola virus siRNA sense strand
aacaagaucaggaccacacuc

SEQ ID NO: 3426 - RNA, 21 nt, Artificial Sequence
  Ebola virus siRNA sense strand
acaagaucaggaccacacuca

SEQ ID NO: 3427 - RNA, 21 nt, Artificial Sequence
  Ebola virus siRNA sense strand
caagaucaggaccacacucaa

SEQ ID NO: 3428 - RNA, 21 nt, Artificial Sequence
  Ebola virus siRNA sense strand
aagaucaggaccacacucaag

SEQ ID NO: 3429 - RNA, 21 nt, Artificial Sequence
  Ebola virus siRNA sense strand
agaucaggaccacacucaaga

SEQ ID NO: 3430 - RNA, 21 nt, Artificial Sequence
  Ebola virus siRNA sense strand
gaucaggaccacacucaagag

SEQ ID NO: 3431 - RNA, 21 nt, Artificial Sequence
  Ebola virus siRNA sense strand
aucaggaccacacucaagagg

SEQ ID NO: 3432 - RNA, 21 nt, Artificial Sequence
  Ebola virus siRNA sense strand
ucaggaccacacucaagaggc

SEQ ID NO: 3433 - RNA, 21 nt, Artificial Sequence
  Ebola virus siRNA sense strand
caggaccacacucaagaggcc

SEQ ID NO: 3434 - RNA, 21 nt, Artificial Sequence
  Ebola virus siRNA sense strand
aggaccacacucaagaggcca

SEQ ID NO: 3435 - RNA, 21 nt, Artificial Sequence
  Ebola virus siRNA sense strand
ggaccacacucaagaggccag

SEQ ID NO: 3436 - RNA, 21 nt, Artificial Sequence
  Ebola virus siRNA sense strand
gaccacacucaagaggccagg

SEQ ID NO: 3437 - RNA, 21 nt, Artificial Sequence
  Ebola virus siRNA sense strand
accacacucaagaggccagga

SEQ ID NO: 3438 - RNA, 21 nt, Artificial Sequence
  Ebola virus siRNA sense strand
ccacacucaagaggccaggaa

SEQ ID NO: 3439 - RNA, 21 nt, Artificial Sequence
  Ebola virus siRNA sense strand
cacacucaagaggccaggaac

SEQ ID NO: 3440 - RNA, 21 nt, Artificial Sequence
  Ebola virus siRNA sense strand
acacucaagaggccaggaacc

SEQ ID NO: 3441 - RNA, 21 nt, Artificial Sequence
  Ebola virus siRNA sense strand
cacucaagaggccaggaacca

SEQ ID NO: 3442 - RNA, 21 nt, Artificial Sequence
  Ebola virus siRNA sense strand
acucaagaggccaggaaccag

SEQ ID NO: 3443 - RNA, 21 nt, Artificial Sequence
  Ebola virus siRNA sense strand
cucaagaggccaggaaccagg

SEQ ID NO: 3444 - RNA, 21 nt, Artificial Sequence
  Ebola virus siRNA sense strand
ucaagaggccaggaaccagga

SEQ ID NO: 3445 - RNA, 21 nt, Artificial Sequence
  Ebola virus siRNA sense strand
caagaggccaggaaccaggac

SEQ ID NO: 3446 - RNA, 21 nt, Artificial Sequence
  Ebola virus siRNA sense strand
aagaggccaggaaccaggaca

SEQ ID NO: 3447 - RNA, 21 nt, Artificial Sequence
  Ebola virus siRNA sense strand
agaggccaggaaccaggacag

SEQ ID NO: 3448 - RNA, 21 nt, Artificial Sequence
  Ebola virus siRNA sense strand
gaggccaggaaccaggacagu

SEQ ID NO: 3449 - RNA, 21 nt, Artificial Sequence
  Ebola virus siRNA sense strand
aggccaggaaccaggacagug

SEQ ID NO: 3450 - RNA, 21 nt, Artificial Sequence
  Ebola virus siRNA sense strand
ggccaggaaccaggacaguga

SEQ ID NO: 3451 - RNA, 21 nt, Artificial Sequence
  Ebola virus siRNA sense strand
gccaggaaccaggacagugac

SEQ ID NO: 3452 - RNA, 21 nt, Artificial Sequence
  Ebola virus siRNA sense strand
ccaggaaccaggacagugaca

SEQ ID NO: 3453 - RNA, 21 nt, Artificial Sequence
  Ebola virus siRNA sense strand
caggaaccaggacagugacaa

SEQ ID NO: 3454 - RNA, 21 nt, Artificial Sequence
  Ebola virus siRNA sense strand
aggaaccaggacagugacaac

SEQ ID NO: 3455 - RNA, 21 nt, Artificial Sequence
  Ebola virus siRNA sense strand
ggaaccaggacagugacaaca

SEQ ID NO: 3456 - RNA, 21 nt, Artificial Sequence
  Ebola virus siRNA sense strand
gaaccaggacagugacaacac

SEQ ID NO: 3457 - RNA, 21 nt, Artificial Sequence
  Ebola virus siRNA sense strand
aaccaggacagugacaacacc

SEQ ID NO: 3458 - RNA, 21 nt, Artificial Sequence
  Ebola virus siRNA sense strand
accaggacagugacaacaccc

SEQ ID NO: 3459 - RNA, 21 nt, Artificial Sequence
  Ebola virus siRNA sense strand
ccaggacagugacaacaccca

SEQ ID NO: 3460 - RNA, 21 nt, Artificial Sequence
  Ebola virus siRNA sense strand
caggacagugacaacacccag

SEQ ID NO: 3461 - RNA, 21 nt, Artificial Sequence
  Ebola virus siRNA sense strand
aggacagugacaacacccagu

SEQ ID NO: 3462 - RNA, 21 nt, Artificial Sequence
  Ebola virus siRNA sense strand
ggacagugacaacacccaguc

SEQ ID NO: 3463 - RNA, 21 nt, Artificial Sequence
  Ebola virus siRNA sense strand
gacagugacaacacccaguca

SEQ ID NO: 3464 - RNA, 21 nt, Artificial Sequence
  Ebola virus siRNA sense strand
acagugacaacacccagucag

SEQ ID NO: 3465 - RNA, 21 nt, Artificial Sequence
  Ebola virus siRNA sense strand
cagugacaacacccagucaga

SEQ ID NO: 3466 - RNA, 21 nt, Artificial Sequence
  Ebola virus siRNA sense strand
agugacaacacccagucagaa

SEQ ID NO: 3467 - RNA, 21 nt, Artificial Sequence
  Ebola virus siRNA sense strand
gugacaacacccagucagaac

SEQ ID NO: 3468 - RNA, 21 nt, Artificial Sequence
  Ebola virus siRNA sense strand
ugacaacacccagucagaaca

SEQ ID NO: 3469 - RNA, 21 nt, Artificial Sequence
  Ebola virus siRNA sense strand
gacaacacccagucagaacac

SEQ ID NO: 3470 - RNA, 21 nt, Artificial Sequence
  Ebola virus siRNA sense strand
acaacacccagucagaacacu

SEQ ID NO: 3471 - RNA, 21 nt, Artificial Sequence
  Ebola virus siRNA sense strand
caacacccagucagaacacuc

SEQ ID NO: 3472 - RNA, 21 nt, Artificial Sequence
  Ebola virus siRNA sense strand
aacacccagucagaacacucu

SEQ ID NO: 3473 - RNA, 21 nt, Artificial Sequence
  Ebola virus siRNA sense strand
acacccagucagaacacucuu

SEQ ID NO: 3474 - RNA, 21 nt, Artificial Sequence
  Ebola virus siRNA sense strand
cacccagucagaacacucuuu

SEQ ID NO: 3475 - RNA, 21 nt, Artificial Sequence
  Ebola virus siRNA sense strand
acccagucagaacacucuuuu

SEQ ID NO: 3476 - RNA, 21 nt, Artificial Sequence
  Ebola virus siRNA sense strand
cccagucagaacacucuuuug

SEQ ID NO: 3477 - RNA, 21 nt, Artificial Sequence
  Ebola virus siRNA sense strand
ccagucagaacacucuuuuga

SEQ ID NO: 3478 - RNA, 21 nt, Artificial Sequence
  Ebola virus siRNA sense strand
cagucagaacacucuuuugag

SEQ ID NO: 3479 - RNA, 21 nt, Artificial Sequence
  Ebola virus siRNA sense strand
agucagaacacucuuuugagg

SEQ ID NO: 3480 - RNA, 21 nt, Artificial Sequence
  Ebola virus siRNA sense strand
gucagaacacucuuuugagga

SEQ ID NO: 3481 - RNA, 21 nt, Artificial Sequence
  Ebola virus siRNA sense strand
ucagaacacucuuuugaggag

SEQ ID NO: 3482 - RNA, 21 nt, Artificial Sequence
  Ebola virus siRNA sense strand
cagaacacucuuuugaggaga

SEQ ID NO: 3483 - RNA, 21 nt, Artificial Sequence
  Ebola virus siRNA sense strand
agaacacucuuuugaggagau

SEQ ID NO: 3484 - RNA, 21 nt, Artificial Sequence
  Ebola virus siRNA sense strand
gaacacucuuuugaggagaug

SEQ ID NO: 3485 - RNA, 21 nt, Artificial Sequence
  Ebola virus siRNA sense strand
aacacucuuuugaggagaugu

SEQ ID NO: 3486 - RNA, 21 nt, Artificial Sequence
  Ebola virus siRNA sense strand
acacucuuuugaggagaugua

SEQ ID NO: 3487 - RNA, 21 nt, Artificial Sequence
  Ebola virus siRNA sense strand
cacucuuuugaggagauguau

SEQ ID NO: 3488 - RNA, 21 nt, Artificial Sequence
  Ebola virus siRNA sense strand
acucuuuugaggagauguauc

SEQ ID NO: 3489 - RNA, 21 nt, Artificial Sequence
  Ebola virus siRNA sense strand
cucuuuugaggagauguaucg

SEQ ID NO: 3490 - RNA, 21 nt, Artificial Sequence
  Ebola virus siRNA sense strand
ucuuuugaggagauguaucgc

SEQ ID NO: 3491 - RNA, 21 nt, Artificial Sequence
  Ebola virus siRNA sense strand
cuuuugaggagauguaucgcc

SEQ ID NO: 3492 - RNA, 21 nt, Artificial Sequence
  Ebola virus siRNA sense strand
uuuugaggagauguaucgcca

SEQ ID NO: 3493 - RNA, 21 nt, Artificial Sequence
  Ebola virus siRNA sense strand
uuugaggagauguaucgccac

SEQ ID NO: 3494 - RNA, 21 nt, Artificial Sequence
  Ebola virus siRNA sense strand
uugaggagauguaucgccaca

SEQ ID NO: 3495 - RNA, 21 nt, Artificial Sequence
  Ebola virus siRNA sense strand
ugaggagauguaucgccacau

SEQ ID NO: 3496 - RNA, 21 nt, Artificial Sequence
  Ebola virus siRNA sense strand
gaggagauguaucgccacauu

SEQ ID NO: 3497 - RNA, 21 nt, Artificial Sequence
  Ebola virus siRNA sense strand
aggagauguaucgccacauuc

SEQ ID NO: 3498 - RNA, 21 nt, Artificial Sequence
  Ebola virus siRNA sense strand
ggagauguaucgccacauucu

SEQ ID NO: 3499 - RNA, 21 nt, Artificial Sequence
  Ebola virus siRNA sense strand
gagauguaucgccacauucua

SEQ ID NO: 3500 - RNA, 21 nt, Artificial Sequence
  Ebola virus siRNA sense strand
agauguaucgccacauucuaa

SEQ ID NO: 3501 - RNA, 21 nt, Artificial Sequence
  Ebola virus siRNA sense strand
gauguaucgccacauucuaag

SEQ ID NO: 3502 - RNA, 21 nt, Artificial Sequence
  Ebola virus siRNA sense strand
auguaucgccacauucuaaga

SEQ ID NO: 3503 - RNA, 21 nt, Artificial Sequence
  Ebola virus siRNA sense strand
uguaucgccacauucuaagau

SEQ ID NO: 3504 - RNA, 21 nt, Artificial Sequence
  Ebola virus siRNA sense strand
guaucgccacauucuaagauc

SEQ ID NO: 3505 - RNA, 21 nt, Artificial Sequence
  Ebola virus siRNA sense strand
uaucgccacauucuaagauca

SEQ ID NO: 3506 - RNA, 21 nt, Artificial Sequence
  Ebola virus siRNA sense strand
aucgccacauucuaagaucac

SEQ ID NO: 3507 - RNA, 21 nt, Artificial Sequence
  Ebola virus siRNA sense strand
ucgccacauucuaagaucaca

SEQ ID NO: 3508 - RNA, 21 nt, Artificial Sequence
  Ebola virus siRNA sense strand
cgccacauucuaagaucacag

SEQ ID NO: 3509 - RNA, 21 nt, Artificial Sequence
  Ebola virus siRNA sense strand
gccacauucuaagaucacagg

SEQ ID NO: 3510 - RNA, 21 nt, Artificial Sequence
  Ebola virus siRNA sense strand
ccacauucuaagaucacaggg

SEQ ID NO: 3511 - RNA, 21 nt, Artificial Sequence
  Ebola virus siRNA sense strand
cacauucuaagaucacagggg

SEQ ID NO: 3512 - RNA, 21 nt, Artificial Sequence
  Ebola virus siRNA sense strand
acauucuaagaucacaggggc

SEQ ID NO: 3513 - RNA, 21 nt, Artificial Sequence
  Ebola virus siRNA sense strand
cauucuaagaucacaggggcc

SEQ ID NO: 3514 - RNA, 21 nt, Artificial Sequence
  Ebola virus siRNA sense strand
auucuaagaucacaggggcca

SEQ ID NO: 3515 - RNA, 21 nt, Artificial Sequence
  Ebola virus siRNA sense strand
uucuaagaucacaggggccau

SEQ ID NO: 3516 - RNA, 21 nt, Artificial Sequence
  Ebola virus siRNA sense strand
ucuaagaucacaggggccauu

SEQ ID NO: 3517 - RNA, 21 nt, Artificial Sequence
  Ebola virus siRNA sense strand
cuaagaucacaggggccauuu

SEQ ID NO: 3518 - RNA, 21 nt, Artificial Sequence
  Ebola virus siRNA sense strand
uaagaucacaggggccauuug

SEQ ID NO: 3519 - RNA, 21 nt, Artificial Sequence
  Ebola virus siRNA sense strand
aagaucacaggggccauuuga

SEQ ID NO: 3520 - RNA, 21 nt, Artificial Sequence
  Ebola virus siRNA sense strand
agaucacaggggccauuugau

SEQ ID NO: 3521 - RNA, 21 nt, Artificial Sequence
  Ebola virus siRNA sense strand
gaucacaggggccauuugaug

SEQ ID NO: 3522 - RNA, 21 nt, Artificial Sequence
  Ebola virus siRNA sense strand
aucacaggggccauuugaugc

SEQ ID NO: 3523 - RNA, 21 nt, Artificial Sequence
  Ebola virus siRNA sense strand
ucacaggggccauuugaugcu

SEQ ID NO: 3524 - RNA, 21 nt, Artificial Sequence
  Ebola virus siRNA sense strand
cacaggggccauuugaugcug

SEQ ID NO: 3525 - RNA, 21 nt, Artificial Sequence
  Ebola virus siRNA sense strand
acaggggccauuugaugcugu

SEQ ID NO: 3526 - RNA, 21 nt, Artificial Sequence
  Ebola virus siRNA sense strand
caggggccauuugaugcuguu

SEQ ID NO: 3527 - RNA, 21 nt, Artificial Sequence
  Ebola virus siRNA sense strand
aggggccauuugaugcuguuu

SEQ ID NO: 3528 - RNA, 21 nt, Artificial Sequence
  Ebola virus siRNA sense strand
ggggccauuugaugcuguuuu

SEQ ID NO: 3529 - RNA, 21 nt, Artificial Sequence
  Ebola virus siRNA sense strand
gggccauuugaugcuguuuug

SEQ ID NO: 3530 - RNA, 21 nt, Artificial Sequence
  Ebola virus siRNA sense strand
ggccauuugaugcuguuuugu

SEQ ID NO: 3531 - RNA, 21 nt, Artificial Sequence
  Ebola virus siRNA sense strand
gccauuugaugcuguuuugua

SEQ ID NO: 3532 - RNA, 21 nt, Artificial Sequence
  Ebola virus siRNA sense strand
ccauuugaugcuguuuuguau

SEQ ID NO: 3533 - RNA, 21 nt, Artificial Sequence
  Ebola virus siRNA sense strand
cauuugaugcuguuuuguauu

SEQ ID NO: 3534 - RNA, 21 nt, Artificial Sequence
  Ebola virus siRNA sense strand
auuugaugcuguuuuguauua

SEQ ID NO: 3535 - RNA, 21 nt, Artificial Sequence
  Ebola virus siRNA sense strand
uuugaugcuguuuuguauuau

SEQ ID NO: 3536 - RNA, 21 nt, Artificial Sequence
  Ebola virus siRNA sense strand
uugaugcuguuuuguauuauc

SEQ ID NO: 3537 - RNA, 21 nt, Artificial Sequence
  Ebola virus siRNA sense strand
ugaugcuguuuuguauuauca

SEQ ID NO: 3538 - RNA, 21 nt, Artificial Sequence
  Ebola virus siRNA sense strand
gaugcuguuuuguauuaucau

SEQ ID NO: 3539 - RNA, 21 nt, Artificial Sequence
  Ebola virus siRNA sense strand
augcuguuuuguauuaucaua

SEQ ID NO: 3540 - RNA, 21 nt, Artificial Sequence
  Ebola virus siRNA sense strand
ugcuguuuuguauuaucauau

SEQ ID NO: 3541 - RNA, 21 nt, Artificial Sequence
  Ebola virus siRNA sense strand
gcuguuuuguauuaucauaug

SEQ ID NO: 3542 - RNA, 21 nt, Artificial Sequence
  Ebola virus siRNA sense strand
cuguuuuguauuaucauauga

SEQ ID NO: 3543 - RNA, 21 nt, Artificial Sequence
  Ebola virus siRNA sense strand
uguuuuguauuaucauaugau

SEQ ID NO: 3544 - RNA, 21 nt, Artificial Sequence
  Ebola virus siRNA sense strand
guuuuguauuaucauaugaug

SEQ ID NO: 3545 - RNA, 21 nt, Artificial Sequence
  Ebola virus siRNA sense strand
uuuuguauuaucauaugauga

SEQ ID NO: 3546 - RNA, 21 nt, Artificial Sequence
  Ebola virus siRNA sense strand
uuuguauuaucauaugaugaa

SEQ ID NO: 3547 - RNA, 21 nt, Artificial Sequence
  Ebola virus siRNA sense strand
uuguauuaucauaugaugaag

SEQ ID NO: 3548 - RNA, 21 nt, Artificial Sequence
  Ebola virus siRNA sense strand
uguauuaucauaugaugaagg

SEQ ID NO: 3549 - RNA, 21 nt, Artificial Sequence
  Ebola virus siRNA sense strand
guauuaucauaugaugaagga

SEQ ID NO: 3550 - RNA, 21 nt, Artificial Sequence
  Ebola virus siRNA sense strand
uauuaucauaugaugaaggau

SEQ ID NO: 3551 - RNA, 21 nt, Artificial Sequence
  Ebola virus siRNA sense strand
auuaucauaugaugaaggaug

SEQ ID NO: 3552 - RNA, 21 nt, Artificial Sequence
  Ebola virus siRNA sense strand
uuaucauaugaugaaggauga

SEQ ID NO: 3553 - RNA, 21 nt, Artificial Sequence
  Ebola virus siRNA sense strand
uaucauaugaugaaggaugag

SEQ ID NO: 3554 - RNA, 21 nt, Artificial Sequence
  Ebola virus siRNA sense strand
aucauaugaugaaggaugagc

SEQ ID NO: 3555 - RNA, 21 nt, Artificial Sequence
  Ebola virus siRNA sense strand
ucauaugaugaaggaugagcc

SEQ ID NO: 3556 - RNA, 21 nt, Artificial Sequence
  Ebola virus siRNA sense strand
cauaugaugaaggaugagccu

SEQ ID NO: 3557 - RNA, 21 nt, Artificial Sequence
  Ebola virus siRNA sense strand
auaugaugaaggaugagccug

SEQ ID NO: 3558 - RNA, 21 nt, Artificial Sequence
  Ebola virus siRNA sense strand
uaugaugaaggaugagccugu

SEQ ID NO: 3559 - RNA, 21 nt, Artificial Sequence
  Ebola virus siRNA sense strand
augaugaaggaugagccugua

SEQ ID NO: 3560 - RNA, 21 nt, Artificial Sequence
  Ebola virus siRNA sense strand
ugaugaaggaugagccuguag

SEQ ID NO: 3561 - RNA, 21 nt, Artificial Sequence
  Ebola virus siRNA sense strand
gaugaaggaugagccuguagu

SEQ ID NO: 3562 - RNA, 21 nt, Artificial Sequence
  Ebola virus siRNA sense strand
augaaggaugagccuguaguu

SEQ ID NO: 3563 - RNA, 21 nt, Artificial Sequence
  Ebola virus siRNA sense strand
ugaaggaugagccuguaguuu

SEQ ID NO: 3564 - RNA, 21 nt, Artificial Sequence
  Ebola virus siRNA sense strand
gaaggaugagccuguaguuuu

SEQ ID NO: 3565 - RNA, 21 nt, Artificial Sequence
  Ebola virus siRNA sense strand
aaggaugagccuguaguuuuc

SEQ ID NO: 3566 - RNA, 21 nt, Artificial Sequence
  Ebola virus siRNA sense strand
aggaugagccuguaguuuuca

SEQ ID NO: 3567 - RNA, 21 nt, Artificial Sequence
  Ebola virus siRNA sense strand
ggaugagccuguaguuuucag

SEQ ID NO: 3568 - RNA, 21 nt, Artificial Sequence
  Ebola virus siRNA sense strand
gaugagccuguaguuuucagu

SEQ ID NO: 3569 - RNA, 21 nt, Artificial Sequence
  Ebola virus siRNA sense strand
augagccuguaguuuucagua

SEQ ID NO: 3570 - RNA, 21 nt, Artificial Sequence
  Ebola virus siRNA sense strand
ugagccuguaguuuucaguac

SEQ ID NO: 3571 - RNA, 21 nt, Artificial Sequence
  Ebola virus siRNA sense strand
gagccuguaguuuucaguacc

SEQ ID NO: 3572 - RNA, 21 nt, Artificial Sequence
  Ebola virus siRNA sense strand
agccuguaguuuucaguacca

SEQ ID NO: 3573 - RNA, 21 nt, Artificial Sequence
  Ebola virus siRNA sense strand
gccuguaguuuucaguaccag

SEQ ID NO: 3574 - RNA, 21 nt, Artificial Sequence
  Ebola virus siRNA sense strand
ccuguaguuuucaguaccagu

SEQ ID NO: 3575 - RNA, 21 nt, Artificial Sequence
  Ebola virus siRNA sense strand
cuguaguuuucaguaccagug

SEQ ID NO: 3576 - RNA, 21 nt, Artificial Sequence
  Ebola virus siRNA sense strand
uguaguuuucaguaccaguga

SEQ ID NO: 3577 - RNA, 21 nt, Artificial Sequence
  Ebola virus siRNA sense strand
guaguuuucaguaccagugau

SEQ ID NO: 3578 - RNA, 21 nt, Artificial Sequence
  Ebola virus siRNA sense strand
uaguuuucaguaccagugaug

SEQ ID NO: 3579 - RNA, 21 nt, Artificial Sequence
  Ebola virus siRNA sense strand
aguuuucaguaccagugaugg

SEQ ID NO: 3580 - RNA, 21 nt, Artificial Sequence
  Ebola virus siRNA sense strand
guuuucaguaccagugauggc

SEQ ID NO: 3581 - RNA, 21 nt, Artificial Sequence
  Ebola virus siRNA sense strand
uuuucaguaccagugauggca

SEQ ID NO: 3582 - RNA, 21 nt, Artificial Sequence
  Ebola virus siRNA sense strand
uuucaguaccagugauggcaa

SEQ ID NO: 3583 - RNA, 21 nt, Artificial Sequence
  Ebola virus siRNA sense strand
uucaguaccagugauggcaaa

SEQ ID NO: 3584 - RNA, 21 nt, Artificial Sequence
  Ebola virus siRNA sense strand
ucaguaccagugauggcaaag

SEQ ID NO: 3585 - RNA, 21 nt, Artificial Sequence
  Ebola virus siRNA sense strand
caguaccagugauggcaaaga

SEQ ID NO: 3586 - RNA, 21 nt, Artificial Sequence
  Ebola virus siRNA sense strand
aguaccagugauggcaaagag

SEQ ID NO: 3587 - RNA, 21 nt, Artificial Sequence
  Ebola virus siRNA sense strand
guaccagugauggcaaagagu

SEQ ID NO: 3588 - RNA, 21 nt, Artificial Sequence
  Ebola virus siRNA sense strand
uaccagugauggcaaagagua

SEQ ID NO: 3589 - RNA, 21 nt, Artificial Sequence
  Ebola virus siRNA sense strand
accagugauggcaaagaguac

SEQ ID NO: 3590 - RNA, 21 nt, Artificial Sequence
  Ebola virus siRNA sense strand
ccagugauggcaaagaguaca

SEQ ID NO: 3591 - RNA, 21 nt, Artificial Sequence
  Ebola virus siRNA sense strand
cagugauggcaaagaguacac

SEQ ID NO: 3592 - RNA, 21 nt, Artificial Sequence
  Ebola virus siRNA sense strand
agugauggcaaagaguacacg

SEQ ID NO: 3593 - RNA, 21 nt, Artificial Sequence
  Ebola virus siRNA sense strand
gugauggcaaagaguacacgu

SEQ ID NO: 3594 - RNA, 21 nt, Artificial Sequence
  Ebola virus siRNA sense strand
ugauggcaaagaguacacgua

SEQ ID NO: 3595 - RNA, 21 nt, Artificial Sequence
  Ebola virus siRNA sense strand
gauggcaaagaguacacguau

SEQ ID NO: 3596 - RNA, 21 nt, Artificial Sequence
  Ebola virus siRNA sense strand
auggcaaagaguacacguauc

SEQ ID NO: 3597 - RNA, 21 nt, Artificial Sequence
  Ebola virus siRNA sense strand
uggcaaagaguacacguaucc

SEQ ID NO: 3598 - RNA, 21 nt, Artificial Sequence
  Ebola virus siRNA sense strand
ggcaaagaguacacguaucca

SEQ ID NO: 3599 - RNA, 21 nt, Artificial Sequence
  Ebola virus siRNA sense strand
gcaaagaguacacguauccag

SEQ ID NO: 3600 - RNA, 21 nt, Artificial Sequence
  Ebola virus siRNA sense strand
caaagaguacacguauccaga

SEQ ID NO: 3601 - RNA, 21 nt, Artificial Sequence
  Ebola virus siRNA sense strand
aaagaguacacguauccagac

SEQ ID NO: 3602 - RNA, 21 nt, Artificial Sequence
  Ebola virus siRNA sense strand
aagaguacacguauccagacu

SEQ ID NO: 3603 - RNA, 21 nt, Artificial Sequence
  Ebola virus siRNA sense strand
agaguacacguauccagacuc

SEQ ID NO: 3604 - RNA, 21 nt, Artificial Sequence
  Ebola virus siRNA sense strand
gaguacacguauccagacucc

SEQ ID NO: 3605 - RNA, 21 nt, Artificial Sequence
  Ebola virus siRNA sense strand
aguacacguauccagacuccc

SEQ ID NO: 3606 - RNA, 21 nt, Artificial Sequence
  Ebola virus siRNA sense strand
guacacguauccagacucccu

SEQ ID NO: 3607 - RNA, 21 nt, Artificial Sequence
  Ebola virus siRNA sense strand
uacacguauccagacucccuu

SEQ ID NO: 3608 - RNA, 21 nt, Artificial Sequence
  Ebola virus siRNA sense strand
acacguauccagacucccuug

SEQ ID NO: 3609 - RNA, 21 nt, Artificial Sequence
  Ebola virus siRNA sense strand
cacguauccagacucccuuga

SEQ ID NO: 3610 - RNA, 21 nt, Artificial Sequence
  Ebola virus siRNA sense strand
acguauccagacucccuugaa

SEQ ID NO: 3611 - RNA, 21 nt, Artificial Sequence
  Ebola virus siRNA sense strand
cguauccagacucccuugaag

SEQ ID NO: 3612 - RNA, 21 nt, Artificial Sequence
  Ebola virus siRNA sense strand
guauccagacucccuugaaga

SEQ ID NO: 3613 - RNA, 21 nt, Artificial Sequence
  Ebola virus siRNA sense strand
uauccagacucccuugaagag

SEQ ID NO: 3614 - RNA, 21 nt, Artificial Sequence
  Ebola virus siRNA sense strand
auccagacucccuugaagagg

SEQ ID NO: 3615 - RNA, 21 nt, Artificial Sequence
  Ebola virus siRNA sense strand
uccagacucccuugaagagga

SEQ ID NO: 3616 - RNA, 21 nt, Artificial Sequence
  Ebola virus siRNA sense strand
ccagacucccuugaagaggaa

SEQ ID NO: 3617 - RNA, 21 nt, Artificial Sequence
  Ebola virus siRNA sense strand
cagacucccuugaagaggaau

SEQ ID NO: 3618 - RNA, 21 nt, Artificial Sequence
  Ebola virus siRNA sense strand
agacucccuugaagaggaaua

SEQ ID NO: 3619 - RNA, 21 nt, Artificial Sequence
  Ebola virus siRNA sense strand
gacucccuugaagaggaauau

SEQ ID NO: 3620 - RNA, 21 nt, Artificial Sequence
  Ebola virus siRNA sense strand
acucccuugaagaggaauauc

SEQ ID NO: 3621 - RNA, 21 nt, Artificial Sequence
  Ebola virus siRNA sense strand
cucccuugaagaggaauaucc

SEQ ID NO: 3622 - RNA, 21 nt, Artificial Sequence
  Ebola virus siRNA sense strand
ucccuugaagaggaauaucca

SEQ ID NO: 3623 - RNA, 21 nt, Artificial Sequence
  Ebola virus siRNA sense strand
cccuugaagaggaauauccac

SEQ ID NO: 3624 - RNA, 21 nt, Artificial Sequence
  Ebola virus siRNA sense strand
ccuugaagaggaauauccacc

SEQ ID NO: 3625 - RNA, 21 nt, Artificial Sequence
  Ebola virus siRNA sense strand
cuugaagaggaauauccacca

SEQ ID NO: 3626 - RNA, 21 nt, Artificial Sequence
  Ebola virus siRNA sense strand
uugaagaggaauauccaccau

SEQ ID NO: 3627 - RNA, 21 nt, Artificial Sequence
  Ebola virus siRNA sense strand
ugaagaggaauauccaccaug

SEQ ID NO: 3628 - RNA, 21 nt, Artificial Sequence
  Ebola virus siRNA sense strand
gaagaggaauauccaccaugg

SEQ ID NO: 3629 - RNA, 21 nt, Artificial Sequence
  Ebola virus siRNA sense strand
aagaggaauauccaccauggc

SEQ ID NO: 3630 - RNA, 21 nt, Artificial Sequence
  Ebola virus siRNA sense strand
agaggaauauccaccauggcu

SEQ ID NO: 3631 - RNA, 21 nt, Artificial Sequence
  Ebola virus siRNA sense strand
gaggaauauccaccauggcuc

SEQ ID NO: 3632 - RNA, 21 nt, Artificial Sequence
  Ebola virus siRNA sense strand
aggaauauccaccauggcuca

SEQ ID NO: 3633 - RNA, 21 nt, Artificial Sequence
  Ebola virus siRNA sense strand
ggaauauccaccauggcucac

SEQ ID NO: 3634 - RNA, 21 nt, Artificial Sequence
  Ebola virus siRNA sense strand
gaauauccaccauggcucacu

SEQ ID NO: 3635 - RNA, 21 nt, Artificial Sequence
  Ebola virus siRNA sense strand
aauauccaccauggcucacug

SEQ ID NO: 3636 - RNA, 21 nt, Artificial Sequence
  Ebola virus siRNA sense strand
auauccaccauggcucacuga

SEQ ID NO: 3637 - RNA, 21 nt, Artificial Sequence
  Ebola virus siRNA sense strand
uauccaccauggcucacugaa

SEQ ID NO: 3638 - RNA, 21 nt, Artificial Sequence
  Ebola virus siRNA sense strand
auccaccauggcucacugaaa

SEQ ID NO: 3639 - RNA, 21 nt, Artificial Sequence
  Ebola virus siRNA sense strand
uccaccauggcucacugaaaa

SEQ ID NO: 3640 - RNA, 21 nt, Artificial Sequence
  Ebola virus siRNA sense strand
ccaccauggcucacugaaaaa

SEQ ID NO: 3641 - RNA, 21 nt, Artificial Sequence
  Ebola virus siRNA sense strand
caccauggcucacugaaaaag

SEQ ID NO: 3642 - RNA, 21 nt, Artificial Sequence
  Ebola virus siRNA sense strand
accauggcucacugaaaaaga

SEQ ID NO: 3643 - RNA, 21 nt, Artificial Sequence
  Ebola virus siRNA sense strand
ccauggcucacugaaaaagag

SEQ ID NO: 3644 - RNA, 21 nt, Artificial Sequence
  Ebola virus siRNA sense strand
cauggcucacugaaaaagagg

SEQ ID NO: 3645 - RNA, 21 nt, Artificial Sequence
  Ebola virus siRNA sense strand
auggcucacugaaaaagaggc

SEQ ID NO: 3646 - RNA, 21 nt, Artificial Sequence
  Ebola virus siRNA sense strand
uggcucacugaaaaagaggcu

SEQ ID NO: 3647 - RNA, 21 nt, Artificial Sequence
  Ebola virus siRNA sense strand
ggcucacugaaaaagaggcua

SEQ ID NO: 3648 - RNA, 21 nt, Artificial Sequence
  Ebola virus siRNA sense strand
gcucacugaaaaagaggcuau

SEQ ID NO: 3649 - RNA, 21 nt, Artificial Sequence
  Ebola virus siRNA sense strand
cucacugaaaaagaggcuaug

SEQ ID NO: 3650 - RNA, 21 nt, Artificial Sequence
  Ebola virus siRNA sense strand
ucacugaaaaagaggcuauga

SEQ ID NO: 3651 - RNA, 21 nt, Artificial Sequence
  Ebola virus siRNA sense strand
cacugaaaaagaggcuaugaa

SEQ ID NO: 3652 - RNA, 21 nt, Artificial Sequence
  Ebola virus siRNA sense strand
acugaaaaagaggcuaugaau

SEQ ID NO: 3653 - RNA, 21 nt, Artificial Sequence
  Ebola virus siRNA sense strand
cugaaaaagaggcuaugaaug

SEQ ID NO: 3654 - RNA, 21 nt, Artificial Sequence
  Ebola virus siRNA sense strand
ugaaaaagaggcuaugaauga

SEQ ID NO: 3655 - RNA, 21 nt, Artificial Sequence
  Ebola virus siRNA sense strand
gaaaaagaggcuaugaaugaa

SEQ ID NO: 3656 - RNA, 21 nt, Artificial Sequence
  Ebola virus siRNA sense strand
aaaaagaggcuaugaaugaag

SEQ ID NO: 3657 - RNA, 21 nt, Artificial Sequence
  Ebola virus siRNA sense strand
aaaagaggcuaugaaugaaga

SEQ ID NO: 3658 - RNA, 21 nt, Artificial Sequence
  Ebola virus siRNA sense strand
aaagaggcuaugaaugaagag

SEQ ID NO: 3659 - RNA, 21 nt, Artificial Sequence
  Ebola virus siRNA sense strand
aagaggcuaugaaugaagaga

SEQ ID NO: 3660 - RNA, 21 nt, Artificial Sequence
  Ebola virus siRNA sense strand
agaggcuaugaaugaagagaa

SEQ ID NO: 3661 - RNA, 21 nt, Artificial Sequence
  Ebola virus siRNA sense strand
gaggcuaugaaugaagagaau

SEQ ID NO: 3662 - RNA, 21 nt, Artificial Sequence
  Ebola virus siRNA sense strand
aggcuaugaaugaagagaaua

SEQ ID NO: 3663 - RNA, 21 nt, Artificial Sequence
  Ebola virus siRNA sense strand
ggcuaugaaugaagagaauag

SEQ ID NO: 3664 - RNA, 21 nt, Artificial Sequence
  Ebola virus siRNA sense strand
gcuaugaaugaagagaauaga

SEQ ID NO: 3665 - RNA, 21 nt, Artificial Sequence
  Ebola virus siRNA sense strand
cuaugaaugaagagaauagau

SEQ ID NO: 3666 - RNA, 21 nt, Artificial Sequence
  Ebola virus siRNA sense strand
uaugaaugaagagaauagauu

SEQ ID NO: 3667 - RNA, 21 nt, Artificial Sequence
  Ebola virus siRNA sense strand
augaaugaagagaauagauuu

SEQ ID NO: 3668 - RNA, 21 nt, Artificial Sequence
  Ebola virus siRNA sense strand
ugaaugaagagaauagauuug

SEQ ID NO: 3669 - RNA, 21 nt, Artificial Sequence
  Ebola virus siRNA sense strand
gaaugaagagaauagauuugu

SEQ ID NO: 3670 - RNA, 21 nt, Artificial Sequence
  Ebola virus siRNA sense strand
aaugaagagaauagauuuguu

SEQ ID NO: 3671 - RNA, 21 nt, Artificial Sequence
  Ebola virus siRNA sense strand
augaagagaauagauuuguua

SEQ ID NO: 3672 - RNA, 21 nt, Artificial Sequence
  Ebola virus siRNA sense strand
ugaagagaauagauuuguuac

SEQ ID NO: 3673 - RNA, 21 nt, Artificial Sequence
  Ebola virus siRNA sense strand
gaagagaauagauuuguuaca

SEQ ID NO: 3674 - RNA, 21 nt, Artificial Sequence
  Ebola virus siRNA sense strand
aagagaauagauuuguuacau

SEQ ID NO: 3675 - RNA, 21 nt, Artificial Sequence
  Ebola virus siRNA sense strand
agagaauagauuuguuacauu

SEQ ID NO: 3676 - RNA, 21 nt, Artificial Sequence
  Ebola virus siRNA sense strand
gagaauagauuuguuacauug

SEQ ID NO: 3677 - RNA, 21 nt, Artificial Sequence
  Ebola virus siRNA sense strand
agaauagauuuguuacauugg

SEQ ID NO: 3678 - RNA, 21 nt, Artificial Sequence
  Ebola virus siRNA sense strand
gaauagauuuguuacauugga

SEQ ID NO: 3679 - RNA, 21 nt, Artificial Sequence
  Ebola virus siRNA sense strand
aauagauuuguuacauuggau

SEQ ID NO: 3680 - RNA, 21 nt, Artificial Sequence
  Ebola virus siRNA sense strand
auagauuuguuacauuggaug

SEQ ID NO: 3681 - RNA, 21 nt, Artificial Sequence
  Ebola virus siRNA sense strand
uagauuuguuacauuggaugg

SEQ ID NO: 3682 - RNA, 21 nt, Artificial Sequence
  Ebola virus siRNA sense strand
agauuuguuacauuggauggu

SEQ ID NO: 3683 - RNA, 21 nt, Artificial Sequence
  Ebola virus siRNA sense strand
gauuuguuacauuggaugguc

SEQ ID NO: 3684 - RNA, 21 nt, Artificial Sequence
  Ebola virus siRNA sense strand
auuuguuacauuggaugguca

SEQ ID NO: 3685 - RNA, 21 nt, Artificial Sequence
  Ebola virus siRNA sense strand
uuuguuacauuggauggucaa

SEQ ID NO: 3686 - RNA, 21 nt, Artificial Sequence
  Ebola virus siRNA sense strand
uuguuacauuggauggucaac

SEQ ID NO: 3687 - RNA, 21 nt, Artificial Sequence
  Ebola virus siRNA sense strand
uguuacauuggauggucaaca

SEQ ID NO: 3688 - RNA, 21 nt, Artificial Sequence
  Ebola virus siRNA sense strand
guuacauuggauggucaacaa

SEQ ID NO: 3689 - RNA, 21 nt, Artificial Sequence
  Ebola virus siRNA sense strand
uuacauuggauggucaacaau

SEQ ID NO: 3690 - RNA, 21 nt, Artificial Sequence
  Ebola virus siRNA sense strand
uacauuggauggucaacaauu

SEQ ID NO: 3691 - RNA, 21 nt, Artificial Sequence
  Ebola virus siRNA sense strand
acauuggauggucaacaauuu

SEQ ID NO: 3692 - RNA, 21 nt, Artificial Sequence
  Ebola virus siRNA sense strand
cauuggauggucaacaauuuu

SEQ ID NO: 3693 - RNA, 21 nt, Artificial Sequence
  Ebola virus siRNA sense strand
auuggauggucaacaauuuua

SEQ ID NO: 3694 - RNA, 21 nt, Artificial Sequence
  Ebola virus siRNA sense strand
uuggauggucaacaauuuuau

SEQ ID NO: 3695 - RNA, 21 nt, Artificial Sequence
  Ebola virus siRNA sense strand
uggauggucaacaauuuuauu

SEQ ID NO: 3696 - RNA, 21 nt, Artificial Sequence
  Ebola virus siRNA sense strand
ggauggucaacaauuuuauug

SEQ ID NO: 3697 - RNA, 21 nt, Artificial Sequence
  Ebola virus siRNA sense strand
gauggucaacaauuuuauugg

SEQ ID NO: 3698 - RNA, 21 nt, Artificial Sequence
  Ebola virus siRNA sense strand
auggucaacaauuuuauuggc

SEQ ID NO: 3699 - RNA, 21 nt, Artificial Sequence
  Ebola virus siRNA sense strand
uggucaacaauuuuauuggcc

SEQ ID NO: 3700 - RNA, 21 nt, Artificial Sequence
  Ebola virus siRNA sense strand
ggucaacaauuuuauuggccg

SEQ ID NO: 3701 - RNA, 21 nt, Artificial Sequence
  Ebola virus siRNA sense strand
gucaacaauuuuauuggccgg

SEQ ID NO: 3702 - RNA, 21 nt, Artificial Sequence
  Ebola virus siRNA sense strand
ucaacaauuuuauuggccggu

SEQ ID NO: 3703 - RNA, 21 nt, Artificial Sequence
  Ebola virus siRNA sense strand
caacaauuuuauuggccggug

SEQ ID NO: 3704 - RNA, 21 nt, Artificial Sequence
  Ebola virus siRNA sense strand
aacaauuuuauuggccgguga

SEQ ID NO: 3705 - RNA, 21 nt, Artificial Sequence
  Ebola virus siRNA sense strand
acaauuuuauuggccggugau

SEQ ID NO: 3706 - RNA, 21 nt, Artificial Sequence
  Ebola virus siRNA sense strand
caauuuuauuggccggugaug

SEQ ID NO: 3707 - RNA, 21 nt, Artificial Sequence
  Ebola virus siRNA sense strand
aauuuuauuggccggugauga

SEQ ID NO: 3708 - RNA, 21 nt, Artificial Sequence
  Ebola virus siRNA sense strand
auuuuauuggccggugaugaa

SEQ ID NO: 3709 - RNA, 21 nt, Artificial Sequence
  Ebola virus siRNA sense strand
uuuuauuggccggugaugaau

SEQ ID NO: 3710 - RNA, 21 nt, Artificial Sequence
  Ebola virus siRNA sense strand
uuuauuggccggugaugaauc

SEQ ID NO: 3711 - RNA, 21 nt, Artificial Sequence
  Ebola virus siRNA sense strand
uuauuggccggugaugaauca

SEQ ID NO: 3712 - RNA, 21 nt, Artificial Sequence
  Ebola virus siRNA sense strand
uauuggccggugaugaaucac

SEQ ID NO: 3713 - RNA, 21 nt, Artificial Sequence
  Ebola virus siRNA sense strand
auuggccggugaugaaucaca

SEQ ID NO: 3714 - RNA, 21 nt, Artificial Sequence
  Ebola virus siRNA sense strand
uuggccggugaugaaucacaa

SEQ ID NO: 3715 - RNA, 21 nt, Artificial Sequence
  Ebola virus siRNA sense strand
uggccggugaugaaucacaag

SEQ ID NO: 3716 - RNA, 21 nt, Artificial Sequence
  Ebola virus siRNA sense strand
ggccggugaugaaucacaaga

SEQ ID NO: 3717 - RNA, 21 nt, Artificial Sequence
  Ebola virus siRNA sense strand
gccggugaugaaucacaagaa

SEQ ID NO: 3718 - RNA, 21 nt, Artificial Sequence
  Ebola virus siRNA sense strand
ccggugaugaaucacaagaau

SEQ ID NO: 3719 - RNA, 21 nt, Artificial Sequence
  Ebola virus siRNA sense strand
cggugaugaaucacaagaaua

SEQ ID NO: 3720 - RNA, 21 nt, Artificial Sequence
  Ebola virus siRNA sense strand
ggugaugaaucacaagaauaa

SEQ ID NO: 3721 - RNA, 21 nt, Artificial Sequence
  Ebola virus siRNA sense strand
gugaugaaucacaagaauaaa

SEQ ID NO: 3722 - RNA, 21 nt, Artificial Sequence
  Ebola virus siRNA sense strand
ugaugaaucacaagaauaaau

SEQ ID NO: 3723 - RNA, 21 nt, Artificial Sequence
  Ebola virus siRNA sense strand
gaugaaucacaagaauaaauu

SEQ ID NO: 3724 - RNA, 21 nt, Artificial Sequence
  Ebola virus siRNA sense strand
augaaucacaagaauaaauuc

SEQ ID NO: 3725 - RNA, 21 nt, Artificial Sequence
  Ebola virus siRNA sense strand
ugaaucacaagaauaaauuca

SEQ ID NO: 3726 - RNA, 21 nt, Artificial Sequence
  Ebola virus siRNA sense strand
gaaucacaagaauaaauucau

SEQ ID NO: 3727 - RNA, 21 nt, Artificial Sequence
  Ebola virus siRNA sense strand
aaucacaagaauaaauucaug

SEQ ID NO: 3728 - RNA, 21 nt, Artificial Sequence
  Ebola virus siRNA sense strand
aucacaagaauaaauucaugg

SEQ ID NO: 3729 - RNA, 21 nt, Artificial Sequence
  Ebola virus siRNA sense strand
ucacaagaauaaauucauggc

SEQ ID NO: 3730 - RNA, 21 nt, Artificial Sequence
  Ebola virus siRNA sense strand
cacaagaauaaauucauggca

SEQ ID NO: 3731 - RNA, 21 nt, Artificial Sequence
  Ebola virus siRNA sense strand
acaagaauaaauucauggcaa

SEQ ID NO: 3732 - RNA, 21 nt, Artificial Sequence
  Ebola virus siRNA sense strand
caagaauaaauucauggcaau

SEQ ID NO: 3733 - RNA, 21 nt, Artificial Sequence
  Ebola virus siRNA sense strand
aagaauaaauucauggcaauc

SEQ ID NO: 3734 - RNA, 21 nt, Artificial Sequence
  Ebola virus siRNA sense strand
agaauaaauucauggcaaucc

SEQ ID NO: 3735 - RNA, 21 nt, Artificial Sequence
  Ebola virus siRNA sense strand
gaauaaauucauggcaauccu

SEQ ID NO: 3736 - RNA, 21 nt, Artificial Sequence
  Ebola virus siRNA sense strand
aauaaauucauggcaauccug

SEQ ID NO: 3737 - RNA, 21 nt, Artificial Sequence
  Ebola virus siRNA sense strand
auaaauucauggcaauccugc

SEQ ID NO: 3738 - RNA, 21 nt, Artificial Sequence
  Ebola virus siRNA sense strand
uaaauucauggcaauccugca

SEQ ID NO: 3739 - RNA, 21 nt, Artificial Sequence
  Ebola virus siRNA sense strand
aaauucauggcaauccugcaa

SEQ ID NO: 3740 - RNA, 21 nt, Artificial Sequence
  Ebola virus siRNA sense strand
aauucauggcaauccugcaac

SEQ ID NO: 3741 - RNA, 21 nt, Artificial Sequence
  Ebola virus siRNA sense strand
auucauggcaauccugcaaca

SEQ ID NO: 3742 - RNA, 21 nt, Artificial Sequence
  Ebola virus siRNA sense strand
uucauggcaauccugcaacau

SEQ ID NO: 3743 - RNA, 21 nt, Artificial Sequence
  Ebola virus siRNA sense strand
ucauggcaauccugcaacauc

SEQ ID NO: 3744 - RNA, 21 nt, Artificial Sequence
  Ebola virus siRNA sense strand
cauggcaauccugcaacauca

SEQ ID NO: 3745 - RNA, 21 nt, Artificial Sequence
  Ebola virus siRNA sense strand
auggcaauccugcaacaucau

SEQ ID NO: 3746 - RNA, 21 nt, Artificial Sequence
  Ebola virus siRNA sense strand
uggcaauccugcaacaucauc

SEQ ID NO: 3747 - RNA, 21 nt, Artificial Sequence
  Ebola virus siRNA sense strand
ggcaauccugcaacaucauca

SEQ ID NO: 3748 - RNA, 21 nt, Artificial Sequence
  Ebola virus siRNA sense strand
gcaauccugcaacaucaucag

SEQ ID NO: 3749 - RNA, 21 nt, Artificial Sequence
  Ebola virus siRNA sense strand
caauccugcaacaucaucagu

SEQ ID NO: 3750 - RNA, 21 nt, Artificial Sequence
  Ebola virus siRNA sense strand
aauccugcaacaucaucagug

SEQ ID NO: 3751 - RNA, 21 nt, Artificial Sequence
  Ebola virus siRNA sense strand
auccugcaacaucaucaguga

SEQ ID NO: 3752 - RNA, 21 nt, Artificial Sequence
  Ebola virus siRNA sense strand
uccugcaacaucaucagugaa

SEQ ID NO: 3753 - RNA, 21 nt, Artificial Sequence
  Ebola virus siRNA sense strand
ccugcaacaucaucagugaau

SEQ ID NO: 3754 - RNA, 21 nt, Artificial Sequence
  Ebola virus siRNA sense strand
cugcaacaucaucagugaaug

SEQ ID NO: 3755 - RNA, 21 nt, Artificial Sequence
  Ebola virus siRNA sense strand
ugcaacaucaucagugaauga

SEQ ID NO: 3756 - RNA, 21 nt, Artificial Sequence
  Ebola virus siRNA sense strand
gcaacaucaucagugaaugag

SEQ ID NO: 3757 - RNA, 21 nt, Artificial Sequence
  Ebola virus siRNA sense strand
caacaucaucagugaaugagc

SEQ ID NO: 3758 - RNA, 21 nt, Artificial Sequence
  Ebola virus siRNA sense strand
aacaucaucagugaaugagca

SEQ ID NO: 3759 - RNA, 21 nt, Artificial Sequence
  Ebola virus siRNA sense strand
acaucaucagugaaugagcau

SEQ ID NO: 3760 - RNA, 21 nt, Artificial Sequence
  Ebola virus siRNA sense strand
caucaucagugaaugagcaug

SEQ ID NO: 3761 - RNA, 21 nt, Artificial Sequence
  Ebola virus siRNA sense strand
aucaucagugaaugagcaugg

SEQ ID NO: 3762 - RNA, 21 nt, Artificial Sequence
  Ebola virus siRNA sense strand
ucaucagugaaugagcaugga

SEQ ID NO: 3763 - RNA, 21 nt, Artificial Sequence
  Ebola virus siRNA sense strand
caucagugaaugagcauggaa

SEQ ID NO: 3764 - RNA, 21 nt, Artificial Sequence
  Ebola virus siRNA sense strand
aucagugaaugagcauggaac

SEQ ID NO: 3765 - RNA, 21 nt, Artificial Sequence
  Ebola virus siRNA sense strand
ucagugaaugagcauggaaca

SEQ ID NO: 3766 - RNA, 21 nt, Artificial Sequence
  Ebola virus siRNA sense strand
cagugaaugagcauggaacaa

SEQ ID NO: 3767 - RNA, 21 nt, Artificial Sequence
  Ebola virus siRNA sense strand
agugaaugagcauggaacaau

SEQ ID NO: 3768 - RNA, 21 nt, Artificial Sequence
  Ebola virus siRNA sense strand
gugaaugagcauggaacaaug

SEQ ID NO: 3769 - RNA, 21 nt, Artificial Sequence
  Ebola virus siRNA sense strand
ugaaugagcauggaacaaugg

SEQ ID NO: 3770 - RNA, 21 nt, Artificial Sequence
  Ebola virus siRNA sense strand
gaaugagcauggaacaauggg

SEQ ID NO: 3771 - RNA, 21 nt, Artificial Sequence
  Ebola virus siRNA sense strand
aaugagcauggaacaauggga

SEQ ID NO: 3772 - RNA, 21 nt, Artificial Sequence
  Ebola virus siRNA sense strand
augagcauggaacaaugggau

SEQ ID NO: 3773 - RNA, 21 nt, Artificial Sequence
  Ebola virus siRNA sense strand
ugagcauggaacaaugggaug

SEQ ID NO: 3774 - RNA, 21 nt, Artificial Sequence
  Ebola virus siRNA sense strand
gagcauggaacaaugggauga

SEQ ID NO: 3775 - RNA, 21 nt, Artificial Sequence
  Ebola virus siRNA sense strand
agcauggaacaaugggaugau

SEQ ID NO: 3776 - RNA, 21 nt, Artificial Sequence
  Ebola virus siRNA sense strand
gcauggaacaaugggaugauu

SEQ ID NO: 3777 - RNA, 21 nt, Artificial Sequence
  Ebola virus siRNA sense strand
cauggaacaaugggaugauuc

SEQ ID NO: 3778 - RNA, 21 nt, Artificial Sequence
  Ebola virus siRNA sense strand
auggaacaaugggaugauuca

SEQ ID NO: 3779 - RNA, 21 nt, Artificial Sequence
  Ebola virus siRNA sense strand
uggaacaaugggaugauucaa

SEQ ID NO: 3780 - RNA, 21 nt, Artificial Sequence
  Ebola virus siRNA sense strand
ggaacaaugggaugauucaac

SEQ ID NO: 3781 - RNA, 21 nt, Artificial Sequence
  Ebola virus siRNA sense strand
gaacaaugggaugauucaacc

SEQ ID NO: 3782 - RNA, 21 nt, Artificial Sequence
  Ebola virus siRNA sense strand
aacaaugggaugauucaaccg

SEQ ID NO: 3783 - RNA, 21 nt, Artificial Sequence
  Ebola virus siRNA sense strand
acaaugggaugauucaaccga

SEQ ID NO: 3784 - RNA, 21 nt, Artificial Sequence
  Ebola virus siRNA sense strand
caaugggaugauucaaccgac

SEQ ID NO: 3785 - RNA, 21 nt, Artificial Sequence
  Ebola virus siRNA sense strand
aaugggaugauucaaccgaca

SEQ ID NO: 3786 - RNA, 21 nt, Artificial Sequence
  Ebola virus siRNA sense strand
augggaugauucaaccgacaa

SEQ ID NO: 3787 - RNA, 21 nt, Artificial Sequence
  Ebola virus siRNA sense strand
ugggaugauucaaccgacaaa

SEQ ID NO: 3788 - RNA, 21 nt, Artificial Sequence
  Ebola virus siRNA sense strand
gggaugauucaaccgacaaau

SEQ ID NO: 3789 - RNA, 21 nt, Artificial Sequence
  Ebola virus siRNA sense strand
ggaugauucaaccgacaaaua

SEQ ID NO: 3790 - RNA, 21 nt, Artificial Sequence
  Ebola virus siRNA sense strand
gaugauucaaccgacaaauag

SEQ ID NO: 3791 - RNA, 21 nt, Artificial Sequence
  Ebola virus siRNA sense strand
augauucaaccgacaaauagc

SEQ ID NO: 3792 - RNA, 21 nt, Artificial Sequence
  Ebola virus siRNA sense strand
ugauucaaccgacaaauagcu

SEQ ID NO: 3793 - RNA, 21 nt, Artificial Sequence
  Ebola virus siRNA sense strand
gauucaaccgacaaauagcua

SEQ ID NO: 3794 - RNA, 21 nt, Artificial Sequence
  Ebola virus siRNA sense strand
auucaaccgacaaauagcuaa

SEQ ID NO: 3795 - RNA, 21 nt, Artificial Sequence
  Ebola virus siRNA sense strand
uucaaccgacaaauagcuaac

SEQ ID NO: 3796 - RNA, 21 nt, Artificial Sequence
  Ebola virus siRNA sense strand
ucaaccgacaaauagcuaaca

SEQ ID NO: 3797 - RNA, 21 nt, Artificial Sequence
  Ebola virus siRNA sense strand
caaccgacaaauagcuaacau

SEQ ID NO: 3798 - RNA, 21 nt, Artificial Sequence
  Ebola virus siRNA sense strand
aaccgacaaauagcuaacauu

SEQ ID NO: 3799 - RNA, 21 nt, Artificial Sequence
  Ebola virus siRNA sense strand
accgacaaauagcuaacauua

SEQ ID NO: 3800 - RNA, 21 nt, Artificial Sequence
  Ebola virus siRNA sense strand
ccgacaaauagcuaacauuaa

SEQ ID NO: 3801 - RNA, 21 nt, Artificial Sequence
  Ebola virus siRNA sense strand
cgacaaauagcuaacauuaag

SEQ ID NO: 3802 - RNA, 21 nt, Artificial Sequence
  Ebola virus siRNA sense strand
gacaaauagcuaacauuaagu

SEQ ID NO: 3803 - RNA, 21 nt, Artificial Sequence
  Ebola virus siRNA sense strand
acaaauagcuaacauuaagua

SEQ ID NO: 3804 - RNA, 21 nt, Artificial Sequence
  Ebola virus siRNA sense strand
caaauagcuaacauuaaguag

SEQ ID NO: 3805 - RNA, 21 nt, Artificial Sequence
  Ebola virus siRNA sense strand
aaauagcuaacauuaaguagu

SEQ ID NO: 3806 - RNA, 21 nt, Artificial Sequence
  Ebola virus siRNA sense strand
aauagcuaacauuaaguaguc

SEQ ID NO: 3807 - RNA, 21 nt, Artificial Sequence
  Ebola virus siRNA sense strand
auagcuaacauuaaguaguca

SEQ ID NO: 3808 - RNA, 21 nt, Artificial Sequence
  Ebola virus siRNA sense strand
uagcuaacauuaaguagucaa

SEQ ID NO: 3809 - RNA, 21 nt, Artificial Sequence
  Ebola virus siRNA sense strand
agcuaacauuaaguagucaag

SEQ ID NO: 3810 - RNA, 21 nt, Artificial Sequence
  Ebola virus siRNA sense strand
gcuaacauuaaguagucaagg

SEQ ID NO: 3811 - RNA, 21 nt, Artificial Sequence
  Ebola virus siRNA sense strand
cuaacauuaaguagucaagga

SEQ ID NO: 3812 - RNA, 21 nt, Artificial Sequence
  Ebola virus siRNA sense strand
uaacauuaaguagucaaggaa

SEQ ID NO: 3813 - RNA, 21 nt, Artificial Sequence
  Ebola virus siRNA sense strand
aacauuaaguagucaaggaac

SEQ ID NO: 3814 - RNA, 21 nt, Artificial Sequence
  Ebola virus siRNA sense strand
acauuaaguagucaaggaacg

SEQ ID NO: 3815 - RNA, 21 nt, Artificial Sequence
  Ebola virus siRNA sense strand
cauuaaguagucaaggaacga

SEQ ID NO: 3816 - RNA, 21 nt, Artificial Sequence
  Ebola virus siRNA sense strand
auuaaguagucaaggaacgaa

SEQ ID NO: 3817 - RNA, 21 nt, Artificial Sequence
  Ebola virus siRNA sense strand
uuaaguagucaaggaacgaaa

SEQ ID NO: 3818 - RNA, 21 nt, Artificial Sequence
  Ebola virus siRNA sense strand
uaaguagucaaggaacgaaaa

SEQ ID NO: 3819 - RNA, 21 nt, Artificial Sequence
  Ebola virus siRNA sense strand
aaguagucaaggaacgaaaac

SEQ ID NO: 3820 - RNA, 21 nt, Artificial Sequence
  Ebola virus siRNA sense strand
aguagucaaggaacgaaaaca

SEQ ID NO: 3821 - RNA, 21 nt, Artificial Sequence
  Ebola virus siRNA sense strand
guagucaaggaacgaaaacag

SEQ ID NO: 3822 - RNA, 21 nt, Artificial Sequence
  Ebola virus siRNA sense strand
uagucaaggaacgaaaacagg

SEQ ID NO: 3823 - RNA, 21 nt, Artificial Sequence
  Ebola virus siRNA sense strand
agucaaggaacgaaaacagga

SEQ ID NO: 3824 - RNA, 21 nt, Artificial Sequence
  Ebola virus siRNA sense strand
gucaaggaacgaaaacaggaa

SEQ ID NO: 3825 - RNA, 21 nt, Artificial Sequence
  Ebola virus siRNA sense strand
ucaaggaacgaaaacaggaag

SEQ ID NO: 3826 - RNA, 21 nt, Artificial Sequence
  Ebola virus siRNA sense strand
caaggaacgaaaacaggaaga

SEQ ID NO: 3827 - RNA, 21 nt, Artificial Sequence
  Ebola virus siRNA sense strand
aaggaacgaaaacaggaagaa

SEQ ID NO: 3828 - RNA, 21 nt, Artificial Sequence
  Ebola virus siRNA sense strand
aggaacgaaaacaggaagaau

SEQ ID NO: 3829 - RNA, 21 nt, Artificial Sequence
  Ebola virus siRNA sense strand
ggaacgaaaacaggaagaauu

SEQ ID NO: 3830 - RNA, 21 nt, Artificial Sequence
  Ebola virus siRNA sense strand
gaacgaaaacaggaagaauuu

SEQ ID NO: 3831 - RNA, 21 nt, Artificial Sequence
  Ebola virus siRNA sense strand
aacgaaaacaggaagaauuuu

SEQ ID NO: 3832 - RNA, 21 nt, Artificial Sequence
  Ebola virus siRNA sense strand
acgaaaacaggaagaauuuuu

SEQ ID NO: 3833 - RNA, 21 nt, Artificial Sequence
  Ebola virus siRNA sense strand
cgaaaacaggaagaauuuuug

SEQ ID NO: 3834 - RNA, 21 nt, Artificial Sequence
  Ebola virus siRNA sense strand
gaaaacaggaagaauuuuuga

SEQ ID NO: 3835 - RNA, 21 nt, Artificial Sequence
  Ebola virus siRNA sense strand
aaaacaggaagaauuuuugau

SEQ ID NO: 3836 - RNA, 21 nt, Artificial Sequence
  Ebola virus siRNA sense strand
aaacaggaagaauuuuugaug

SEQ ID NO: 3837 - RNA, 21 nt, Artificial Sequence
  Ebola virus siRNA sense strand
aacaggaagaauuuuugaugu

SEQ ID NO: 3838 - RNA, 21 nt, Artificial Sequence
  Ebola virus siRNA sense strand
acaggaagaauuuuugauguc

SEQ ID NO: 3839 - RNA, 21 nt, Artificial Sequence
  Ebola virus siRNA sense strand
caggaagaauuuuugaugucu

SEQ ID NO: 3840 - RNA, 21 nt, Artificial Sequence
  Ebola virus siRNA sense strand
aggaagaauuuuugaugucua

SEQ ID NO: 3841 - RNA, 21 nt, Artificial Sequence
  Ebola virus siRNA sense strand
ggaagaauuuuugaugucuaa

SEQ ID NO: 3842 - RNA, 21 nt, Artificial Sequence
  Ebola virus siRNA sense strand
gaagaauuuuugaugucuaag

SEQ ID NO: 3843 - RNA, 21 nt, Artificial Sequence
  Ebola virus siRNA sense strand
aagaauuuuugaugucuaagg

SEQ ID NO: 3844 - RNA, 21 nt, Artificial Sequence
  Ebola virus siRNA sense strand
agaauuuuugaugucuaaggu

SEQ ID NO: 3845 - RNA, 21 nt, Artificial Sequence
  Ebola virus siRNA sense strand
gaauuuuugaugucuaaggug

SEQ ID NO: 3846 - RNA, 21 nt, Artificial Sequence
  Ebola virus siRNA sense strand
aauuuuugaugucuaaggugu

SEQ ID NO: 3847 - RNA, 21 nt, Artificial Sequence
  Ebola virus siRNA sense strand
auuuuugaugucuaaggugug

SEQ ID NO: 3848 - RNA, 21 nt, Artificial Sequence
  Ebola virus siRNA sense strand
uuuuugaugucuaagguguga

SEQ ID NO: 3849 - RNA, 21 nt, Artificial Sequence
  Ebola virus siRNA sense strand
uuuugaugucuaaggugugaa

SEQ ID NO: 3850 - RNA, 21 nt, Artificial Sequence
  Ebola virus siRNA sense strand
uuugaugucuaaggugugaau

SEQ ID NO: 3851 - RNA, 21 nt, Artificial Sequence
  Ebola virus siRNA sense strand
uugaugucuaaggugugaauu

SEQ ID NO: 3852 - RNA, 21 nt, Artificial Sequence
  Ebola virus siRNA sense strand
ugaugucuaaggugugaauua

SEQ ID NO: 3853 - RNA, 21 nt, Artificial Sequence
  Ebola virus siRNA sense strand
gaugucuaaggugugaauuau

SEQ ID NO: 3854 - RNA, 21 nt, Artificial Sequence
  Ebola virus siRNA sense strand
augucuaaggugugaauuauu

SEQ ID NO: 3855 - RNA, 21 nt, Artificial Sequence
  Ebola virus siRNA sense strand
ugucuaaggugugaauuauua

SEQ ID NO: 3856 - RNA, 21 nt, Artificial Sequence
  Ebola virus siRNA sense strand
gucuaaggugugaauuauuau

SEQ ID NO: 3857 - RNA, 21 nt, Artificial Sequence
  Ebola virus siRNA sense strand
ucuaaggugugaauuauuauc

SEQ ID NO: 3858 - RNA, 21 nt, Artificial Sequence
  Ebola virus siRNA sense strand
cuaaggugugaauuauuauca

SEQ ID NO: 3859 - RNA, 21 nt, Artificial Sequence
  Ebola virus siRNA sense strand
uaaggugugaauuauuaucac

SEQ ID NO: 3860 - RNA, 21 nt, Artificial Sequence
  Ebola virus siRNA sense strand
aaggugugaauuauuaucaca

SEQ ID NO: 3861 - RNA, 21 nt, Artificial Sequence
  Ebola virus siRNA sense strand
aggugugaauuauuaucacaa

SEQ ID NO: 3862 - RNA, 21 nt, Artificial Sequence
  Ebola virus siRNA sense strand
ggugugaauuauuaucacaau

SEQ ID NO: 3863 - RNA, 21 nt, Artificial Sequence
  Ebola virus siRNA sense strand
gugugaauuauuaucacaaua

SEQ ID NO: 3864 - RNA, 21 nt, Artificial Sequence
  Ebola virus siRNA sense strand
ugugaauuauuaucacaauaa

SEQ ID NO: 3865 - RNA, 21 nt, Artificial Sequence
  Ebola virus siRNA sense strand
gugaauuauuaucacaauaaa

SEQ ID NO: 3866 - RNA, 21 nt, Artificial Sequence
  Ebola virus siRNA sense strand
ugaauuauuaucacaauaaaa

SEQ ID NO: 3867 - RNA, 21 nt, Artificial Sequence
  Ebola virus siRNA sense strand
gaauuauuaucacaauaaaag

SEQ ID NO: 3868 - RNA, 21 nt, Artificial Sequence
  Ebola virus siRNA sense strand
aauuauuaucacaauaaaagu

SEQ ID NO: 3869 - RNA, 21 nt, Artificial Sequence
  Ebola virus siRNA sense strand
auuauuaucacaauaaaagug

SEQ ID NO: 3870 - RNA, 21 nt, Artificial Sequence
  Ebola virus siRNA sense strand
uuauuaucacaauaaaaguga

SEQ ID NO: 3871 - RNA, 21 nt, Artificial Sequence
  Ebola virus siRNA sense strand
uauuaucacaauaaaagugau

SEQ ID NO: 3872 - RNA, 21 nt, Artificial Sequence
  Ebola virus siRNA sense strand
auuaucacaauaaaagugauu

SEQ ID NO: 3873 - RNA, 21 nt, Artificial Sequence
  Ebola virus siRNA sense strand
uuaucacaauaaaagugauuc

SEQ ID NO: 3874 - RNA, 21 nt, Artificial Sequence
  Ebola virus siRNA sense strand
uaucacaauaaaagugauucu

SEQ ID NO: 3875 - RNA, 21 nt, Artificial Sequence
  Ebola virus siRNA sense strand
aucacaauaaaagugauucuu

SEQ ID NO: 3876 - RNA, 21 nt, Artificial Sequence
  Ebola virus siRNA sense strand
ucacaauaaaagugauucuua

SEQ ID NO: 3877 - RNA, 21 nt, Artificial Sequence
  Ebola virus siRNA sense strand
cacaauaaaagugauucuuau

SEQ ID NO: 3878 - RNA, 21 nt, Artificial Sequence
  Ebola virus siRNA sense strand
acaauaaaagugauucuuauu

SEQ ID NO: 3879 - RNA, 21 nt, Artificial Sequence
  Ebola virus siRNA sense strand
caauaaaagugauucuuauuu

SEQ ID NO: 3880 - RNA, 21 nt, Artificial Sequence
  Ebola virus siRNA sense strand
aauaaaagugauucuuauuuu

SEQ ID NO: 3881 - RNA, 21 nt, Artificial Sequence
  Ebola virus siRNA sense strand
auaaaagugauucuuauuuuu

SEQ ID NO: 3882 - RNA, 21 nt, Artificial Sequence
  Ebola virus siRNA sense strand
uaaaagugauucuuauuuuug

SEQ ID NO: 3883 - RNA, 21 nt, Artificial Sequence
  Ebola virus siRNA sense strand
aaaagugauucuuauuuuuga

SEQ ID NO: 3884 - RNA, 21 nt, Artificial Sequence
  Ebola virus siRNA sense strand
aaagugauucuuauuuuugaa

SEQ ID NO: 3885 - RNA, 21 nt, Artificial Sequence
  Ebola virus siRNA sense strand
aagugauucuuauuuuugaau

SEQ ID NO: 3886 - RNA, 21 nt, Artificial Sequence
  Ebola virus siRNA sense strand
agugauucuuauuuuugaauu

SEQ ID NO: 3887 - RNA, 21 nt, Artificial Sequence
  Ebola virus siRNA sense strand
gugauucuuauuuuugaauuu

SEQ ID NO: 3888 - RNA, 21 nt, Artificial Sequence
  Ebola virus siRNA sense strand
ugauucuuauuuuugaauuua

SEQ ID NO: 3889 - RNA, 21 nt, Artificial Sequence
  Ebola virus siRNA sense strand
gauucuuauuuuugaauuuaa

SEQ ID NO: 3890 - RNA, 21 nt, Artificial Sequence
  Ebola virus siRNA sense strand
auucuuauuuuugaauuuaaa

SEQ ID NO: 3891 - RNA, 21 nt, Artificial Sequence
  Ebola virus siRNA sense strand
uucuuauuuuugaauuuaaag

SEQ ID NO: 3892 - RNA, 21 nt, Artificial Sequence
  Ebola virus siRNA sense strand
ucuuauuuuugaauuuaaagc

SEQ ID NO: 3893 - RNA, 21 nt, Artificial Sequence
  Ebola virus siRNA sense strand
cuuauuuuugaauuuaaagcu

SEQ ID NO: 3894 - RNA, 21 nt, Artificial Sequence
  Ebola virus siRNA sense strand
uuauuuuugaauuuaaagcua

SEQ ID NO: 3895 - RNA, 21 nt, Artificial Sequence
  Ebola virus siRNA sense strand
uauuuuugaauuuaaagcuag

SEQ ID NO: 3896 - RNA, 21 nt, Artificial Sequence
  Ebola virus siRNA sense strand
auuuuugaauuuaaagcuagc

SEQ ID NO: 3897 - RNA, 21 nt, Artificial Sequence
  Ebola virus siRNA sense strand
uuuuugaauuuaaagcuagcu

SEQ ID NO: 3898 - RNA, 21 nt, Artificial Sequence
  Ebola virus siRNA sense strand
uuuugaauuuaaagcuagcuu

SEQ ID NO: 3899 - RNA, 21 nt, Artificial Sequence
  Ebola virus siRNA sense strand
uuugaauuuaaagcuagcuua

SEQ ID NO: 3900 - RNA, 21 nt, Artificial Sequence
  Ebola virus siRNA sense strand
uugaauuuaaagcuagcuuau

SEQ ID NO: 3901 - RNA, 21 nt, Artificial Sequence
  Ebola virus siRNA sense strand
ugaauuuaaagcuagcuuauu

SEQ ID NO: 3902 - RNA, 21 nt, Artificial Sequence
  Ebola virus siRNA sense strand
gaauuuaaagcuagcuuauua

SEQ ID NO: 3903 - RNA, 21 nt, Artificial Sequence
  Ebola virus siRNA sense strand
aauuuaaagcuagcuuauuau

SEQ ID NO: 3904 - RNA, 21 nt, Artificial Sequence
  Ebola virus siRNA sense strand
auuuaaagcuagcuuauuauu

SEQ ID NO: 3905 - RNA, 21 nt, Artificial Sequence
  Ebola virus siRNA sense strand
uuuaaagcuagcuuauuauua

SEQ ID NO: 3906 - RNA, 21 nt, Artificial Sequence
  Ebola virus siRNA sense strand
uuaaagcuagcuuauuauuac

SEQ ID NO: 3907 - RNA, 21 nt, Artificial Sequence
  Ebola virus siRNA sense strand
uaaagcuagcuuauuauuacu

SEQ ID NO: 3908 - RNA, 21 nt, Artificial Sequence
  Ebola virus siRNA sense strand
aaagcuagcuuauuauuacua

SEQ ID NO: 3909 - RNA, 21 nt, Artificial Sequence
  Ebola virus siRNA sense strand
aagcuagcuuauuauuacuag

SEQ ID NO: 3910 - RNA, 21 nt, Artificial Sequence
  Ebola virus siRNA sense strand
agcuagcuuauuauuacuagc

SEQ ID NO: 3911 - RNA, 21 nt, Artificial Sequence
  Ebola virus siRNA sense strand
gcuagcuuauuauuacuagcc

SEQ ID NO: 3912 - RNA, 21 nt, Artificial Sequence
  Ebola virus siRNA sense strand
cuagcuuauuauuacuagccg

SEQ ID NO: 3913 - RNA, 21 nt, Artificial Sequence
  Ebola virus siRNA sense strand
uagcuuauuauuacuagccgu

SEQ ID NO: 3914 - RNA, 21 nt, Artificial Sequence
  Ebola virus siRNA sense strand
agcuuauuauuacuagccguu

SEQ ID NO: 3915 - RNA, 21 nt, Artificial Sequence
  Ebola virus siRNA sense strand
gcuuauuauuacuagccguuu

SEQ ID NO: 3916 - RNA, 21 nt, Artificial Sequence
  Ebola virus siRNA sense strand
cuuauuauuacuagccguuuu

SEQ ID NO: 3917 - RNA, 21 nt, Artificial Sequence
  Ebola virus siRNA sense strand
uuauuauuacuagccguuuuu

SEQ ID NO: 3918 - RNA, 21 nt, Artificial Sequence
  Ebola virus siRNA sense strand
uauuauuacuagccguuuuuc

SEQ ID NO: 3919 - RNA, 21 nt, Artificial Sequence
  Ebola virus siRNA sense strand
auuauuacuagccguuuuuca

SEQ ID NO: 3920 - RNA, 21 nt, Artificial Sequence
  Ebola virus siRNA sense strand
uuauuacuagccguuuuucaa

SEQ ID NO: 3921 - RNA, 21 nt, Artificial Sequence
  Ebola virus siRNA sense strand
uauuacuagccguuuuucaaa

SEQ ID NO: 3922 - RNA, 21 nt, Artificial Sequence
  Ebola virus siRNA sense strand
auuacuagccguuuuucaaag

SEQ ID NO: 3923 - RNA, 21 nt, Artificial Sequence
  Ebola virus siRNA sense strand
uuacuagccguuuuucaaagu

SEQ ID NO: 3924 - RNA, 21 nt, Artificial Sequence
  Ebola virus siRNA sense strand
uacuagccguuuuucaaaguu

SEQ ID NO: 3925 - RNA, 21 nt, Artificial Sequence
  Ebola virus siRNA sense strand
acuagccguuuuucaaaguuc

SEQ ID NO: 3926 - RNA, 21 nt, Artificial Sequence
  Ebola virus siRNA sense strand
cuagccguuuuucaaaguuca

SEQ ID NO: 3927 - RNA, 21 nt, Artificial Sequence
  Ebola virus siRNA sense strand
uagccguuuuucaaaguucaa

SEQ ID NO: 3928 - RNA, 21 nt, Artificial Sequence
  Ebola virus siRNA sense strand
agccguuuuucaaaguucaau

SEQ ID NO: 3929 - RNA, 21 nt, Artificial Sequence
  Ebola virus siRNA sense strand
gccguuuuucaaaguucaauu

SEQ ID NO: 3930 - RNA, 21 nt, Artificial Sequence
  Ebola virus siRNA sense strand
ccguuuuucaaaguucaauuu

SEQ ID NO: 3931 - RNA, 21 nt, Artificial Sequence
  Ebola virus siRNA sense strand
cguuuuucaaaguucaauuug

SEQ ID NO: 3932 - RNA, 21 nt, Artificial Sequence
  Ebola virus siRNA sense strand
guuuuucaaaguucaauuuga

SEQ ID NO: 3933 - RNA, 21 nt, Artificial Sequence
  Ebola virus siRNA sense strand
uuuuucaaaguucaauuugag

SEQ ID NO: 3934 - RNA, 21 nt, Artificial Sequence
  Ebola virus siRNA sense strand
uuuucaaaguucaauuugagu

SEQ ID NO: 3935 - RNA, 21 nt, Artificial Sequence
  Ebola virus siRNA sense strand
uuucaaaguucaauuugaguc

SEQ ID NO: 3936 - RNA, 21 nt, Artificial Sequence
  Ebola virus siRNA sense strand
uucaaaguucaauuugagucu

SEQ ID NO: 3937 - RNA, 21 nt, Artificial Sequence
  Ebola virus siRNA sense strand
ucaaaguucaauuugagucuu

SEQ ID NO: 3938 - RNA, 21 nt, Artificial Sequence
  Ebola virus siRNA sense strand
caaaguucaauuugagucuua

SEQ ID NO: 3939 - RNA, 21 nt, Artificial Sequence
  Ebola virus siRNA sense strand
aaaguucaauuugagucuuaa

SEQ ID NO: 3940 - RNA, 21 nt, Artificial Sequence
  Ebola virus siRNA sense strand
aaguucaauuugagucuuaau

SEQ ID NO: 3941 - RNA, 21 nt, Artificial Sequence
  Ebola virus siRNA sense strand
aguucaauuugagucuuaaug

SEQ ID NO: 3942 - RNA, 21 nt, Artificial Sequence
  Ebola virus siRNA sense strand
guucaauuugagucuuaaugc

SEQ ID NO: 3943 - RNA, 21 nt, Artificial Sequence
  Ebola virus siRNA sense strand
uucaauuugagucuuaaugca

SEQ ID NO: 3944 - RNA, 21 nt, Artificial Sequence
  Ebola virus siRNA sense strand
ucaauuugagucuuaaugcaa

SEQ ID NO: 3945 - RNA, 21 nt, Artificial Sequence
  Ebola virus siRNA sense strand
caauuugagucuuaaugcaaa

SEQ ID NO: 3946 - RNA, 21 nt, Artificial Sequence
  Ebola virus siRNA sense strand
aauuugagucuuaaugcaaau

SEQ ID NO: 3947 - RNA, 21 nt, Artificial Sequence
  Ebola virus siRNA sense strand
auuugagucuuaaugcaaaua

SEQ ID NO: 3948 - RNA, 21 nt, Artificial Sequence
  Ebola virus siRNA sense strand
uuugagucuuaaugcaaauag

SEQ ID NO: 3949 - RNA, 21 nt, Artificial Sequence
  Ebola virus siRNA sense strand
uugagucuuaaugcaaauagg

SEQ ID NO: 3950 - RNA, 21 nt, Artificial Sequence
  Ebola virus siRNA sense strand
ugagucuuaaugcaaauaggc

SEQ ID NO: 3951 - RNA, 21 nt, Artificial Sequence
  Ebola virus siRNA sense strand
gagucuuaaugcaaauaggcg

SEQ ID NO: 3952 - RNA, 21 nt, Artificial Sequence
  Ebola virus siRNA sense strand
agucuuaaugcaaauaggcgu

SEQ ID NO: 3953 - RNA, 21 nt, Artificial Sequence
  Ebola virus siRNA sense strand
gucuuaaugcaaauaggcguu

SEQ ID NO: 3954 - RNA, 21 nt, Artificial Sequence
  Ebola virus siRNA sense strand
ucuuaaugcaaauaggcguua

SEQ ID NO: 3955 - RNA, 21 nt, Artificial Sequence
  Ebola virus siRNA sense strand
cuuaaugcaaauaggcguuaa

SEQ ID NO: 3956 - RNA, 21 nt, Artificial Sequence
  Ebola virus siRNA sense strand
uuaaugcaaauaggcguuaag

SEQ ID NO: 3957 - RNA, 21 nt, Artificial Sequence
  Ebola virus siRNA sense strand
uaaugcaaauaggcguuaagc

SEQ ID NO: 3958 - RNA, 21 nt, Artificial Sequence
  Ebola virus siRNA sense strand
aaugcaaauaggcguuaagcc

SEQ ID NO: 3959 - RNA, 21 nt, Artificial Sequence
  Ebola virus siRNA sense strand
augcaaauaggcguuaagcca

SEQ ID NO: 3960 - RNA, 21 nt, Artificial Sequence
  Ebola virus siRNA sense strand
ugcaaauaggcguuaagccac

SEQ ID NO: 3961 - RNA, 21 nt, Artificial Sequence
  Ebola virus siRNA sense strand
gcaaauaggcguuaagccaca

SEQ ID NO: 3962 - RNA, 21 nt, Artificial Sequence
  Ebola virus siRNA sense strand
caaauaggcguuaagccacag

SEQ ID NO: 3963 - RNA, 21 nt, Artificial Sequence
  Ebola virus siRNA sense strand
aaauaggcguuaagccacagu

SEQ ID NO: 3964 - RNA, 21 nt, Artificial Sequence
  Ebola virus siRNA sense strand
aauaggcguuaagccacaguu

SEQ ID NO: 3965 - RNA, 21 nt, Artificial Sequence
  Ebola virus siRNA sense strand
auaggcguuaagccacaguua

SEQ ID NO: 3966 - RNA, 21 nt, Artificial Sequence
  Ebola virus siRNA sense strand
uaggcguuaagccacaguuau

SEQ ID NO: 3967 - RNA, 21 nt, Artificial Sequence
  Ebola virus siRNA sense strand
aggcguuaagccacaguuaua

SEQ ID NO: 3968 - RNA, 21 nt, Artificial Sequence
  Ebola virus siRNA sense strand
ggcguuaagccacaguuauag

SEQ ID NO: 3969 - RNA, 21 nt, Artificial Sequence
  Ebola virus siRNA sense strand
gcguuaagccacaguuauagc

SEQ ID NO: 3970 - RNA, 21 nt, Artificial Sequence
  Ebola virus siRNA sense strand
cguuaagccacaguuauagcc

SEQ ID NO: 3971 - RNA, 21 nt, Artificial Sequence
  Ebola virus siRNA sense strand
guuaagccacaguuauagcca

SEQ ID NO: 3972 - RNA, 21 nt, Artificial Sequence
  Ebola virus siRNA sense strand
uuaagccacaguuauagccau

SEQ ID NO: 3973 - RNA, 21 nt, Artificial Sequence
  Ebola virus siRNA sense strand
uaagccacaguuauagccaua

SEQ ID NO: 3974 - RNA, 21 nt, Artificial Sequence
  Ebola virus siRNA sense strand
aagccacaguuauagccauaa

SEQ ID NO: 3975 - RNA, 21 nt, Artificial Sequence
  Ebola virus siRNA sense strand
agccacaguuauagccauaau

SEQ ID NO: 3976 - RNA, 21 nt, Artificial Sequence
  Ebola virus siRNA sense strand
gccacaguuauagccauaauu

SEQ ID NO: 3977 - RNA, 21 nt, Artificial Sequence
  Ebola virus siRNA sense strand
ccacaguuauagccauaauug

SEQ ID NO: 3978 - RNA, 21 nt, Artificial Sequence
  Ebola virus siRNA sense strand
cacaguuauagccauaauugu

SEQ ID NO: 3979 - RNA, 21 nt, Artificial Sequence
  Ebola virus siRNA sense strand
acaguuauagccauaauugua

SEQ ID NO: 3980 - RNA, 21 nt, Artificial Sequence
  Ebola virus siRNA sense strand
caguuauagccauaauuguaa

SEQ ID NO: 3981 - RNA, 21 nt, Artificial Sequence
  Ebola virus siRNA sense strand
aguuauagccauaauuguaac

SEQ ID NO: 3982 - RNA, 21 nt, Artificial Sequence
  Ebola virus siRNA sense strand
guuauagccauaauuguaacu

SEQ ID NO: 3983 - RNA, 21 nt, Artificial Sequence
  Ebola virus siRNA sense strand
uuauagccauaauuguaacuc

SEQ ID NO: 3984 - RNA, 21 nt, Artificial Sequence
  Ebola virus siRNA sense strand
uauagccauaauuguaacuca

SEQ ID NO: 3985 - RNA, 21 nt, Artificial Sequence
  Ebola virus siRNA sense strand
auagccauaauuguaacucaa

SEQ ID NO: 3986 - RNA, 21 nt, Artificial Sequence
  Ebola virus siRNA sense strand
uagccauaauuguaacucaau

SEQ ID NO: 3987 - RNA, 21 nt, Artificial Sequence
  Ebola virus siRNA sense strand
agccauaauuguaacucaaua

SEQ ID NO: 3988 - RNA, 21 nt, Artificial Sequence
  Ebola virus siRNA sense strand
gccauaauuguaacucaauau

SEQ ID NO: 3989 - RNA, 21 nt, Artificial Sequence
  Ebola virus siRNA sense strand
ccauaauuguaacucaauauu

SEQ ID NO: 3990 - RNA, 21 nt, Artificial Sequence
  Ebola virus siRNA sense strand
cauaauuguaacucaauauuc

SEQ ID NO: 3991 - RNA, 21 nt, Artificial Sequence
  Ebola virus siRNA sense strand
auaauuguaacucaauauucu

SEQ ID NO: 3992 - RNA, 21 nt, Artificial Sequence
  Ebola virus siRNA sense strand
uaauuguaacucaauauucua

SEQ ID NO: 3993 - RNA, 21 nt, Artificial Sequence
  Ebola virus siRNA sense strand
aauuguaacucaauauucuaa

SEQ ID NO: 3994 - RNA, 21 nt, Artificial Sequence
  Ebola virus siRNA sense strand
auuguaacucaauauucuaac

SEQ ID NO: 3995 - RNA, 21 nt, Artificial Sequence
  Ebola virus siRNA sense strand
uuguaacucaauauucuaacu

SEQ ID NO: 3996 - RNA, 21 nt, Artificial Sequence
  Ebola virus siRNA sense strand
uguaacucaauauucuaacua

SEQ ID NO: 3997 - RNA, 21 nt, Artificial Sequence
  Ebola virus siRNA sense strand
guaacucaauauucuaacuag

SEQ ID NO: 3998 - RNA, 21 nt, Artificial Sequence
  Ebola virus siRNA sense strand
uaacucaauauucuaacuagc

SEQ ID NO: 3999 - RNA, 21 nt, Artificial Sequence
  Ebola virus siRNA sense strand
aacucaauauucuaacuagcg

SEQ ID NO: 4000 - RNA, 21 nt, Artificial Sequence
  Ebola virus siRNA sense strand
acucaauauucuaacuagcga

SEQ ID NO: 4001 - RNA, 21 nt, Artificial Sequence
  Ebola virus siRNA sense strand
cucaauauucuaacuagcgau

SEQ ID NO: 4002 - RNA, 21 nt, Artificial Sequence
  Ebola virus siRNA sense strand
ucaauauucuaacuagcgauu

SEQ ID NO: 4003 - RNA, 21 nt, Artificial Sequence
  Ebola virus siRNA sense strand
caauauucuaacuagcgauuu

SEQ ID NO: 4004 - RNA, 21 nt, Artificial Sequence
  Ebola virus siRNA sense strand
aauauucuaacuagcgauuua

SEQ ID NO: 4005 - RNA, 21 nt, Artificial Sequence
  Ebola virus siRNA sense strand
auauucuaacuagcgauuuau

SEQ ID NO: 4006 - RNA, 21 nt, Artificial Sequence
  Ebola virus siRNA sense strand
uauucuaacuagcgauuuauc

SEQ ID NO: 4007 - RNA, 21 nt, Artificial Sequence
  Ebola virus siRNA sense strand
auucuaacuagcgauuuaucu

SEQ ID NO: 4008 - RNA, 21 nt, Artificial Sequence
  Ebola virus siRNA sense strand
uucuaacuagcgauuuaucua

SEQ ID NO: 4009 - RNA, 21 nt, Artificial Sequence
  Ebola virus siRNA sense strand
ucuaacuagcgauuuaucuaa

SEQ ID NO: 4010 - RNA, 21 nt, Artificial Sequence
  Ebola virus siRNA sense strand
cuaacuagcgauuuaucuaaa

SEQ ID NO: 4011 - RNA, 21 nt, Artificial Sequence
  Ebola virus siRNA sense strand
uaacuagcgauuuaucuaaau

SEQ ID NO: 4012 - RNA, 21 nt, Artificial Sequence
  Ebola virus siRNA sense strand
aacuagcgauuuaucuaaauu

SEQ ID NO: 4013 - RNA, 21 nt, Artificial Sequence
  Ebola virus siRNA sense strand
acuagcgauuuaucuaaauua

SEQ ID NO: 4014 - RNA, 21 nt, Artificial Sequence
  Ebola virus siRNA sense strand
cuagcgauuuaucuaaauuaa

SEQ ID NO: 4015 - RNA, 21 nt, Artificial Sequence
  Ebola virus siRNA sense strand
uagcgauuuaucuaaauuaaa

SEQ ID NO: 4016 - RNA, 21 nt, Artificial Sequence
  Ebola virus siRNA sense strand
agcgauuuaucuaaauuaaau

SEQ ID NO: 4017 - RNA, 21 nt, Artificial Sequence
  Ebola virus siRNA sense strand
gcgauuuaucuaaauuaaauu

SEQ ID NO: 4018 - RNA, 21 nt, Artificial Sequence
  Ebola virus siRNA sense strand
cgauuuaucuaaauuaaauua

SEQ ID NO: 4019 - RNA, 21 nt, Artificial Sequence
  Ebola virus siRNA sense strand
gauuuaucuaaauuaaauuac

SEQ ID NO: 4020 - RNA, 21 nt, Artificial Sequence
  Ebola virus siRNA sense strand
auuuaucuaaauuaaauuaca

SEQ ID NO: 4021 - RNA, 21 nt, Artificial Sequence
  Ebola virus siRNA sense strand
uuuaucuaaauuaaauuacau

SEQ ID NO: 4022 - RNA, 21 nt, Artificial Sequence
  Ebola virus siRNA sense strand
uuaucuaaauuaaauuacauu

SEQ ID NO: 4023 - RNA, 21 nt, Artificial Sequence
  Ebola virus siRNA sense strand
uaucuaaauuaaauuacauua

SEQ ID NO: 4024 - RNA, 21 nt, Artificial Sequence
  Ebola virus siRNA sense strand
aucuaaauuaaauuacauuau

SEQ ID NO: 4025 - RNA, 21 nt, Artificial Sequence
  Ebola virus siRNA sense strand
ucuaaauuaaauuacauuaug

SEQ ID NO: 4026 - RNA, 21 nt, Artificial Sequence
  Ebola virus siRNA sense strand
cuaaauuaaauuacauuaugc

SEQ ID NO: 4027 - RNA, 21 nt, Artificial Sequence
  Ebola virus siRNA sense strand
uaaauuaaauuacauuaugcu

SEQ ID NO: 4028 - RNA, 21 nt, Artificial Sequence
  Ebola virus siRNA sense strand
aaauuaaauuacauuaugcuu

SEQ ID NO: 4029 - RNA, 21 nt, Artificial Sequence
  Ebola virus siRNA sense strand
aauuaaauuacauuaugcuuu

SEQ ID NO: 4030 - RNA, 21 nt, Artificial Sequence
  Ebola virus siRNA sense strand
auuaaauuacauuaugcuuuu

SEQ ID NO: 4031 - RNA, 21 nt, Artificial Sequence
  Ebola virus siRNA sense strand
uuaaauuacauuaugcuuuua

SEQ ID NO: 4032 - RNA, 21 nt, Artificial Sequence
  Ebola virus siRNA sense strand
uaaauuacauuaugcuuuuau

SEQ ID NO: 4033 - RNA, 21 nt, Artificial Sequence
  Ebola virus siRNA sense strand
aaauuacauuaugcuuuuaua

SEQ ID NO: 4034 - RNA, 21 nt, Artificial Sequence
  Ebola virus siRNA sense strand
aauuacauuaugcuuuuauaa

SEQ ID NO: 4035 - RNA, 21 nt, Artificial Sequence
  Ebola virus siRNA sense strand
auuacauuaugcuuuuauaac

SEQ ID NO: 4036 - RNA, 21 nt, Artificial Sequence
  Ebola virus siRNA sense strand
uuacauuaugcuuuuauaacu

SEQ ID NO: 4037 - RNA, 21 nt, Artificial Sequence
  Ebola virus siRNA sense strand
uacauuaugcuuuuauaacuu

SEQ ID NO: 4038 - RNA, 21 nt, Artificial Sequence
  Ebola virus siRNA sense strand
acauuaugcuuuuauaacuua

SEQ ID NO: 4039 - RNA, 21 nt, Artificial Sequence
  Ebola virus siRNA sense strand
cauuaugcuuuuauaacuuac

SEQ ID NO: 4040 - RNA, 21 nt, Artificial Sequence
  Ebola virus siRNA sense strand
auuaugcuuuuauaacuuacc

SEQ ID NO: 4041 - RNA, 21 nt, Artificial Sequence
  Ebola virus siRNA sense strand
uuaugcuuuuauaacuuaccu

SEQ ID NO: 4042 - RNA, 21 nt, Artificial Sequence
  Ebola virus siRNA sense strand
uaugcuuuuauaacuuaccua

SEQ ID NO: 4043 - RNA, 21 nt, Artificial Sequence
  Ebola virus siRNA sense strand
augcuuuuauaacuuaccuac

SEQ ID NO: 4044 - RNA, 21 nt, Artificial Sequence
  Ebola virus siRNA sense strand
ugcuuuuauaacuuaccuacu

SEQ ID NO: 4045 - RNA, 21 nt, Artificial Sequence
  Ebola virus siRNA sense strand
gcuuuuauaacuuaccuacua

SEQ ID NO: 4046 - RNA, 21 nt, Artificial Sequence
  Ebola virus siRNA sense strand
cuuuuauaacuuaccuacuag

SEQ ID NO: 4047 - RNA, 21 nt, Artificial Sequence
  Ebola virus siRNA sense strand
uuuuauaacuuaccuacuagc

SEQ ID NO: 4048 - RNA, 21 nt, Artificial Sequence
  Ebola virus siRNA sense strand
uuuauaacuuaccuacuagcc

SEQ ID NO: 4049 - RNA, 21 nt, Artificial Sequence
  Ebola virus siRNA sense strand
uuauaacuuaccuacuagccu

SEQ ID NO: 4050 - RNA, 21 nt, Artificial Sequence
  Ebola virus siRNA sense strand
uauaacuuaccuacuagccug

SEQ ID NO: 4051 - RNA, 21 nt, Artificial Sequence
  Ebola virus siRNA sense strand
auaacuuaccuacuagccugc

SEQ ID NO: 4052 - RNA, 21 nt, Artificial Sequence
  Ebola virus siRNA sense strand
uaacuuaccuacuagccugcc

SEQ ID NO: 4053 - RNA, 21 nt, Artificial Sequence
  Ebola virus siRNA sense strand
aacuuaccuacuagccugccc

SEQ ID NO: 4054 - RNA, 21 nt, Artificial Sequence
  Ebola virus siRNA sense strand
acuuaccuacuagccugccca

SEQ ID NO: 4055 - RNA, 21 nt, Artificial Sequence
  Ebola virus siRNA sense strand
cuuaccuacuagccugcccaa

SEQ ID NO: 4056 - RNA, 21 nt, Artificial Sequence
  Ebola virus siRNA sense strand
uuaccuacuagccugcccaac

SEQ ID NO: 4057 - RNA, 21 nt, Artificial Sequence
  Ebola virus siRNA sense strand
uaccuacuagccugcccaaca

SEQ ID NO: 4058 - RNA, 21 nt, Artificial Sequence
  Ebola virus siRNA sense strand
accuacuagccugcccaacau

SEQ ID NO: 4059 - RNA, 21 nt, Artificial Sequence
  Ebola virus siRNA sense strand
ccuacuagccugcccaacauu

SEQ ID NO: 4060 - RNA, 21 nt, Artificial Sequence
  Ebola virus siRNA sense strand
cuacuagccugcccaacauuu

SEQ ID NO: 4061 - RNA, 21 nt, Artificial Sequence
  Ebola virus siRNA sense strand
uacuagccugcccaacauuua

SEQ ID NO: 4062 - RNA, 21 nt, Artificial Sequence
  Ebola virus siRNA sense strand
acuagccugcccaacauuuac

SEQ ID NO: 4063 - RNA, 21 nt, Artificial Sequence
  Ebola virus siRNA sense strand
cuagccugcccaacauuuaca

SEQ ID NO: 4064 - RNA, 21 nt, Artificial Sequence
  Ebola virus siRNA sense strand
uagccugcccaacauuuacac

SEQ ID NO: 4065 - RNA, 21 nt, Artificial Sequence
  Ebola virus siRNA sense strand
agccugcccaacauuuacacg

SEQ ID NO: 4066 - RNA, 21 nt, Artificial Sequence
  Ebola virus siRNA sense strand
gccugcccaacauuuacacga

SEQ ID NO: 4067 - RNA, 21 nt, Artificial Sequence
  Ebola virus siRNA sense strand
ccugcccaacauuuacacgau

SEQ ID NO: 4068 - RNA, 21 nt, Artificial Sequence
  Ebola virus siRNA sense strand
cugcccaacauuuacacgauc

SEQ ID NO: 4069 - RNA, 21 nt, Artificial Sequence
  Ebola virus siRNA sense strand
ugcccaacauuuacacgaucg

SEQ ID NO: 4070 - RNA, 21 nt, Artificial Sequence
  Ebola virus siRNA sense strand
gcccaacauuuacacgaucgu

SEQ ID NO: 4071 - RNA, 21 nt, Artificial Sequence
  Ebola virus siRNA sense strand
cccaacauuuacacgaucguu

SEQ ID NO: 4072 - RNA, 21 nt, Artificial Sequence
  Ebola virus siRNA sense strand
ccaacauuuacacgaucguuu

SEQ ID NO: 4073 - RNA, 21 nt, Artificial Sequence
  Ebola virus siRNA sense strand
caacauuuacacgaucguuuu

SEQ ID NO: 4074 - RNA, 21 nt, Artificial Sequence
  Ebola virus siRNA sense strand
aacauuuacacgaucguuuua

SEQ ID NO: 4075 - RNA, 21 nt, Artificial Sequence
  Ebola virus siRNA sense strand
acauuuacacgaucguuuuau

SEQ ID NO: 4076 - RNA, 21 nt, Artificial Sequence
  Ebola virus siRNA sense strand
cauuuacacgaucguuuuaua

SEQ ID NO: 4077 - RNA, 21 nt, Artificial Sequence
  Ebola virus siRNA sense strand
auuuacacgaucguuuuauaa

SEQ ID NO: 4078 - RNA, 21 nt, Artificial Sequence
  Ebola virus siRNA sense strand
uuuacacgaucguuuuauaau

SEQ ID NO: 4079 - RNA, 21 nt, Artificial Sequence
  Ebola virus siRNA sense strand
uuacacgaucguuuuauaauu

SEQ ID NO: 4080 - RNA, 21 nt, Artificial Sequence
  Ebola virus siRNA sense strand
uacacgaucguuuuauaauua

SEQ ID NO: 4081 - RNA, 21 nt, Artificial Sequence
  Ebola virus siRNA sense strand
acacgaucguuuuauaauuaa

SEQ ID NO: 4082 - RNA, 21 nt, Artificial Sequence
  Ebola virus siRNA sense strand
cacgaucguuuuauaauuaag

SEQ ID NO: 4083 - RNA, 21 nt, Artificial Sequence
  Ebola virus siRNA sense strand
acgaucguuuuauaauuaaga

SEQ ID NO: 4084 - RNA, 21 nt, Artificial Sequence
  Ebola virus siRNA sense strand
cgaucguuuuauaauuaagaa

SEQ ID NO: 4085 - RNA, 21 nt, Artificial Sequence
  Ebola virus siRNA sense strand
gaucguuuuauaauuaagaaa

SEQ ID NO: 4086 - RNA, 21 nt, Artificial Sequence
  Ebola virus siRNA sense strand
aucguuuuauaauuaagaaaa

SEQ ID NO: 4087 - RNA, 21 nt, Artificial Sequence
  Ebola virus siRNA sense strand
ucguuuuauaauuaagaaaaa

SEQ ID NO: 4088 - RNA, 21 nt, Artificial Sequence
  Ebola virus siRNA sense strand
cguuuuauaauuaagaaaaaa

SEQ ID NO: 4089 - RNA, 21 nt, Artificial Sequence
  Ebola virus siRNA sense strand
guuuuauaauuaagaaaaaac

SEQ ID NO: 4090 - RNA, 21 nt, Artificial Sequence
  Ebola virus siRNA sense strand
uuuuauaauuaagaaaaaacu

SEQ ID NO: 4091 - RNA, 21 nt, Artificial Sequence
  Ebola virus siRNA sense strand
uuuauaauuaagaaaaaacua

SEQ ID NO: 4092 - RNA, 21 nt, Artificial Sequence
  Ebola virus siRNA sense strand
uuauaauuaagaaaaaacuaa

SEQ ID NO: 4093 - RNA, 21 nt, Artificial Sequence
  Ebola virus siRNA sense strand
uauaauuaagaaaaaacuaau

SEQ ID NO: 4094 - RNA, 21 nt, Artificial Sequence
  Ebola virus siRNA sense strand
auaauuaagaaaaaacuaaug

SEQ ID NO: 4095 - RNA, 21 nt, Artificial Sequence
  Ebola virus siRNA sense strand
uaauuaagaaaaaacuaauga

SEQ ID NO: 4096 - RNA, 21 nt, Artificial Sequence
  Ebola virus siRNA sense strand
aauuaagaaaaaacuaaugau

SEQ ID NO: 4097 - RNA, 21 nt, Artificial Sequence
  Ebola virus siRNA sense strand
auuaagaaaaaacuaaugaug

SEQ ID NO: 4098 - RNA, 21 nt, Artificial Sequence
  Ebola virus siRNA sense strand
uuaagaaaaaacuaaugauga

SEQ ID NO: 4099 - RNA, 21 nt, Artificial Sequence
  Ebola virus siRNA sense strand
uaagaaaaaacuaaugaugaa

SEQ ID NO: 4100 - RNA, 21 nt, Artificial Sequence
  Ebola virus siRNA sense strand
aagaaaaaacuaaugaugaag

SEQ ID NO: 4101 - RNA, 21 nt, Artificial Sequence
  Ebola virus siRNA sense strand
agaaaaaacuaaugaugaaga

SEQ ID NO: 4102 - RNA, 21 nt, Artificial Sequence
  Ebola virus siRNA sense strand
gaaaaaacuaaugaugaagau

SEQ ID NO: 4103 - RNA, 21 nt, Artificial Sequence
  Ebola virus siRNA sense strand
aaaaaacuaaugaugaagauu

SEQ ID NO: 4104 - RNA, 21 nt, Artificial Sequence
  Ebola virus siRNA sense strand
aaaaacuaaugaugaagauua

SEQ ID NO: 4105 - RNA, 21 nt, Artificial Sequence
  Ebola virus siRNA sense strand
aaaacuaaugaugaagauuaa

SEQ ID NO: 4106 - RNA, 21 nt, Artificial Sequence
  Ebola virus siRNA sense strand
aaacuaaugaugaagauuaaa

SEQ ID NO: 4107 - RNA, 21 nt, Artificial Sequence
  Ebola virus siRNA sense strand
aacuaaugaugaagauuaaaa

SEQ ID NO: 4108 - RNA, 21 nt, Artificial Sequence
  Ebola virus siRNA sense strand
acuaaugaugaagauuaaaac

SEQ ID NO: 4109 - RNA, 21 nt, Artificial Sequence
  Ebola virus siRNA sense strand
cuaaugaugaagauuaaaacc

SEQ ID NO: 4110 - RNA, 21 nt, Artificial Sequence
  Ebola virus siRNA sense strand
uaaugaugaagauuaaaaccu

SEQ ID NO: 4111 - RNA, 21 nt, Artificial Sequence
  Ebola virus siRNA sense strand
aaugaugaagauuaaaaccuu

SEQ ID NO: 4112 - RNA, 21 nt, Artificial Sequence
  Ebola virus siRNA sense strand
augaugaagauuaaaaccuuc

SEQ ID NO: 4113 - RNA, 21 nt, Artificial Sequence
  Ebola virus siRNA sense strand
ugaugaagauuaaaaccuuca

SEQ ID NO: 4114 - RNA, 21 nt, Artificial Sequence
  Ebola virus siRNA sense strand
gaugaagauuaaaaccuucau

SEQ ID NO: 4115 - RNA, 21 nt, Artificial Sequence
  Ebola virus siRNA sense strand
augaagauuaaaaccuucauc

SEQ ID NO: 4116 - RNA, 21 nt, Artificial Sequence
  Ebola virus siRNA sense strand
ugaagauuaaaaccuucauca

SEQ ID NO: 4117 - RNA, 21 nt, Artificial Sequence
  Ebola virus siRNA sense strand
gaagauuaaaaccuucaucau

SEQ ID NO: 4118 - RNA, 21 nt, Artificial Sequence
  Ebola virus siRNA sense strand
aagauuaaaaccuucaucauc

SEQ ID NO: 4119 - RNA, 21 nt, Artificial Sequence
  Ebola virus siRNA sense strand
agauuaaaaccuucaucaucc

SEQ ID NO: 4120 - RNA, 21 nt, Artificial Sequence
  Ebola virus siRNA sense strand
gauuaaaaccuucaucauccu

SEQ ID NO: 4121 - RNA, 21 nt, Artificial Sequence
  Ebola virus siRNA sense strand
auuaaaaccuucaucauccuu

SEQ ID NO: 4122 - RNA, 21 nt, Artificial Sequence
  Ebola virus siRNA sense strand
uuaaaaccuucaucauccuua

SEQ ID NO: 4123 - RNA, 21 nt, Artificial Sequence
  Ebola virus siRNA sense strand
uaaaaccuucaucauccuuac

SEQ ID NO: 4124 - RNA, 21 nt, Artificial Sequence
  Ebola virus siRNA sense strand
aaaaccuucaucauccuuacg

SEQ ID NO: 4125 - RNA, 21 nt, Artificial Sequence
  Ebola virus siRNA sense strand
aaaccuucaucauccuuacgu

SEQ ID NO: 4126 - RNA, 21 nt, Artificial Sequence
  Ebola virus siRNA sense strand
aaccuucaucauccuuacguc

SEQ ID NO: 4127 - RNA, 21 nt, Artificial Sequence
  Ebola virus siRNA sense strand
accuucaucauccuuacguca

SEQ ID NO: 4128 - RNA, 21 nt, Artificial Sequence
  Ebola virus siRNA sense strand
ccuucaucauccuuacgucaa

SEQ ID NO: 4129 - RNA, 21 nt, Artificial Sequence
  Ebola virus siRNA sense strand
cuucaucauccuuacgucaau

SEQ ID NO: 4130 - RNA, 21 nt, Artificial Sequence
  Ebola virus siRNA sense strand
uucaucauccuuacgucaauu

SEQ ID NO: 4131 - RNA, 21 nt, Artificial Sequence
  Ebola virus siRNA sense strand
ucaucauccuuacgucaauug

SEQ ID NO: 4132 - RNA, 21 nt, Artificial Sequence
  Ebola virus siRNA sense strand
caucauccuuacgucaauuga

SEQ ID NO: 4133 - RNA, 21 nt, Artificial Sequence
  Ebola virus siRNA sense strand
aucauccuuacgucaauugaa

SEQ ID NO: 4134 - RNA, 21 nt, Artificial Sequence
  Ebola virus siRNA sense strand
ucauccuuacgucaauugaau

SEQ ID NO: 4135 - RNA, 21 nt, Artificial Sequence
  Ebola virus siRNA sense strand
cauccuuacgucaauugaauu

SEQ ID NO: 4136 - RNA, 21 nt, Artificial Sequence
  Ebola virus siRNA sense strand
auccuuacgucaauugaauuc

SEQ ID NO: 4137 - RNA, 21 nt, Artificial Sequence
  Ebola virus siRNA sense strand
uccuuacgucaauugaauucu

SEQ ID NO: 4138 - RNA, 21 nt, Artificial Sequence
  Ebola virus siRNA sense strand
ccuuacgucaauugaauucuc

SEQ ID NO: 4139 - RNA, 21 nt, Artificial Sequence
  Ebola virus siRNA sense strand
cuuacgucaauugaauucucu

SEQ ID NO: 4140 - RNA, 21 nt, Artificial Sequence
  Ebola virus siRNA sense strand
uuacgucaauugaauucucua

SEQ ID NO: 4141 - RNA, 21 nt, Artificial Sequence
  Ebola virus siRNA sense strand
uacgucaauugaauucucuag

SEQ ID NO: 4142 - RNA, 21 nt, Artificial Sequence
  Ebola virus siRNA sense strand
acgucaauugaauucucuagc

SEQ ID NO: 4143 - RNA, 21 nt, Artificial Sequence
  Ebola virus siRNA sense strand
cgucaauugaauucucuagca

SEQ ID NO: 4144 - RNA, 21 nt, Artificial Sequence
  Ebola virus siRNA sense strand
gucaauugaauucucuagcac

SEQ ID NO: 4145 - RNA, 21 nt, Artificial Sequence
  Ebola virus siRNA sense strand
ucaauugaauucucuagcacu

SEQ ID NO: 4146 - RNA, 21 nt, Artificial Sequence
  Ebola virus siRNA sense strand
caauugaauucucuagcacuc

SEQ ID NO: 4147 - RNA, 21 nt, Artificial Sequence
  Ebola virus siRNA sense strand
aauugaauucucuagcacucg

SEQ ID NO: 4148 - RNA, 21 nt, Artificial Sequence
  Ebola virus siRNA sense strand
auugaauucucuagcacucga

SEQ ID NO: 4149 - RNA, 21 nt, Artificial Sequence
  Ebola virus siRNA sense strand
uugaauucucuagcacucgaa

SEQ ID NO: 4150 - RNA, 21 nt, Artificial Sequence
  Ebola virus siRNA sense strand
ugaauucucuagcacucgaag

SEQ ID NO: 4151 - RNA, 21 nt, Artificial Sequence
  Ebola virus siRNA sense strand
gaauucucuagcacucgaagc

SEQ ID NO: 4152 - RNA, 21 nt, Artificial Sequence
  Ebola virus siRNA sense strand
aauucucuagcacucgaagcu

SEQ ID NO: 4153 - RNA, 21 nt, Artificial Sequence
  Ebola virus siRNA sense strand
auucucuagcacucgaagcuu

SEQ ID NO: 4154 - RNA, 21 nt, Artificial Sequence
  Ebola virus siRNA sense strand
uucucuagcacucgaagcuua

SEQ ID NO: 4155 - RNA, 21 nt, Artificial Sequence
  Ebola virus siRNA sense strand
ucucuagcacucgaagcuuau

SEQ ID NO: 4156 - RNA, 21 nt, Artificial Sequence
  Ebola virus siRNA sense strand
cucuagcacucgaagcuuauu

SEQ ID NO: 4157 - RNA, 21 nt, Artificial Sequence
  Ebola virus siRNA sense strand
ucuagcacucgaagcuuauug

SEQ ID NO: 4158 - RNA, 21 nt, Artificial Sequence
  Ebola virus siRNA sense strand
cuagcacucgaagcuuauugu

SEQ ID NO: 4159 - RNA, 21 nt, Artificial Sequence
  Ebola virus siRNA sense strand
uagcacucgaagcuuauuguc

SEQ ID NO: 4160 - RNA, 21 nt, Artificial Sequence
  Ebola virus siRNA sense strand
agcacucgaagcuuauugucu

SEQ ID NO: 4161 - RNA, 21 nt, Artificial Sequence
  Ebola virus siRNA sense strand
gcacucgaagcuuauugucuu

SEQ ID NO: 4162 - RNA, 21 nt, Artificial Sequence
  Ebola virus siRNA sense strand
cacucgaagcuuauugucuuc

SEQ ID NO: 4163 - RNA, 21 nt, Artificial Sequence
  Ebola virus siRNA sense strand
acucgaagcuuauugucuuca

SEQ ID NO: 4164 - RNA, 21 nt, Artificial Sequence
  Ebola virus siRNA sense strand
cucgaagcuuauugucuucaa

SEQ ID NO: 4165 - RNA, 21 nt, Artificial Sequence
  Ebola virus siRNA sense strand
ucgaagcuuauugucuucaau

SEQ ID NO: 4166 - RNA, 21 nt, Artificial Sequence
  Ebola virus siRNA sense strand
cgaagcuuauugucuucaaug

SEQ ID NO: 4167 - RNA, 21 nt, Artificial Sequence
  Ebola virus siRNA sense strand
gaagcuuauugucuucaaugu

SEQ ID NO: 4168 - RNA, 21 nt, Artificial Sequence
  Ebola virus siRNA sense strand
aagcuuauugucuucaaugua

SEQ ID NO: 4169 - RNA, 21 nt, Artificial Sequence
  Ebola virus siRNA sense strand
agcuuauugucuucaauguaa

SEQ ID NO: 4170 - RNA, 21 nt, Artificial Sequence
  Ebola virus siRNA sense strand
gcuuauugucuucaauguaaa

SEQ ID NO: 4171 - RNA, 21 nt, Artificial Sequence
  Ebola virus siRNA sense strand
cuuauugucuucaauguaaaa

SEQ ID NO: 4172 - RNA, 21 nt, Artificial Sequence
  Ebola virus siRNA sense strand
uuauugucuucaauguaaaag

SEQ ID NO: 4173 - RNA, 21 nt, Artificial Sequence
  Ebola virus siRNA sense strand
uauugucuucaauguaaaaga

SEQ ID NO: 4174 - RNA, 21 nt, Artificial Sequence
  Ebola virus siRNA sense strand
auugucuucaauguaaaagaa

SEQ ID NO: 4175 - RNA, 21 nt, Artificial Sequence
  Ebola virus siRNA sense strand
uugucuucaauguaaaagaaa

SEQ ID NO: 4176 - RNA, 21 nt, Artificial Sequence
  Ebola virus siRNA sense strand
ugucuucaauguaaaagaaaa

SEQ ID NO: 4177 - RNA, 21 nt, Artificial Sequence
  Ebola virus siRNA sense strand
gucuucaauguaaaagaaaag

SEQ ID NO: 4178 - RNA, 21 nt, Artificial Sequence
  Ebola virus siRNA sense strand
ucuucaauguaaaagaaaagc

SEQ ID NO: 4179 - RNA, 21 nt, Artificial Sequence
  Ebola virus siRNA sense strand
cuucaauguaaaagaaaagcu

SEQ ID NO: 4180 - RNA, 21 nt, Artificial Sequence
  Ebola virus siRNA sense strand
uucaauguaaaagaaaagcug

SEQ ID NO: 4181 - RNA, 21 nt, Artificial Sequence
  Ebola virus siRNA sense strand
ucaauguaaaagaaaagcugg

SEQ ID NO: 4182 - RNA, 21 nt, Artificial Sequence
  Ebola virus siRNA sense strand
caauguaaaagaaaagcuggu

SEQ ID NO: 4183 - RNA, 21 nt, Artificial Sequence
  Ebola virus siRNA sense strand
aauguaaaagaaaagcugguc

SEQ ID NO: 4184 - RNA, 21 nt, Artificial Sequence
  Ebola virus siRNA sense strand
auguaaaagaaaagcuggucu

SEQ ID NO: 4185 - RNA, 21 nt, Artificial Sequence
  Ebola virus siRNA sense strand
uguaaaagaaaagcuggucua

SEQ ID NO: 4186 - RNA, 21 nt, Artificial Sequence
  Ebola virus siRNA sense strand
guaaaagaaaagcuggucuaa

SEQ ID NO: 4187 - RNA, 21 nt, Artificial Sequence
  Ebola virus siRNA sense strand
uaaaagaaaagcuggucuaac

SEQ ID NO: 4188 - RNA, 21 nt, Artificial Sequence
  Ebola virus siRNA sense strand
aaaagaaaagcuggucuaaca

SEQ ID NO: 4189 - RNA, 21 nt, Artificial Sequence
  Ebola virus siRNA sense strand
aaagaaaagcuggucuaacaa

SEQ ID NO: 4190 - RNA, 21 nt, Artificial Sequence
  Ebola virus siRNA sense strand
aagaaaagcuggucuaacaag

SEQ ID NO: 4191 - RNA, 21 nt, Artificial Sequence
  Ebola virus siRNA sense strand
agaaaagcuggucuaacaaga

SEQ ID NO: 4192 - RNA, 21 nt, Artificial Sequence
  Ebola virus siRNA sense strand
gaaaagcuggucuaacaagau

SEQ ID NO: 4193 - RNA, 21 nt, Artificial Sequence
  Ebola virus siRNA sense strand
aaaagcuggucuaacaagaug

SEQ ID NO: 4194 - RNA, 21 nt, Artificial Sequence
  Ebola virus siRNA sense strand
aaagcuggucuaacaagauga

SEQ ID NO: 4195 - RNA, 21 nt, Artificial Sequence
  Ebola virus siRNA sense strand
aagcuggucuaacaagaugac

SEQ ID NO: 4196 - RNA, 21 nt, Artificial Sequence
  Ebola virus siRNA sense strand
agcuggucuaacaagaugaca

SEQ ID NO: 4197 - RNA, 21 nt, Artificial Sequence
  Ebola virus siRNA sense strand
gcuggucuaacaagaugacaa

SEQ ID NO: 4198 - RNA, 21 nt, Artificial Sequence
  Ebola virus siRNA sense strand
cuggucuaacaagaugacaac

SEQ ID NO: 4199 - RNA, 21 nt, Artificial Sequence
  Ebola virus siRNA sense strand
uggucuaacaagaugacaacu

SEQ ID NO: 4200 - RNA, 21 nt, Artificial Sequence
  Ebola virus siRNA sense strand
ggucuaacaagaugacaacua

SEQ ID NO: 4201 - RNA, 21 nt, Artificial Sequence
  Ebola virus siRNA sense strand
gucuaacaagaugacaacuag

SEQ ID NO: 4202 - RNA, 21 nt, Artificial Sequence
  Ebola virus siRNA sense strand
ucuaacaagaugacaacuaga

SEQ ID NO: 4203 - RNA, 21 nt, Artificial Sequence
  Ebola virus siRNA sense strand
cuaacaagaugacaacuagaa

SEQ ID NO: 4204 - RNA, 21 nt, Artificial Sequence
  Ebola virus siRNA sense strand
uaacaagaugacaacuagaac

SEQ ID NO: 4205 - RNA, 21 nt, Artificial Sequence
  Ebola virus siRNA sense strand
aacaagaugacaacuagaaca

SEQ ID NO: 4206 - RNA, 21 nt, Artificial Sequence
  Ebola virus siRNA sense strand
acaagaugacaacuagaacaa

SEQ ID NO: 4207 - RNA, 21 nt, Artificial Sequence
  Ebola virus siRNA sense strand
caagaugacaacuagaacaaa

SEQ ID NO: 4208 - RNA, 21 nt, Artificial Sequence
  Ebola virus siRNA sense strand
aagaugacaacuagaacaaag

SEQ ID NO: 4209 - RNA, 21 nt, Artificial Sequence
  Ebola virus siRNA sense strand
agaugacaacuagaacaaagg

SEQ ID NO: 4210 - RNA, 21 nt, Artificial Sequence
  Ebola virus siRNA sense strand
gaugacaacuagaacaaaggg

SEQ ID NO: 4211 - RNA, 21 nt, Artificial Sequence
  Ebola virus siRNA sense strand
augacaacuagaacaaagggc

SEQ ID NO: 4212 - RNA, 21 nt, Artificial Sequence
  Ebola virus siRNA sense strand
ugacaacuagaacaaagggca

SEQ ID NO: 4213 - RNA, 21 nt, Artificial Sequence
  Ebola virus siRNA sense strand
gacaacuagaacaaagggcag

SEQ ID NO: 4214 - RNA, 21 nt, Artificial Sequence
  Ebola virus siRNA sense strand
acaacuagaacaaagggcagg

SEQ ID NO: 4215 - RNA, 21 nt, Artificial Sequence
  Ebola virus siRNA sense strand
caacuagaacaaagggcaggg

SEQ ID NO: 4216 - RNA, 21 nt, Artificial Sequence
  Ebola virus siRNA sense strand
aacuagaacaaagggcagggg

SEQ ID NO: 4217 - RNA, 21 nt, Artificial Sequence
  Ebola virus siRNA sense strand
acuagaacaaagggcaggggc

SEQ ID NO: 4218 - RNA, 21 nt, Artificial Sequence
  Ebola virus siRNA sense strand
cuagaacaaagggcaggggcc

SEQ ID NO: 4219 - RNA, 21 nt, Artificial Sequence
  Ebola virus siRNA sense strand
uagaacaaagggcaggggcca

SEQ ID NO: 4220 - RNA, 21 nt, Artificial Sequence
  Ebola virus siRNA sense strand
agaacaaagggcaggggccau

SEQ ID NO: 4221 - RNA, 21 nt, Artificial Sequence
  Ebola virus siRNA sense strand
gaacaaagggcaggggccaua

SEQ ID NO: 4222 - RNA, 21 nt, Artificial Sequence
  Ebola virus siRNA sense strand
aacaaagggcaggggccauac

SEQ ID NO: 4223 - RNA, 21 nt, Artificial Sequence
  Ebola virus siRNA sense strand
acaaagggcaggggccauacu

SEQ ID NO: 4224 - RNA, 21 nt, Artificial Sequence
  Ebola virus siRNA sense strand
caaagggcaggggccauacug

SEQ ID NO: 4225 - RNA, 21 nt, Artificial Sequence
  Ebola virus siRNA sense strand
aaagggcaggggccauacugc

SEQ ID NO: 4226 - RNA, 21 nt, Artificial Sequence
  Ebola virus siRNA sense strand
aagggcaggggccauacugcg

SEQ ID NO: 4227 - RNA, 21 nt, Artificial Sequence
  Ebola virus siRNA sense strand
agggcaggggccauacugcgg

SEQ ID NO: 4228 - RNA, 21 nt, Artificial Sequence
  Ebola virus siRNA sense strand
gggcaggggccauacugcggc

SEQ ID NO: 4229 - RNA, 21 nt, Artificial Sequence
  Ebola virus siRNA sense strand
ggcaggggccauacugcggcc

SEQ ID NO: 4230 - RNA, 21 nt, Artificial Sequence
  Ebola virus siRNA sense strand
gcaggggccauacugcggcca

SEQ ID NO: 4231 - RNA, 21 nt, Artificial Sequence
  Ebola virus siRNA sense strand
caggggccauacugcggccac

SEQ ID NO: 4232 - RNA, 21 nt, Artificial Sequence
  Ebola virus siRNA sense strand
aggggccauacugcggccacg

SEQ ID NO: 4233 - RNA, 21 nt, Artificial Sequence
  Ebola virus siRNA sense strand
ggggccauacugcggccacga

SEQ ID NO: 4234 - RNA, 21 nt, Artificial Sequence
  Ebola virus siRNA sense strand
gggccauacugcggccacgac

SEQ ID NO: 4235 - RNA, 21 nt, Artificial Sequence
  Ebola virus siRNA sense strand
ggccauacugcggccacgacu

SEQ ID NO: 4236 - RNA, 21 nt, Artificial Sequence
  Ebola virus siRNA sense strand
gccauacugcggccacgacuc

SEQ ID NO: 4237 - RNA, 21 nt, Artificial Sequence
  Ebola virus siRNA sense strand
ccauacugcggccacgacuca

SEQ ID NO: 4238 - RNA, 21 nt, Artificial Sequence
  Ebola virus siRNA sense strand
cauacugcggccacgacucaa

SEQ ID NO: 4239 - RNA, 21 nt, Artificial Sequence
  Ebola virus siRNA sense strand
auacugcggccacgacucaaa

SEQ ID NO: 4240 - RNA, 21 nt, Artificial Sequence
  Ebola virus siRNA sense strand
uacugcggccacgacucaaaa

SEQ ID NO: 4241 - RNA, 21 nt, Artificial Sequence
  Ebola virus siRNA sense strand
acugcggccacgacucaaaac

SEQ ID NO: 4242 - RNA, 21 nt, Artificial Sequence
  Ebola virus siRNA sense strand
cugcggccacgacucaaaacg

SEQ ID NO: 4243 - RNA, 21 nt, Artificial Sequence
  Ebola virus siRNA sense strand
ugcggccacgacucaaaacga

SEQ ID NO: 4244 - RNA, 21 nt, Artificial Sequence
  Ebola virus siRNA sense strand
gcggccacgacucaaaacgac

SEQ ID NO: 4245 - RNA, 21 nt, Artificial Sequence
  Ebola virus siRNA sense strand
cggccacgacucaaaacgaca

SEQ ID NO: 4246 - RNA, 21 nt, Artificial Sequence
  Ebola virus siRNA sense strand
ggccacgacucaaaacgacag

SEQ ID NO: 4247 - RNA, 21 nt, Artificial Sequence
  Ebola virus siRNA sense strand
gccacgacucaaaacgacaga

SEQ ID NO: 4248 - RNA, 21 nt, Artificial Sequence
  Ebola virus siRNA sense strand
ccacgacucaaaacgacagaa

SEQ ID NO: 4249 - RNA, 21 nt, Artificial Sequence
  Ebola virus siRNA sense strand
cacgacucaaaacgacagaau

SEQ ID NO: 4250 - RNA, 21 nt, Artificial Sequence
  Ebola virus siRNA sense strand
acgacucaaaacgacagaaug

SEQ ID NO: 4251 - RNA, 21 nt, Artificial Sequence
  Ebola virus siRNA sense strand
cgacucaaaacgacagaaugc

SEQ ID NO: 4252 - RNA, 21 nt, Artificial Sequence
  Ebola virus siRNA sense strand
gacucaaaacgacagaaugcc

SEQ ID NO: 4253 - RNA, 21 nt, Artificial Sequence
  Ebola virus siRNA sense strand
acucaaaacgacagaaugcca

SEQ ID NO: 4254 - RNA, 21 nt, Artificial Sequence
  Ebola virus siRNA sense strand
cucaaaacgacagaaugccag

SEQ ID NO: 4255 - RNA, 21 nt, Artificial Sequence
  Ebola virus siRNA sense strand
ucaaaacgacagaaugccagg

SEQ ID NO: 4256 - RNA, 21 nt, Artificial Sequence
  Ebola virus siRNA sense strand
caaaacgacagaaugccaggc

SEQ ID NO: 4257 - RNA, 21 nt, Artificial Sequence
  Ebola virus siRNA sense strand
aaaacgacagaaugccaggcc

SEQ ID NO: 4258 - RNA, 21 nt, Artificial Sequence
  Ebola virus siRNA sense strand
aaacgacagaaugccaggccc

SEQ ID NO: 4259 - RNA, 21 nt, Artificial Sequence
  Ebola virus siRNA sense strand
aacgacagaaugccaggcccu

SEQ ID NO: 4260 - RNA, 21 nt, Artificial Sequence
  Ebola virus siRNA sense strand
acgacagaaugccaggcccug

SEQ ID NO: 4261 - RNA, 21 nt, Artificial Sequence
  Ebola virus siRNA sense strand
cgacagaaugccaggcccuga

SEQ ID NO: 4262 - RNA, 21 nt, Artificial Sequence
  Ebola virus siRNA sense strand
gacagaaugccaggcccugag

SEQ ID NO: 4263 - RNA, 21 nt, Artificial Sequence
  Ebola virus siRNA sense strand
acagaaugccaggcccugagc

SEQ ID NO: 4264 - RNA, 21 nt, Artificial Sequence
  Ebola virus siRNA sense strand
cagaaugccaggcccugagcu

SEQ ID NO: 4265 - RNA, 21 nt, Artificial Sequence
  Ebola virus siRNA sense strand
agaaugccaggcccugagcuu

SEQ ID NO: 4266 - RNA, 21 nt, Artificial Sequence
  Ebola virus siRNA sense strand
gaaugccaggcccugagcuuu

SEQ ID NO: 4267 - RNA, 21 nt, Artificial Sequence
  Ebola virus siRNA sense strand
aaugccaggcccugagcuuuc

SEQ ID NO: 4268 - RNA, 21 nt, Artificial Sequence
  Ebola virus siRNA sense strand
augccaggcccugagcuuucg

SEQ ID NO: 4269 - RNA, 21 nt, Artificial Sequence
  Ebola virus siRNA sense strand
ugccaggcccugagcuuucgg

SEQ ID NO: 4270 - RNA, 21 nt, Artificial Sequence
  Ebola virus siRNA sense strand
gccaggcccugagcuuucggg

SEQ ID NO: 4271 - RNA, 21 nt, Artificial Sequence
  Ebola virus siRNA sense strand
ccaggcccugagcuuucgggc

SEQ ID NO: 4272 - RNA, 21 nt, Artificial Sequence
  Ebola virus siRNA sense strand
caggcccugagcuuucgggcu

SEQ ID NO: 4273 - RNA, 21 nt, Artificial Sequence
  Ebola virus siRNA sense strand
aggcccugagcuuucgggcug

SEQ ID NO: 4274 - RNA, 21 nt, Artificial Sequence
  Ebola virus siRNA sense strand
ggcccugagcuuucgggcugg

SEQ ID NO: 4275 - RNA, 21 nt, Artificial Sequence
  Ebola virus siRNA sense strand
gcccugagcuuucgggcugga

SEQ ID NO: 4276 - RNA, 21 nt, Artificial Sequence
  Ebola virus siRNA sense strand
cccugagcuuucgggcuggau

SEQ ID NO: 4277 - RNA, 21 nt, Artificial Sequence
  Ebola virus siRNA sense strand
ccugagcuuucgggcuggauc

SEQ ID NO: 4278 - RNA, 21 nt, Artificial Sequence
  Ebola virus siRNA sense strand
cugagcuuucgggcuggaucu

SEQ ID NO: 4279 - RNA, 21 nt, Artificial Sequence
  Ebola virus siRNA sense strand
ugagcuuucgggcuggaucuc

SEQ ID NO: 4280 - RNA, 21 nt, Artificial Sequence
  Ebola virus siRNA sense strand
gagcuuucgggcuggaucucu

SEQ ID NO: 4281 - RNA, 21 nt, Artificial Sequence
  Ebola virus siRNA sense strand
agcuuucgggcuggaucucug

SEQ ID NO: 4282 - RNA, 21 nt, Artificial Sequence
  Ebola virus siRNA sense strand
gcuuucgggcuggaucucuga

SEQ ID NO: 4283 - RNA, 21 nt, Artificial Sequence
  Ebola virus siRNA sense strand
cuuucgggcuggaucucugag

SEQ ID NO: 4284 - RNA, 21 nt, Artificial Sequence
  Ebola virus siRNA sense strand
uuucgggcuggaucucugagc

SEQ ID NO: 4285 - RNA, 21 nt, Artificial Sequence
  Ebola virus siRNA sense strand
uucgggcuggaucucugagca

SEQ ID NO: 4286 - RNA, 21 nt, Artificial Sequence
  Ebola virus siRNA sense strand
ucgggcuggaucucugagcag

SEQ ID NO: 4287 - RNA, 21 nt, Artificial Sequence
  Ebola virus siRNA sense strand
cgggcuggaucucugagcagc

SEQ ID NO: 4288 - RNA, 21 nt, Artificial Sequence
  Ebola virus siRNA sense strand
gggcuggaucucugagcagcu

SEQ ID NO: 4289 - RNA, 21 nt, Artificial Sequence
  Ebola virus siRNA sense strand
ggcuggaucucugagcagcua

SEQ ID NO: 4290 - RNA, 21 nt, Artificial Sequence
  Ebola virus siRNA sense strand
gcuggaucucugagcagcuaa

SEQ ID NO: 4291 - RNA, 21 nt, Artificial Sequence
  Ebola virus siRNA sense strand
cuggaucucugagcagcuaau

SEQ ID NO: 4292 - RNA, 21 nt, Artificial Sequence
  Ebola virus siRNA sense strand
uggaucucugagcagcuaaug

SEQ ID NO: 4293 - RNA, 21 nt, Artificial Sequence
  Ebola virus siRNA sense strand
ggaucucugagcagcuaauga

SEQ ID NO: 4294 - RNA, 21 nt, Artificial Sequence
  Ebola virus siRNA sense strand
gaucucugagcagcuaaugac

SEQ ID NO: 4295 - RNA, 21 nt, Artificial Sequence
  Ebola virus siRNA sense strand
aucucugagcagcuaaugacc

SEQ ID NO: 4296 - RNA, 21 nt, Artificial Sequence
  Ebola virus siRNA sense strand
ucucugagcagcuaaugaccg

SEQ ID NO: 4297 - RNA, 21 nt, Artificial Sequence
  Ebola virus siRNA sense strand
cucugagcagcuaaugaccgg

SEQ ID NO: 4298 - RNA, 21 nt, Artificial Sequence
  Ebola virus siRNA sense strand
ucugagcagcuaaugaccgga

SEQ ID NO: 4299 - RNA, 21 nt, Artificial Sequence
  Ebola virus siRNA sense strand
cugagcagcuaaugaccggaa

SEQ ID NO: 4300 - RNA, 21 nt, Artificial Sequence
  Ebola virus siRNA sense strand
ugagcagcuaaugaccggaag

SEQ ID NO: 4301 - RNA, 21 nt, Artificial Sequence
  Ebola virus siRNA sense strand
gagcagcuaaugaccggaaga

SEQ ID NO: 4302 - RNA, 21 nt, Artificial Sequence
  Ebola virus siRNA sense strand
agcagcuaaugaccggaagaa

SEQ ID NO: 4303 - RNA, 21 nt, Artificial Sequence
  Ebola virus siRNA sense strand
gcagcuaaugaccggaagaau

SEQ ID NO: 4304 - RNA, 21 nt, Artificial Sequence
  Ebola virus siRNA sense strand
cagcuaaugaccggaagaauu

SEQ ID NO: 4305 - RNA, 21 nt, Artificial Sequence
  Ebola virus siRNA sense strand
agcuaaugaccggaagaauuc

SEQ ID NO: 4306 - RNA, 21 nt, Artificial Sequence
  Ebola virus siRNA sense strand
gcuaaugaccggaagaauucc

SEQ ID NO: 4307 - RNA, 21 nt, Artificial Sequence
  Ebola virus siRNA sense strand
cuaaugaccggaagaauuccu

SEQ ID NO: 4308 - RNA, 21 nt, Artificial Sequence
  Ebola virus siRNA sense strand
uaaugaccggaagaauuccug

SEQ ID NO: 4309 - RNA, 21 nt, Artificial Sequence
  Ebola virus siRNA sense strand
aaugaccggaagaauuccugu

SEQ ID NO: 4310 - RNA, 21 nt, Artificial Sequence
  Ebola virus siRNA sense strand
augaccggaagaauuccugua

SEQ ID NO: 4311 - RNA, 21 nt, Artificial Sequence
  Ebola virus siRNA sense strand
ugaccggaagaauuccuguaa

SEQ ID NO: 4312 - RNA, 21 nt, Artificial Sequence
  Ebola virus siRNA sense strand
gaccggaagaauuccuguaag

SEQ ID NO: 4313 - RNA, 21 nt, Artificial Sequence
  Ebola virus siRNA sense strand
accggaagaauuccuguaagc

SEQ ID NO: 4314 - RNA, 21 nt, Artificial Sequence
  Ebola virus siRNA sense strand
ccggaagaauuccuguaagcg

SEQ ID NO: 4315 - RNA, 21 nt, Artificial Sequence
  Ebola virus siRNA sense strand
cggaagaauuccuguaagcga

SEQ ID NO: 4316 - RNA, 21 nt, Artificial Sequence
  Ebola virus siRNA sense strand
ggaagaauuccuguaagcgac

SEQ ID NO: 4317 - RNA, 21 nt, Artificial Sequence
  Ebola virus siRNA sense strand
gaagaauuccuguaagcgaca

SEQ ID NO: 4318 - RNA, 21 nt, Artificial Sequence
  Ebola virus siRNA sense strand
aagaauuccuguaagcgacau

SEQ ID NO: 4319 - RNA, 21 nt, Artificial Sequence
  Ebola virus siRNA sense strand
agaauuccuguaagcgacauc

SEQ ID NO: 4320 - RNA, 21 nt, Artificial Sequence
  Ebola virus siRNA sense strand
gaauuccuguaagcgacaucu

SEQ ID NO: 4321 - RNA, 21 nt, Artificial Sequence
  Ebola virus siRNA sense strand
aauuccuguaagcgacaucuu

SEQ ID NO: 4322 - RNA, 21 nt, Artificial Sequence
  Ebola virus siRNA sense strand
auuccuguaagcgacaucuuc

SEQ ID NO: 4323 - RNA, 21 nt, Artificial Sequence
  Ebola virus siRNA sense strand
uuccuguaagcgacaucuucu

SEQ ID NO: 4324 - RNA, 21 nt, Artificial Sequence
  Ebola virus siRNA sense strand
uccuguaagcgacaucuucug

SEQ ID NO: 4325 - RNA, 21 nt, Artificial Sequence
  Ebola virus siRNA sense strand
ccuguaagcgacaucuucugu

SEQ ID NO: 4326 - RNA, 21 nt, Artificial Sequence
  Ebola virus siRNA sense strand
cuguaagcgacaucuucugug

SEQ ID NO: 4327 - RNA, 21 nt, Artificial Sequence
  Ebola virus siRNA sense strand
uguaagcgacaucuucuguga

SEQ ID NO: 4328 - RNA, 21 nt, Artificial Sequence
  Ebola virus siRNA sense strand
guaagcgacaucuucugugau

SEQ ID NO: 4329 - RNA, 21 nt, Artificial Sequence
  Ebola virus siRNA sense strand
uaagcgacaucuucugugaua

SEQ ID NO: 4330 - RNA, 21 nt, Artificial Sequence
  Ebola virus siRNA sense strand
aagcgacaucuucugugauau

SEQ ID NO: 4331 - RNA, 21 nt, Artificial Sequence
  Ebola virus siRNA sense strand
agcgacaucuucugugauauu

SEQ ID NO: 4332 - RNA, 21 nt, Artificial Sequence
  Ebola virus siRNA sense strand
gcgacaucuucugugauauug

SEQ ID NO: 4333 - RNA, 21 nt, Artificial Sequence
  Ebola virus siRNA sense strand
cgacaucuucugugauauuga

SEQ ID NO: 4334 - RNA, 21 nt, Artificial Sequence
  Ebola virus siRNA sense strand
gacaucuucugugauauugag

SEQ ID NO: 4335 - RNA, 21 nt, Artificial Sequence
  Ebola virus siRNA sense strand
acaucuucugugauauugaga

SEQ ID NO: 4336 - RNA, 21 nt, Artificial Sequence
  Ebola virus siRNA sense strand
caucuucugugauauugagaa

SEQ ID NO: 4337 - RNA, 21 nt, Artificial Sequence
  Ebola virus siRNA sense strand
aucuucugugauauugagaac

SEQ ID NO: 4338 - RNA, 21 nt, Artificial Sequence
  Ebola virus siRNA sense strand
ucuucugugauauugagaaca

SEQ ID NO: 4339 - RNA, 21 nt, Artificial Sequence
  Ebola virus siRNA sense strand
cuucugugauauugagaacaa

SEQ ID NO: 4340 - RNA, 21 nt, Artificial Sequence
  Ebola virus siRNA sense strand
uucugugauauugagaacaau

SEQ ID NO: 4341 - RNA, 21 nt, Artificial Sequence
  Ebola virus siRNA sense strand
ucugugauauugagaacaauc

SEQ ID NO: 4342 - RNA, 21 nt, Artificial Sequence
  Ebola virus siRNA sense strand
cugugauauugagaacaaucc

SEQ ID NO: 4343 - RNA, 21 nt, Artificial Sequence
  Ebola virus siRNA sense strand
ugugauauugagaacaaucca

SEQ ID NO: 4344 - RNA, 21 nt, Artificial Sequence
  Ebola virus siRNA sense strand
gugauauugagaacaauccag

SEQ ID NO: 4345 - RNA, 21 nt, Artificial Sequence
  Ebola virus siRNA sense strand
ugauauugagaacaauccagg

SEQ ID NO: 4346 - RNA, 21 nt, Artificial Sequence
  Ebola virus siRNA sense strand
gauauugagaacaauccagga

SEQ ID NO: 4347 - RNA, 21 nt, Artificial Sequence
  Ebola virus siRNA sense strand
auauugagaacaauccaggau

SEQ ID NO: 4348 - RNA, 21 nt, Artificial Sequence
  Ebola virus siRNA sense strand
uauugagaacaauccaggauu

SEQ ID NO: 4349 - RNA, 21 nt, Artificial Sequence
  Ebola virus siRNA sense strand
auugagaacaauccaggauua

SEQ ID NO: 4350 - RNA, 21 nt, Artificial Sequence
  Ebola virus siRNA sense strand
uugagaacaauccaggauuau

SEQ ID NO: 4351 - RNA, 21 nt, Artificial Sequence
  Ebola virus siRNA sense strand
ugagaacaauccaggauuaug

SEQ ID NO: 4352 - RNA, 21 nt, Artificial Sequence
  Ebola virus siRNA sense strand
gagaacaauccaggauuaugc

SEQ ID NO: 4353 - RNA, 21 nt, Artificial Sequence
  Ebola virus siRNA sense strand
agaacaauccaggauuaugcu

SEQ ID NO: 4354 - RNA, 21 nt, Artificial Sequence
  Ebola virus siRNA sense strand
gaacaauccaggauuaugcua

SEQ ID NO: 4355 - RNA, 21 nt, Artificial Sequence
  Ebola virus siRNA sense strand
aacaauccaggauuaugcuac

SEQ ID NO: 4356 - RNA, 21 nt, Artificial Sequence
  Ebola virus siRNA sense strand
acaauccaggauuaugcuacg

SEQ ID NO: 4357 - RNA, 21 nt, Artificial Sequence
  Ebola virus siRNA sense strand
caauccaggauuaugcuacgc

SEQ ID NO: 4358 - RNA, 21 nt, Artificial Sequence
  Ebola virus siRNA sense strand
aauccaggauuaugcuacgca

SEQ ID NO: 4359 - RNA, 21 nt, Artificial Sequence
  Ebola virus siRNA sense strand
auccaggauuaugcuacgcau

SEQ ID NO: 4360 - RNA, 21 nt, Artificial Sequence
  Ebola virus siRNA sense strand
uccaggauuaugcuacgcauc

SEQ ID NO: 4361 - RNA, 21 nt, Artificial Sequence
  Ebola virus siRNA sense strand
ccaggauuaugcuacgcaucc

SEQ ID NO: 4362 - RNA, 21 nt, Artificial Sequence
  Ebola virus siRNA sense strand
caggauuaugcuacgcauccc

SEQ ID NO: 4363 - RNA, 21 nt, Artificial Sequence
  Ebola virus siRNA sense strand
aggauuaugcuacgcauccca

SEQ ID NO: 4364 - RNA, 21 nt, Artificial Sequence
  Ebola virus siRNA sense strand
ggauuaugcuacgcaucccaa

SEQ ID NO: 4365 - RNA, 21 nt, Artificial Sequence
  Ebola virus siRNA sense strand
gauuaugcuacgcaucccaaa

SEQ ID NO: 4366 - RNA, 21 nt, Artificial Sequence
  Ebola virus siRNA sense strand
auuaugcuacgcaucccaaau

SEQ ID NO: 4367 - RNA, 21 nt, Artificial Sequence
  Ebola virus siRNA sense strand
uuaugcuacgcaucccaaaug

SEQ ID NO: 4368 - RNA, 21 nt, Artificial Sequence
  Ebola virus siRNA sense strand
uaugcuacgcaucccaaaugc

SEQ ID NO: 4369 - RNA, 21 nt, Artificial Sequence
  Ebola virus siRNA sense strand
augcuacgcaucccaaaugca

SEQ ID NO: 4370 - RNA, 21 nt, Artificial Sequence
  Ebola virus siRNA sense strand
ugcuacgcaucccaaaugcaa

SEQ ID NO: 4371 - RNA, 21 nt, Artificial Sequence
  Ebola virus siRNA sense strand
gcuacgcaucccaaaugcaac

SEQ ID NO: 4372 - RNA, 21 nt, Artificial Sequence
  Ebola virus siRNA sense strand
cuacgcaucccaaaugcaaca

SEQ ID NO: 4373 - RNA, 21 nt, Artificial Sequence
  Ebola virus siRNA sense strand
uacgcaucccaaaugcaacaa

SEQ ID NO: 4374 - RNA, 21 nt, Artificial Sequence
  Ebola virus siRNA sense strand
acgcaucccaaaugcaacaaa

SEQ ID NO: 4375 - RNA, 21 nt, Artificial Sequence
  Ebola virus siRNA sense strand
cgcaucccaaaugcaacaaac

SEQ ID NO: 4376 - RNA, 21 nt, Artificial Sequence
  Ebola virus siRNA sense strand
gcaucccaaaugcaacaaacg

SEQ ID NO: 4377 - RNA, 21 nt, Artificial Sequence
  Ebola virus siRNA sense strand
caucccaaaugcaacaaacga

SEQ ID NO: 4378 - RNA, 21 nt, Artificial Sequence
  Ebola virus siRNA sense strand
aucccaaaugcaacaaacgaa

SEQ ID NO: 4379 - RNA, 21 nt, Artificial Sequence
  Ebola virus siRNA sense strand
ucccaaaugcaacaaacgaag

SEQ ID NO: 4380 - RNA, 21 nt, Artificial Sequence
  Ebola virus siRNA sense strand
cccaaaugcaacaaacgaagc

SEQ ID NO: 4381 - RNA, 21 nt, Artificial Sequence
  Ebola virus siRNA sense strand
ccaaaugcaacaaacgaagcc

SEQ ID NO: 4382 - RNA, 21 nt, Artificial Sequence
  Ebola virus siRNA sense strand
caaaugcaacaaacgaagcca

SEQ ID NO: 4383 - RNA, 21 nt, Artificial Sequence
  Ebola virus siRNA sense strand
aaaugcaacaaacgaagccaa

SEQ ID NO: 4384 - RNA, 21 nt, Artificial Sequence
  Ebola virus siRNA sense strand
aaugcaacaaacgaagccaaa

SEQ ID NO: 4385 - RNA, 21 nt, Artificial Sequence
  Ebola virus siRNA sense strand
augcaacaaacgaagccaaac

SEQ ID NO: 4386 - RNA, 21 nt, Artificial Sequence
  Ebola virus siRNA sense strand
ugcaacaaacgaagccaaacc

SEQ ID NO: 4387 - RNA, 21 nt, Artificial Sequence
  Ebola virus siRNA sense strand
gcaacaaacgaagccaaaccc

SEQ ID NO: 4388 - RNA, 21 nt, Artificial Sequence
  Ebola virus siRNA sense strand
caacaaacgaagccaaacccg

SEQ ID NO: 4389 - RNA, 21 nt, Artificial Sequence
  Ebola virus siRNA sense strand
aacaaacgaagccaaacccga

SEQ ID NO: 4390 - RNA, 21 nt, Artificial Sequence
  Ebola virus siRNA sense strand
acaaacgaagccaaacccgaa

SEQ ID NO: 4391 - RNA, 21 nt, Artificial Sequence
  Ebola virus siRNA sense strand
caaacgaagccaaacccgaag

SEQ ID NO: 4392 - RNA, 21 nt, Artificial Sequence
  Ebola virus siRNA sense strand
aaacgaagccaaacccgaaga

SEQ ID NO: 4393 - RNA, 21 nt, Artificial Sequence
  Ebola virus siRNA sense strand
aacgaagccaaacccgaagac

SEQ ID NO: 4394 - RNA, 21 nt, Artificial Sequence
  Ebola virus siRNA sense strand
acgaagccaaacccgaagacg

SEQ ID NO: 4395 - RNA, 21 nt, Artificial Sequence
  Ebola virus siRNA sense strand
cgaagccaaacccgaagacgc

SEQ ID NO: 4396 - RNA, 21 nt, Artificial Sequence
  Ebola virus siRNA sense strand
gaagccaaacccgaagacgcg

SEQ ID NO: 4397 - RNA, 21 nt, Artificial Sequence
  Ebola virus siRNA sense strand
aagccaaacccgaagacgcgc

SEQ ID NO: 4398 - RNA, 21 nt, Artificial Sequence
  Ebola virus siRNA sense strand
agccaaacccgaagacgcgca

SEQ ID NO: 4399 - RNA, 21 nt, Artificial Sequence
  Ebola virus siRNA sense strand
gccaaacccgaagacgcgcaa

SEQ ID NO: 4400 - RNA, 21 nt, Artificial Sequence
  Ebola virus siRNA sense strand
ccaaacccgaagacgcgcaac

SEQ ID NO: 4401 - RNA, 21 nt, Artificial Sequence
  Ebola virus siRNA sense strand
caaacccgaagacgcgcaaca

SEQ ID NO: 4402 - RNA, 21 nt, Artificial Sequence
  Ebola virus siRNA sense strand
aaacccgaagacgcgcaacag

SEQ ID NO: 4403 - RNA, 21 nt, Artificial Sequence
  Ebola virus siRNA sense strand
aacccgaagacgcgcaacagu

SEQ ID NO: 4404 - RNA, 21 nt, Artificial Sequence
  Ebola virus siRNA sense strand
acccgaagacgcgcaacaguc

SEQ ID NO: 4405 - RNA, 21 nt, Artificial Sequence
  Ebola virus siRNA sense strand
cccgaagacgcgcaacaguca

SEQ ID NO: 4406 - RNA, 21 nt, Artificial Sequence
  Ebola virus siRNA sense strand
ccgaagacgcgcaacagucaa

SEQ ID NO: 4407 - RNA, 21 nt, Artificial Sequence
  Ebola virus siRNA sense strand
cgaagacgcgcaacagucaaa

SEQ ID NO: 4408 - RNA, 21 nt, Artificial Sequence
  Ebola virus siRNA sense strand
gaagacgcgcaacagucaaac

SEQ ID NO: 4409 - RNA, 21 nt, Artificial Sequence
  Ebola virus siRNA sense strand
aagacgcgcaacagucaaacc

SEQ ID NO: 4410 - RNA, 21 nt, Artificial Sequence
  Ebola virus siRNA sense strand
agacgcgcaacagucaaaccc

SEQ ID NO: 4411 - RNA, 21 nt, Artificial Sequence
  Ebola virus siRNA sense strand
gacgcgcaacagucaaaccca

SEQ ID NO: 4412 - RNA, 21 nt, Artificial Sequence
  Ebola virus siRNA sense strand
acgcgcaacagucaaacccaa

SEQ ID NO: 4413 - RNA, 21 nt, Artificial Sequence
  Ebola virus siRNA sense strand
cgcgcaacagucaaacccaaa

SEQ ID NO: 4414 - RNA, 21 nt, Artificial Sequence
  Ebola virus siRNA sense strand
gcgcaacagucaaacccaaac

SEQ ID NO: 4415 - RNA, 21 nt, Artificial Sequence
  Ebola virus siRNA sense strand
cgcaacagucaaacccaaacg

SEQ ID NO: 4416 - RNA, 21 nt, Artificial Sequence
  Ebola virus siRNA sense strand
gcaacagucaaacccaaacgg

SEQ ID NO: 4417 - RNA, 21 nt, Artificial Sequence
  Ebola virus siRNA sense strand
caacagucaaacccaaacgga

SEQ ID NO: 4418 - RNA, 21 nt, Artificial Sequence
  Ebola virus siRNA sense strand
aacagucaaacccaaacggac

SEQ ID NO: 4419 - RNA, 21 nt, Artificial Sequence
  Ebola virus siRNA sense strand
acagucaaacccaaacggacc

SEQ ID NO: 4420 - RNA, 21 nt, Artificial Sequence
  Ebola virus siRNA sense strand
cagucaaacccaaacggaccc

SEQ ID NO: 4421 - RNA, 21 nt, Artificial Sequence
  Ebola virus siRNA sense strand
agucaaacccaaacggaccca

SEQ ID NO: 4422 - RNA, 21 nt, Artificial Sequence
  Ebola virus siRNA sense strand
gucaaacccaaacggacccaa

SEQ ID NO: 4423 - RNA, 21 nt, Artificial Sequence
  Ebola virus siRNA sense strand
ucaaacccaaacggacccaau

SEQ ID NO: 4424 - RNA, 21 nt, Artificial Sequence
  Ebola virus siRNA sense strand
caaacccaaacggacccaauu

SEQ ID NO: 4425 - RNA, 21 nt, Artificial Sequence
  Ebola virus siRNA sense strand
aaacccaaacggacccaauuu

SEQ ID NO: 4426 - RNA, 21 nt, Artificial Sequence
  Ebola virus siRNA sense strand
aacccaaacggacccaauuug

SEQ ID NO: 4427 - RNA, 21 nt, Artificial Sequence
  Ebola virus siRNA sense strand
acccaaacggacccaauuugc

SEQ ID NO: 4428 - RNA, 21 nt, Artificial Sequence
  Ebola virus siRNA sense strand
cccaaacggacccaauuugca

SEQ ID NO: 4429 - RNA, 21 nt, Artificial Sequence
  Ebola virus siRNA sense strand
ccaaacggacccaauuugcaa

SEQ ID NO: 4430 - RNA, 21 nt, Artificial Sequence
  Ebola virus siRNA sense strand
caaacggacccaauuugcaau

SEQ ID NO: 4431 - RNA, 21 nt, Artificial Sequence
  Ebola virus siRNA sense strand
aaacggacccaauuugcaauc

SEQ ID NO: 4432 - RNA, 21 nt, Artificial Sequence
  Ebola virus siRNA sense strand
aacggacccaauuugcaauca

SEQ ID NO: 4433 - RNA, 21 nt, Artificial Sequence
  Ebola virus siRNA sense strand
acggacccaauuugcaaucau

SEQ ID NO: 4434 - RNA, 21 nt, Artificial Sequence
  Ebola virus siRNA sense strand
cggacccaauuugcaaucaua

SEQ ID NO: 4435 - RNA, 21 nt, Artificial Sequence
  Ebola virus siRNA sense strand
ggacccaauuugcaaucauag

SEQ ID NO: 4436 - RNA, 21 nt, Artificial Sequence
  Ebola virus siRNA sense strand
gacccaauuugcaaucauagu

SEQ ID NO: 4437 - RNA, 21 nt, Artificial Sequence
  Ebola virus siRNA sense strand
acccaauuugcaaucauaguu

SEQ ID NO: 4438 - RNA, 21 nt, Artificial Sequence
  Ebola virus siRNA sense strand
cccaauuugcaaucauaguuu

SEQ ID NO: 4439 - RNA, 21 nt, Artificial Sequence
  Ebola virus siRNA sense strand
ccaauuugcaaucauaguuuu

SEQ ID NO: 4440 - RNA, 21 nt, Artificial Sequence
  Ebola virus siRNA sense strand
caauuugcaaucauaguuuug

SEQ ID NO: 4441 - RNA, 21 nt, Artificial Sequence
  Ebola virus siRNA sense strand
aauuugcaaucauaguuuuga

SEQ ID NO: 4442 - RNA, 21 nt, Artificial Sequence
  Ebola virus siRNA sense strand
auuugcaaucauaguuuugag

SEQ ID NO: 4443 - RNA, 21 nt, Artificial Sequence
  Ebola virus siRNA sense strand
uuugcaaucauaguuuugagg

SEQ ID NO: 4444 - RNA, 21 nt, Artificial Sequence
  Ebola virus siRNA sense strand
uugcaaucauaguuuugagga

SEQ ID NO: 4445 - RNA, 21 nt, Artificial Sequence
  Ebola virus siRNA sense strand
ugcaaucauaguuuugaggag

SEQ ID NO: 4446 - RNA, 21 nt, Artificial Sequence
  Ebola virus siRNA sense strand
gcaaucauaguuuugaggagg

SEQ ID NO: 4447 - RNA, 21 nt, Artificial Sequence
  Ebola virus siRNA sense strand
caaucauaguuuugaggaggu

SEQ ID NO: 4448 - RNA, 21 nt, Artificial Sequence
  Ebola virus siRNA sense strand
aaucauaguuuugaggaggua

SEQ ID NO: 4449 - RNA, 21 nt, Artificial Sequence
  Ebola virus siRNA sense strand
aucauaguuuugaggagguag

SEQ ID NO: 4450 - RNA, 21 nt, Artificial Sequence
  Ebola virus siRNA sense strand
ucauaguuuugaggagguagu

SEQ ID NO: 4451 - RNA, 21 nt, Artificial Sequence
  Ebola virus siRNA sense strand
cauaguuuugaggagguagua

SEQ ID NO: 4452 - RNA, 21 nt, Artificial Sequence
  Ebola virus siRNA sense strand
auaguuuugaggagguaguac

SEQ ID NO: 4453 - RNA, 21 nt, Artificial Sequence
  Ebola virus siRNA sense strand
uaguuuugaggagguaguaca

SEQ ID NO: 4454 - RNA, 21 nt, Artificial Sequence
  Ebola virus siRNA sense strand
aguuuugaggagguaguacaa

SEQ ID NO: 4455 - RNA, 21 nt, Artificial Sequence
  Ebola virus siRNA sense strand
guuuugaggagguaguacaaa

SEQ ID NO: 4456 - RNA, 21 nt, Artificial Sequence
  Ebola virus siRNA sense strand
uuuugaggagguaguacaaac

SEQ ID NO: 4457 - RNA, 21 nt, Artificial Sequence
  Ebola virus siRNA sense strand
uuugaggagguaguacaaaca

SEQ ID NO: 4458 - RNA, 21 nt, Artificial Sequence
  Ebola virus siRNA sense strand
uugaggagguaguacaaacau

SEQ ID NO: 4459 - RNA, 21 nt, Artificial Sequence
  Ebola virus siRNA sense strand
ugaggagguaguacaaacauu

SEQ ID NO: 4460 - RNA, 21 nt, Artificial Sequence
  Ebola virus siRNA sense strand
gaggagguaguacaaacauug

SEQ ID NO: 4461 - RNA, 21 nt, Artificial Sequence
  Ebola virus siRNA sense strand
aggagguaguacaaacauugg

SEQ ID NO: 4462 - RNA, 21 nt, Artificial Sequence
  Ebola virus siRNA sense strand
ggagguaguacaaacauuggc

SEQ ID NO: 4463 - RNA, 21 nt, Artificial Sequence
  Ebola virus siRNA sense strand
gagguaguacaaacauuggcu

SEQ ID NO: 4464 - RNA, 21 nt, Artificial Sequence
  Ebola virus siRNA sense strand
agguaguacaaacauuggcuu

SEQ ID NO: 4465 - RNA, 21 nt, Artificial Sequence
  Ebola virus siRNA sense strand
gguaguacaaacauuggcuuc

SEQ ID NO: 4466 - RNA, 21 nt, Artificial Sequence
  Ebola virus siRNA sense strand
guaguacaaacauuggcuuca

SEQ ID NO: 4467 - RNA, 21 nt, Artificial Sequence
  Ebola virus siRNA sense strand
uaguacaaacauuggcuucau

SEQ ID NO: 4468 - RNA, 21 nt, Artificial Sequence
  Ebola virus siRNA sense strand
aguacaaacauuggcuucauu

SEQ ID NO: 4469 - RNA, 21 nt, Artificial Sequence
  Ebola virus siRNA sense strand
guacaaacauuggcuucauug

SEQ ID NO: 4470 - RNA, 21 nt, Artificial Sequence
  Ebola virus siRNA sense strand
uacaaacauuggcuucauugg

SEQ ID NO: 4471 - RNA, 21 nt, Artificial Sequence
  Ebola virus siRNA sense strand
acaaacauuggcuucauuggc

SEQ ID NO: 4472 - RNA, 21 nt, Artificial Sequence
  Ebola virus siRNA sense strand
caaacauuggcuucauuggcu

SEQ ID NO: 4473 - RNA, 21 nt, Artificial Sequence
  Ebola virus siRNA sense strand
aaacauuggcuucauuggcua

SEQ ID NO: 4474 - RNA, 21 nt, Artificial Sequence
  Ebola virus siRNA sense strand
aacauuggcuucauuggcuac

SEQ ID NO: 4475 - RNA, 21 nt, Artificial Sequence
  Ebola virus siRNA sense strand
acauuggcuucauuggcuacu

SEQ ID NO: 4476 - RNA, 21 nt, Artificial Sequence
  Ebola virus siRNA sense strand
cauuggcuucauuggcuacug

SEQ ID NO: 4477 - RNA, 21 nt, Artificial Sequence
  Ebola virus siRNA sense strand
auuggcuucauuggcuacugu

SEQ ID NO: 4478 - RNA, 21 nt, Artificial Sequence
  Ebola virus siRNA sense strand
uuggcuucauuggcuacuguu

SEQ ID NO: 4479 - RNA, 21 nt, Artificial Sequence
  Ebola virus siRNA sense strand
uggcuucauuggcuacuguug

SEQ ID NO: 4480 - RNA, 21 nt, Artificial Sequence
  Ebola virus siRNA sense strand
ggcuucauuggcuacuguugu

SEQ ID NO: 4481 - RNA, 21 nt, Artificial Sequence
  Ebola virus siRNA sense strand
gcuucauuggcuacuguugug

SEQ ID NO: 4482 - RNA, 21 nt, Artificial Sequence
  Ebola virus siRNA sense strand
cuucauuggcuacuguugugc

SEQ ID NO: 4483 - RNA, 21 nt, Artificial Sequence
  Ebola virus siRNA sense strand
uucauuggcuacuguugugca

SEQ ID NO: 4484 - RNA, 21 nt, Artificial Sequence
  Ebola virus siRNA sense strand
ucauuggcuacuguugugcaa

SEQ ID NO: 4485 - RNA, 21 nt, Artificial Sequence
  Ebola virus siRNA sense strand
cauuggcuacuguugugcaac

SEQ ID NO: 4486 - RNA, 21 nt, Artificial Sequence
  Ebola virus siRNA sense strand
auuggcuacuguugugcaaca

SEQ ID NO: 4487 - RNA, 21 nt, Artificial Sequence
  Ebola virus siRNA sense strand
uuggcuacuguugugcaacaa

SEQ ID NO: 4488 - RNA, 21 nt, Artificial Sequence
  Ebola virus siRNA sense strand
uggcuacuguugugcaacaac

SEQ ID NO: 4489 - RNA, 21 nt, Artificial Sequence
  Ebola virus siRNA sense strand
ggcuacuguugugcaacaaca

SEQ ID NO: 4490 - RNA, 21 nt, Artificial Sequence
  Ebola virus siRNA sense strand
gcuacuguugugcaacaacaa

SEQ ID NO: 4491 - RNA, 21 nt, Artificial Sequence
  Ebola virus siRNA sense strand
cuacuguugugcaacaacaaa

SEQ ID NO: 4492 - RNA, 21 nt, Artificial Sequence
  Ebola virus siRNA sense strand
uacuguugugcaacaacaaac

SEQ ID NO: 4493 - RNA, 21 nt, Artificial Sequence
  Ebola virus siRNA sense strand
acuguugugcaacaacaaacc

SEQ ID NO: 4494 - RNA, 21 nt, Artificial Sequence
  Ebola virus siRNA sense strand
cuguugugcaacaacaaacca

SEQ ID NO: 4495 - RNA, 21 nt, Artificial Sequence
  Ebola virus siRNA sense strand
uguugugcaacaacaaaccau

SEQ ID NO: 4496 - RNA, 21 nt, Artificial Sequence
  Ebola virus siRNA sense strand
guugugcaacaacaaaccauc

SEQ ID NO: 4497 - RNA, 21 nt, Artificial Sequence
  Ebola virus siRNA sense strand
uugugcaacaacaaaccaucg

SEQ ID NO: 4498 - RNA, 21 nt, Artificial Sequence
  Ebola virus siRNA sense strand
ugugcaacaacaaaccaucgc

SEQ ID NO: 4499 - RNA, 21 nt, Artificial Sequence
  Ebola virus siRNA sense strand
gugcaacaacaaaccaucgca

SEQ ID NO: 4500 - RNA, 21 nt, Artificial Sequence
  Ebola virus siRNA sense strand
ugcaacaacaaaccaucgcau

SEQ ID NO: 4501 - RNA, 21 nt, Artificial Sequence
  Ebola virus siRNA sense strand
gcaacaacaaaccaucgcauc

SEQ ID NO: 4502 - RNA, 21 nt, Artificial Sequence
  Ebola virus siRNA sense strand
caacaacaaaccaucgcauca

SEQ ID NO: 4503 - RNA, 21 nt, Artificial Sequence
  Ebola virus siRNA sense strand
aacaacaaaccaucgcaucag

SEQ ID NO: 4504 - RNA, 21 nt, Artificial Sequence
  Ebola virus siRNA sense strand
acaacaaaccaucgcaucaga

SEQ ID NO: 4505 - RNA, 21 nt, Artificial Sequence
  Ebola virus siRNA sense strand
caacaaaccaucgcaucagaa

SEQ ID NO: 4506 - RNA, 21 nt, Artificial Sequence
  Ebola virus siRNA sense strand
aacaaaccaucgcaucagaau

SEQ ID NO: 4507 - RNA, 21 nt, Artificial Sequence
  Ebola virus siRNA sense strand
acaaaccaucgcaucagaauc

SEQ ID NO: 4508 - RNA, 21 nt, Artificial Sequence
  Ebola virus siRNA sense strand
caaaccaucgcaucagaauca

SEQ ID NO: 4509 - RNA, 21 nt, Artificial Sequence
  Ebola virus siRNA sense strand
aaaccaucgcaucagaaucau

SEQ ID NO: 4510 - RNA, 21 nt, Artificial Sequence
  Ebola virus siRNA sense strand
aaccaucgcaucagaaucauu

SEQ ID NO: 4511 - RNA, 21 nt, Artificial Sequence
  Ebola virus siRNA sense strand
accaucgcaucagaaucauua

SEQ ID NO: 4512 - RNA, 21 nt, Artificial Sequence
  Ebola virus siRNA sense strand
ccaucgcaucagaaucauuag

SEQ ID NO: 4513 - RNA, 21 nt, Artificial Sequence
  Ebola virus siRNA sense strand
caucgcaucagaaucauuaga

SEQ ID NO: 4514 - RNA, 21 nt, Artificial Sequence
  Ebola virus siRNA sense strand
aucgcaucagaaucauuagaa

SEQ ID NO: 4515 - RNA, 21 nt, Artificial Sequence
  Ebola virus siRNA sense strand
ucgcaucagaaucauuagaac

SEQ ID NO: 4516 - RNA, 21 nt, Artificial Sequence
  Ebola virus siRNA sense strand
cgcaucagaaucauuagaaca

SEQ ID NO: 4517 - RNA, 21 nt, Artificial Sequence
  Ebola virus siRNA sense strand
gcaucagaaucauuagaacaa

SEQ ID NO: 4518 - RNA, 21 nt, Artificial Sequence
  Ebola virus siRNA sense strand
caucagaaucauuagaacaac

SEQ ID NO: 4519 - RNA, 21 nt, Artificial Sequence
  Ebola virus siRNA sense strand
aucagaaucauuagaacaacg

SEQ ID NO: 4520 - RNA, 21 nt, Artificial Sequence
  Ebola virus siRNA sense strand
ucagaaucauuagaacaacgc

SEQ ID NO: 4521 - RNA, 21 nt, Artificial Sequence
  Ebola virus siRNA sense strand
cagaaucauuagaacaacgca

SEQ ID NO: 4522 - RNA, 21 nt, Artificial Sequence
  Ebola virus siRNA sense strand
agaaucauuagaacaacgcau

SEQ ID NO: 4523 - RNA, 21 nt, Artificial Sequence
  Ebola virus siRNA sense strand
gaaucauuagaacaacgcauu

SEQ ID NO: 4524 - RNA, 21 nt, Artificial Sequence
  Ebola virus siRNA sense strand
aaucauuagaacaacgcauua

SEQ ID NO: 4525 - RNA, 21 nt, Artificial Sequence
  Ebola virus siRNA sense strand
aucauuagaacaacgcauuac

SEQ ID NO: 4526 - RNA, 21 nt, Artificial Sequence
  Ebola virus siRNA sense strand
ucauuagaacaacgcauuacg

SEQ ID NO: 4527 - RNA, 21 nt, Artificial Sequence
  Ebola virus siRNA sense strand
cauuagaacaacgcauuacga

SEQ ID NO: 4528 - RNA, 21 nt, Artificial Sequence
  Ebola virus siRNA sense strand
auuagaacaacgcauuacgag

SEQ ID NO: 4529 - RNA, 21 nt, Artificial Sequence
  Ebola virus siRNA sense strand
uuagaacaacgcauuacgagu

SEQ ID NO: 4530 - RNA, 21 nt, Artificial Sequence
  Ebola virus siRNA sense strand
uagaacaacgcauuacgaguc

SEQ ID NO: 4531 - RNA, 21 nt, Artificial Sequence
  Ebola virus siRNA sense strand
agaacaacgcauuacgagucu

SEQ ID NO: 4532 - RNA, 21 nt, Artificial Sequence
  Ebola virus siRNA sense strand
gaacaacgcauuacgagucuu

SEQ ID NO: 4533 - RNA, 21 nt, Artificial Sequence
  Ebola virus siRNA sense strand
aacaacgcauuacgagucuug

SEQ ID NO: 4534 - RNA, 21 nt, Artificial Sequence
  Ebola virus siRNA sense strand
acaacgcauuacgagucuuga

SEQ ID NO: 4535 - RNA, 21 nt, Artificial Sequence
  Ebola virus siRNA sense strand
caacgcauuacgagucuugag

SEQ ID NO: 4536 - RNA, 21 nt, Artificial Sequence
  Ebola virus siRNA sense strand
aacgcauuacgagucuugaga

SEQ ID NO: 4537 - RNA, 21 nt, Artificial Sequence
  Ebola virus siRNA sense strand
acgcauuacgagucuugagaa

SEQ ID NO: 4538 - RNA, 21 nt, Artificial Sequence
  Ebola virus siRNA sense strand
cgcauuacgagucuugagaau

SEQ ID NO: 4539 - RNA, 21 nt, Artificial Sequence
  Ebola virus siRNA sense strand
gcauuacgagucuugagaaug

SEQ ID NO: 4540 - RNA, 21 nt, Artificial Sequence
  Ebola virus siRNA sense strand
cauuacgagucuugagaaugg

SEQ ID NO: 4541 - RNA, 21 nt, Artificial Sequence
  Ebola virus siRNA sense strand
auuacgagucuugagaauggu

SEQ ID NO: 4542 - RNA, 21 nt, Artificial Sequence
  Ebola virus siRNA sense strand
uuacgagucuugagaaugguc

SEQ ID NO: 4543 - RNA, 21 nt, Artificial Sequence
  Ebola virus siRNA sense strand
uacgagucuugagaauggucu

SEQ ID NO: 4544 - RNA, 21 nt, Artificial Sequence
  Ebola virus siRNA sense strand
acgagucuugagaauggucua

SEQ ID NO: 4545 - RNA, 21 nt, Artificial Sequence
  Ebola virus siRNA sense strand
cgagucuugagaauggucuaa

SEQ ID NO: 4546 - RNA, 21 nt, Artificial Sequence
  Ebola virus siRNA sense strand
gagucuugagaauggucuaaa

SEQ ID NO: 4547 - RNA, 21 nt, Artificial Sequence
  Ebola virus siRNA sense strand
agucuugagaauggucuaaag

SEQ ID NO: 4548 - RNA, 21 nt, Artificial Sequence
  Ebola virus siRNA sense strand
gucuugagaauggucuaaagc

SEQ ID NO: 4549 - RNA, 21 nt, Artificial Sequence
  Ebola virus siRNA sense strand
ucuugagaauggucuaaagcc

SEQ ID NO: 4550 - RNA, 21 nt, Artificial Sequence
  Ebola virus siRNA sense strand
cuugagaauggucuaaagcca

SEQ ID NO: 4551 - RNA, 21 nt, Artificial Sequence
  Ebola virus siRNA sense strand
uugagaauggucuaaagccag

SEQ ID NO: 4552 - RNA, 21 nt, Artificial Sequence
  Ebola virus siRNA sense strand
ugagaauggucuaaagccagu

SEQ ID NO: 4553 - RNA, 21 nt, Artificial Sequence
  Ebola virus siRNA sense strand
gagaauggucuaaagccaguu

SEQ ID NO: 4554 - RNA, 21 nt, Artificial Sequence
  Ebola virus siRNA sense strand
agaauggucuaaagccaguuu

SEQ ID NO: 4555 - RNA, 21 nt, Artificial Sequence
  Ebola virus siRNA sense strand
gaauggucuaaagccaguuua

SEQ ID NO: 4556 - RNA, 21 nt, Artificial Sequence
  Ebola virus siRNA sense strand
aauggucuaaagccaguuuau

SEQ ID NO: 4557 - RNA, 21 nt, Artificial Sequence
  Ebola virus siRNA sense strand
auggucuaaagccaguuuaug

SEQ ID NO: 4558 - RNA, 21 nt, Artificial Sequence
  Ebola virus siRNA sense strand
uggucuaaagccaguuuauga

SEQ ID NO: 4559 - RNA, 21 nt, Artificial Sequence
  Ebola virus siRNA sense strand
ggucuaaagccaguuuaugau

SEQ ID NO: 4560 - RNA, 21 nt, Artificial Sequence
  Ebola virus siRNA sense strand
gucuaaagccaguuuaugaua

SEQ ID NO: 4561 - RNA, 21 nt, Artificial Sequence
  Ebola virus siRNA sense strand
ucuaaagccaguuuaugauau

SEQ ID NO: 4562 - RNA, 21 nt, Artificial Sequence
  Ebola virus siRNA sense strand
cuaaagccaguuuaugauaug

SEQ ID NO: 4563 - RNA, 21 nt, Artificial Sequence
  Ebola virus siRNA sense strand
uaaagccaguuuaugauaugg

SEQ ID NO: 4564 - RNA, 21 nt, Artificial Sequence
  Ebola virus siRNA sense strand
aaagccaguuuaugauauggc

SEQ ID NO: 4565 - RNA, 21 nt, Artificial Sequence
  Ebola virus siRNA sense strand
aagccaguuuaugauauggca

SEQ ID NO: 4566 - RNA, 21 nt, Artificial Sequence
  Ebola virus siRNA sense strand
agccaguuuaugauauggcaa

SEQ ID NO: 4567 - RNA, 21 nt, Artificial Sequence
  Ebola virus siRNA sense strand
gccaguuuaugauauggcaaa

SEQ ID NO: 4568 - RNA, 21 nt, Artificial Sequence
  Ebola virus siRNA sense strand
ccaguuuaugauauggcaaaa

SEQ ID NO: 4569 - RNA, 21 nt, Artificial Sequence
  Ebola virus siRNA sense strand
caguuuaugauauggcaaaaa

SEQ ID NO: 4570 - RNA, 21 nt, Artificial Sequence
  Ebola virus siRNA sense strand
aguuuaugauauggcaaaaac

SEQ ID NO: 4571 - RNA, 21 nt, Artificial Sequence
  Ebola virus siRNA sense strand
guuuaugauauggcaaaaaca

SEQ ID NO: 4572 - RNA, 21 nt, Artificial Sequence
  Ebola virus siRNA sense strand
uuuaugauauggcaaaaacaa

SEQ ID NO: 4573 - RNA, 21 nt, Artificial Sequence
  Ebola virus siRNA sense strand
uuaugauauggcaaaaacaau

SEQ ID NO: 4574 - RNA, 21 nt, Artificial Sequence
  Ebola virus siRNA sense strand
uaugauauggcaaaaacaauc

SEQ ID NO: 4575 - RNA, 21 nt, Artificial Sequence
  Ebola virus siRNA sense strand
augauauggcaaaaacaaucu

SEQ ID NO: 4576 - RNA, 21 nt, Artificial Sequence
  Ebola virus siRNA sense strand
ugauauggcaaaaacaaucuc

SEQ ID NO: 4577 - RNA, 21 nt, Artificial Sequence
  Ebola virus siRNA sense strand
gauauggcaaaaacaaucucc

SEQ ID NO: 4578 - RNA, 21 nt, Artificial Sequence
  Ebola virus siRNA sense strand
auauggcaaaaacaaucuccu

SEQ ID NO: 4579 - RNA, 21 nt, Artificial Sequence
  Ebola virus siRNA sense strand
uauggcaaaaacaaucuccuc

SEQ ID NO: 4580 - RNA, 21 nt, Artificial Sequence
  Ebola virus siRNA sense strand
auggcaaaaacaaucuccuca

SEQ ID NO: 4581 - RNA, 21 nt, Artificial Sequence
  Ebola virus siRNA sense strand
uggcaaaaacaaucuccucau

SEQ ID NO: 4582 - RNA, 21 nt, Artificial Sequence
  Ebola virus siRNA sense strand
ggcaaaaacaaucuccucauu

SEQ ID NO: 4583 - RNA, 21 nt, Artificial Sequence
  Ebola virus siRNA sense strand
gcaaaaacaaucuccucauug

SEQ ID NO: 4584 - RNA, 21 nt, Artificial Sequence
  Ebola virus siRNA sense strand
caaaaacaaucuccucauuga

SEQ ID NO: 4585 - RNA, 21 nt, Artificial Sequence
  Ebola virus siRNA sense strand
aaaaacaaucuccucauugaa

SEQ ID NO: 4586 - RNA, 21 nt, Artificial Sequence
  Ebola virus siRNA sense strand
aaaacaaucuccucauugaac

SEQ ID NO: 4587 - RNA, 21 nt, Artificial Sequence
  Ebola virus siRNA sense strand
aaacaaucuccucauugaaca

SEQ ID NO: 4588 - RNA, 21 nt, Artificial Sequence
  Ebola virus siRNA sense strand
aacaaucuccucauugaacag

SEQ ID NO: 4589 - RNA, 21 nt, Artificial Sequence
  Ebola virus siRNA sense strand
acaaucuccucauugaacagg

SEQ ID NO: 4590 - RNA, 21 nt, Artificial Sequence
  Ebola virus siRNA sense strand
caaucuccucauugaacaggg

SEQ ID NO: 4591 - RNA, 21 nt, Artificial Sequence
  Ebola virus siRNA sense strand
aaucuccucauugaacagggu

SEQ ID NO: 4592 - RNA, 21 nt, Artificial Sequence
  Ebola virus siRNA sense strand
aucuccucauugaacaggguu

SEQ ID NO: 4593 - RNA, 21 nt, Artificial Sequence
  Ebola virus siRNA sense strand
ucuccucauugaacaggguuu

SEQ ID NO: 4594 - RNA, 21 nt, Artificial Sequence
  Ebola virus siRNA sense strand
cuccucauugaacaggguuug

SEQ ID NO: 4595 - RNA, 21 nt, Artificial Sequence
  Ebola virus siRNA sense strand
uccucauugaacaggguuugu

SEQ ID NO: 4596 - RNA, 21 nt, Artificial Sequence
  Ebola virus siRNA sense strand
ccucauugaacaggguuugug

SEQ ID NO: 4597 - RNA, 21 nt, Artificial Sequence
  Ebola virus siRNA sense strand
cucauugaacaggguuugugc

SEQ ID NO: 4598 - RNA, 21 nt, Artificial Sequence
  Ebola virus siRNA sense strand
ucauugaacaggguuugugcu

SEQ ID NO: 4599 - RNA, 21 nt, Artificial Sequence
  Ebola virus siRNA sense strand
cauugaacaggguuugugcug

SEQ ID NO: 4600 - RNA, 21 nt, Artificial Sequence
  Ebola virus siRNA sense strand
auugaacaggguuugugcuga

SEQ ID NO: 4601 - RNA, 21 nt, Artificial Sequence
  Ebola virus siRNA sense strand
uugaacaggguuugugcugag

SEQ ID NO: 4602 - RNA, 21 nt, Artificial Sequence
  Ebola virus siRNA sense strand
ugaacaggguuugugcugaga

SEQ ID NO: 4603 - RNA, 21 nt, Artificial Sequence
  Ebola virus siRNA sense strand
gaacaggguuugugcugagau

SEQ ID NO: 4604 - RNA, 21 nt, Artificial Sequence
  Ebola virus siRNA sense strand
aacaggguuugugcugagaug

SEQ ID NO: 4605 - RNA, 21 nt, Artificial Sequence
  Ebola virus siRNA sense strand
acaggguuugugcugagaugg

SEQ ID NO: 4606 - RNA, 21 nt, Artificial Sequence
  Ebola virus siRNA sense strand
caggguuugugcugagauggu

SEQ ID NO: 4607 - RNA, 21 nt, Artificial Sequence
  Ebola virus siRNA sense strand
aggguuugugcugagaugguu

SEQ ID NO: 4608 - RNA, 21 nt, Artificial Sequence
  Ebola virus siRNA sense strand
ggguuugugcugagaugguug

SEQ ID NO: 4609 - RNA, 21 nt, Artificial Sequence
  Ebola virus siRNA sense strand
gguuugugcugagaugguugc

SEQ ID NO: 4610 - RNA, 21 nt, Artificial Sequence
  Ebola virus siRNA sense strand
guuugugcugagaugguugca

SEQ ID NO: 4611 - RNA, 21 nt, Artificial Sequence
  Ebola virus siRNA sense strand
uuugugcugagaugguugcaa

SEQ ID NO: 4612 - RNA, 21 nt, Artificial Sequence
  Ebola virus siRNA sense strand
uugugcugagaugguugcaaa

SEQ ID NO: 4613 - RNA, 21 nt, Artificial Sequence
  Ebola virus siRNA sense strand
ugugcugagaugguugcaaaa

SEQ ID NO: 4614 - RNA, 21 nt, Artificial Sequence
  Ebola virus siRNA sense strand
gugcugagaugguugcaaaau

SEQ ID NO: 4615 - RNA, 21 nt, Artificial Sequence
  Ebola virus siRNA sense strand
ugcugagaugguugcaaaaua

SEQ ID NO: 4616 - RNA, 21 nt, Artificial Sequence
  Ebola virus siRNA sense strand
gcugagaugguugcaaaauau

SEQ ID NO: 4617 - RNA, 21 nt, Artificial Sequence
  Ebola virus siRNA sense strand
cugagaugguugcaaaauaug

SEQ ID NO: 4618 - RNA, 21 nt, Artificial Sequence
  Ebola virus siRNA sense strand
ugagaugguugcaaaauauga

SEQ ID NO: 4619 - RNA, 21 nt, Artificial Sequence
  Ebola virus siRNA sense strand
gagaugguugcaaaauaugau

SEQ ID NO: 4620 - RNA, 21 nt, Artificial Sequence
  Ebola virus siRNA sense strand
agaugguugcaaaauaugauc

SEQ ID NO: 4621 - RNA, 21 nt, Artificial Sequence
  Ebola virus siRNA sense strand
gaugguugcaaaauaugaucu

SEQ ID NO: 4622 - RNA, 21 nt, Artificial Sequence
  Ebola virus siRNA sense strand
augguugcaaaauaugaucuu

SEQ ID NO: 4623 - RNA, 21 nt, Artificial Sequence
  Ebola virus siRNA sense strand
ugguugcaaaauaugaucuuc

SEQ ID NO: 4624 - RNA, 21 nt, Artificial Sequence
  Ebola virus siRNA sense strand
gguugcaaaauaugaucuucu

SEQ ID NO: 4625 - RNA, 21 nt, Artificial Sequence
  Ebola virus siRNA sense strand
guugcaaaauaugaucuucug

SEQ ID NO: 4626 - RNA, 21 nt, Artificial Sequence
  Ebola virus siRNA sense strand
uugcaaaauaugaucuucugg

SEQ ID NO: 4627 - RNA, 21 nt, Artificial Sequence
  Ebola virus siRNA sense strand
ugcaaaauaugaucuucuggu

SEQ ID NO: 4628 - RNA, 21 nt, Artificial Sequence
  Ebola virus siRNA sense strand
gcaaaauaugaucuucuggug

SEQ ID NO: 4629 - RNA, 21 nt, Artificial Sequence
  Ebola virus siRNA sense strand
caaaauaugaucuucugguga

SEQ ID NO: 4630 - RNA, 21 nt, Artificial Sequence
  Ebola virus siRNA sense strand
aaaauaugaucuucuggugau

SEQ ID NO: 4631 - RNA, 21 nt, Artificial Sequence
  Ebola virus siRNA sense strand
aaauaugaucuucuggugaug

SEQ ID NO: 4632 - RNA, 21 nt, Artificial Sequence
  Ebola virus siRNA sense strand
aauaugaucuucuggugauga

SEQ ID NO: 4633 - RNA, 21 nt, Artificial Sequence
  Ebola virus siRNA sense strand
auaugaucuucuggugaugac

SEQ ID NO: 4634 - RNA, 21 nt, Artificial Sequence
  Ebola virus siRNA sense strand
uaugaucuucuggugaugaca

SEQ ID NO: 4635 - RNA, 21 nt, Artificial Sequence
  Ebola virus siRNA sense strand
augaucuucuggugaugacaa

SEQ ID NO: 4636 - RNA, 21 nt, Artificial Sequence
  Ebola virus siRNA sense strand
ugaucuucuggugaugacaac

SEQ ID NO: 4637 - RNA, 21 nt, Artificial Sequence
  Ebola virus siRNA sense strand
gaucuucuggugaugacaacc

SEQ ID NO: 4638 - RNA, 21 nt, Artificial Sequence
  Ebola virus siRNA sense strand
aucuucuggugaugacaaccg

SEQ ID NO: 4639 - RNA, 21 nt, Artificial Sequence
  Ebola virus siRNA sense strand
ucuucuggugaugacaaccgg

SEQ ID NO: 4640 - RNA, 21 nt, Artificial Sequence
  Ebola virus siRNA sense strand
cuucuggugaugacaaccggu

SEQ ID NO: 4641 - RNA, 21 nt, Artificial Sequence
  Ebola virus siRNA sense strand
uucuggugaugacaaccgguc

SEQ ID NO: 4642 - RNA, 21 nt, Artificial Sequence
  Ebola virus siRNA sense strand
ucuggugaugacaaccggucg

SEQ ID NO: 4643 - RNA, 21 nt, Artificial Sequence
  Ebola virus siRNA sense strand
cuggugaugacaaccggucgg

SEQ ID NO: 4644 - RNA, 21 nt, Artificial Sequence
  Ebola virus siRNA sense strand
uggugaugacaaccggucggg

SEQ ID NO: 4645 - RNA, 21 nt, Artificial Sequence
  Ebola virus siRNA sense strand
ggugaugacaaccggucgggc

SEQ ID NO: 4646 - RNA, 21 nt, Artificial Sequence
  Ebola virus siRNA sense strand
gugaugacaaccggucgggca

SEQ ID NO: 4647 - RNA, 21 nt, Artificial Sequence
  Ebola virus siRNA sense strand
ugaugacaaccggucgggcaa

SEQ ID NO: 4648 - RNA, 21 nt, Artificial Sequence
  Ebola virus siRNA sense strand
gaugacaaccggucgggcaac

SEQ ID NO: 4649 - RNA, 21 nt, Artificial Sequence
  Ebola virus siRNA sense strand
augacaaccggucgggcaaca

SEQ ID NO: 4650 - RNA, 21 nt, Artificial Sequence
  Ebola virus siRNA sense strand
ugacaaccggucgggcaacag

SEQ ID NO: 4651 - RNA, 21 nt, Artificial Sequence
  Ebola virus siRNA sense strand
gacaaccggucgggcaacagc

SEQ ID NO: 4652 - RNA, 21 nt, Artificial Sequence
  Ebola virus siRNA sense strand
acaaccggucgggcaacagca

SEQ ID NO: 4653 - RNA, 21 nt, Artificial Sequence
  Ebola virus siRNA sense strand
caaccggucgggcaacagcaa

SEQ ID NO: 4654 - RNA, 21 nt, Artificial Sequence
  Ebola virus siRNA sense strand
aaccggucgggcaacagcaac

SEQ ID NO: 4655 - RNA, 21 nt, Artificial Sequence
  Ebola virus siRNA sense strand
accggucgggcaacagcaacc

SEQ ID NO: 4656 - RNA, 21 nt, Artificial Sequence
  Ebola virus siRNA sense strand
ccggucgggcaacagcaaccg

SEQ ID NO: 4657 - RNA, 21 nt, Artificial Sequence
  Ebola virus siRNA sense strand
cggucgggcaacagcaaccgc

SEQ ID NO: 4658 - RNA, 21 nt, Artificial Sequence
  Ebola virus siRNA sense strand
ggucgggcaacagcaaccgcu

SEQ ID NO: 4659 - RNA, 21 nt, Artificial Sequence
  Ebola virus siRNA sense strand
gucgggcaacagcaaccgcug

SEQ ID NO: 4660 - RNA, 21 nt, Artificial Sequence
  Ebola virus siRNA sense strand
ucgggcaacagcaaccgcugc

SEQ ID NO: 4661 - RNA, 21 nt, Artificial Sequence
  Ebola virus siRNA sense strand
cgggcaacagcaaccgcugcg

SEQ ID NO: 4662 - RNA, 21 nt, Artificial Sequence
  Ebola virus siRNA sense strand
gggcaacagcaaccgcugcgg

SEQ ID NO: 4663 - RNA, 21 nt, Artificial Sequence
  Ebola virus siRNA sense strand
ggcaacagcaaccgcugcggc

SEQ ID NO: 4664 - RNA, 21 nt, Artificial Sequence
  Ebola virus siRNA sense strand
gcaacagcaaccgcugcggca

SEQ ID NO: 4665 - RNA, 21 nt, Artificial Sequence
  Ebola virus siRNA sense strand
caacagcaaccgcugcggcaa

SEQ ID NO: 4666 - RNA, 21 nt, Artificial Sequence
  Ebola virus siRNA sense strand
aacagcaaccgcugcggcaac

SEQ ID NO: 4667 - RNA, 21 nt, Artificial Sequence
  Ebola virus siRNA sense strand
acagcaaccgcugcggcaacu

SEQ ID NO: 4668 - RNA, 21 nt, Artificial Sequence
  Ebola virus siRNA sense strand
cagcaaccgcugcggcaacug

SEQ ID NO: 4669 - RNA, 21 nt, Artificial Sequence
  Ebola virus siRNA sense strand
agcaaccgcugcggcaacuga

SEQ ID NO: 4670 - RNA, 21 nt, Artificial Sequence
  Ebola virus siRNA sense strand
gcaaccgcugcggcaacugag

SEQ ID NO: 4671 - RNA, 21 nt, Artificial Sequence
  Ebola virus siRNA sense strand
caaccgcugcggcaacugagg

SEQ ID NO: 4672 - RNA, 21 nt, Artificial Sequence
  Ebola virus siRNA sense strand
aaccgcugcggcaacugaggc

SEQ ID NO: 4673 - RNA, 21 nt, Artificial Sequence
  Ebola virus siRNA sense strand
accgcugcggcaacugaggcu

SEQ ID NO: 4674 - RNA, 21 nt, Artificial Sequence
  Ebola virus siRNA sense strand
ccgcugcggcaacugaggcuu

SEQ ID NO: 4675 - RNA, 21 nt, Artificial Sequence
  Ebola virus siRNA sense strand
cgcugcggcaacugaggcuua

SEQ ID NO: 4676 - RNA, 21 nt, Artificial Sequence
  Ebola virus siRNA sense strand
gcugcggcaacugaggcuuau

SEQ ID NO: 4677 - RNA, 21 nt, Artificial Sequence
  Ebola virus siRNA sense strand
cugcggcaacugaggcuuauu

SEQ ID NO: 4678 - RNA, 21 nt, Artificial Sequence
  Ebola virus siRNA sense strand
ugcggcaacugaggcuuauug

SEQ ID NO: 4679 - RNA, 21 nt, Artificial Sequence
  Ebola virus siRNA sense strand
gcggcaacugaggcuuauugg

SEQ ID NO: 4680 - RNA, 21 nt, Artificial Sequence
  Ebola virus siRNA sense strand
cggcaacugaggcuuauuggg

SEQ ID NO: 4681 - RNA, 21 nt, Artificial Sequence
  Ebola virus siRNA sense strand
ggcaacugaggcuuauugggc

SEQ ID NO: 4682 - RNA, 21 nt, Artificial Sequence
  Ebola virus siRNA sense strand
gcaacugaggcuuauugggcc

SEQ ID NO: 4683 - RNA, 21 nt, Artificial Sequence
  Ebola virus siRNA sense strand
caacugaggcuuauugggccg

SEQ ID NO: 4684 - RNA, 21 nt, Artificial Sequence
  Ebola virus siRNA sense strand
aacugaggcuuauugggccga

SEQ ID NO: 4685 - RNA, 21 nt, Artificial Sequence
  Ebola virus siRNA sense strand
acugaggcuuauugggccgaa

SEQ ID NO: 4686 - RNA, 21 nt, Artificial Sequence
  Ebola virus siRNA sense strand
cugaggcuuauugggccgaac

SEQ ID NO: 4687 - RNA, 21 nt, Artificial Sequence
  Ebola virus siRNA sense strand
ugaggcuuauugggccgaaca

SEQ ID NO: 4688 - RNA, 21 nt, Artificial Sequence
  Ebola virus siRNA sense strand
gaggcuuauugggccgaacau

SEQ ID NO: 4689 - RNA, 21 nt, Artificial Sequence
  Ebola virus siRNA sense strand
aggcuuauugggccgaacaug

SEQ ID NO: 4690 - RNA, 21 nt, Artificial Sequence
  Ebola virus siRNA sense strand
ggcuuauugggccgaacaugg

SEQ ID NO: 4691 - RNA, 21 nt, Artificial Sequence
  Ebola virus siRNA sense strand
gcuuauugggccgaacauggu

SEQ ID NO: 4692 - RNA, 21 nt, Artificial Sequence
  Ebola virus siRNA sense strand
cuuauugggccgaacaugguc

SEQ ID NO: 4693 - RNA, 21 nt, Artificial Sequence
  Ebola virus siRNA sense strand
uuauugggccgaacaugguca

SEQ ID NO: 4694 - RNA, 21 nt, Artificial Sequence
  Ebola virus siRNA sense strand
uauugggccgaacauggucaa

SEQ ID NO: 4695 - RNA, 21 nt, Artificial Sequence
  Ebola virus siRNA sense strand
auugggccgaacauggucaac

SEQ ID NO: 4696 - RNA, 21 nt, Artificial Sequence
  Ebola virus siRNA sense strand
uugggccgaacauggucaacc

SEQ ID NO: 4697 - RNA, 21 nt, Artificial Sequence
  Ebola virus siRNA sense strand
ugggccgaacauggucaacca

SEQ ID NO: 4698 - RNA, 21 nt, Artificial Sequence
  Ebola virus siRNA sense strand
gggccgaacauggucaaccac

SEQ ID NO: 4699 - RNA, 21 nt, Artificial Sequence
  Ebola virus siRNA sense strand
ggccgaacauggucaaccacc

SEQ ID NO: 4700 - RNA, 21 nt, Artificial Sequence
  Ebola virus siRNA sense strand
gccgaacauggucaaccacca

SEQ ID NO: 4701 - RNA, 21 nt, Artificial Sequence
  Ebola virus siRNA sense strand
ccgaacauggucaaccaccac

SEQ ID NO: 4702 - RNA, 21 nt, Artificial Sequence
  Ebola virus siRNA sense strand
cgaacauggucaaccaccacc

SEQ ID NO: 4703 - RNA, 21 nt, Artificial Sequence
  Ebola virus siRNA sense strand
gaacauggucaaccaccaccu

SEQ ID NO: 4704 - RNA, 21 nt, Artificial Sequence
  Ebola virus siRNA sense strand
aacauggucaaccaccaccug

SEQ ID NO: 4705 - RNA, 21 nt, Artificial Sequence
  Ebola virus siRNA sense strand
acauggucaaccaccaccugg

SEQ ID NO: 4706 - RNA, 21 nt, Artificial Sequence
  Ebola virus siRNA sense strand
cauggucaaccaccaccugga

SEQ ID NO: 4707 - RNA, 21 nt, Artificial Sequence
  Ebola virus siRNA sense strand
auggucaaccaccaccuggac

SEQ ID NO: 4708 - RNA, 21 nt, Artificial Sequence
  Ebola virus siRNA sense strand
uggucaaccaccaccuggacc

SEQ ID NO: 4709 - RNA, 21 nt, Artificial Sequence
  Ebola virus siRNA sense strand
ggucaaccaccaccuggacca

SEQ ID NO: 4710 - RNA, 21 nt, Artificial Sequence
  Ebola virus siRNA sense strand
gucaaccaccaccuggaccau

SEQ ID NO: 4711 - RNA, 21 nt, Artificial Sequence
  Ebola virus siRNA sense strand
ucaaccaccaccuggaccauc

SEQ ID NO: 4712 - RNA, 21 nt, Artificial Sequence
  Ebola virus siRNA sense strand
caaccaccaccuggaccauca

SEQ ID NO: 4713 - RNA, 21 nt, Artificial Sequence
  Ebola virus siRNA sense strand
aaccaccaccuggaccaucac

SEQ ID NO: 4714 - RNA, 21 nt, Artificial Sequence
  Ebola virus siRNA sense strand
accaccaccuggaccaucacu

SEQ ID NO: 4715 - RNA, 21 nt, Artificial Sequence
  Ebola virus siRNA sense strand
ccaccaccuggaccaucacuu

SEQ ID NO: 4716 - RNA, 21 nt, Artificial Sequence
  Ebola virus siRNA sense strand
caccaccuggaccaucacuuu

SEQ ID NO: 4717 - RNA, 21 nt, Artificial Sequence
  Ebola virus siRNA sense strand
accaccuggaccaucacuuua

SEQ ID NO: 4718 - RNA, 21 nt, Artificial Sequence
  Ebola virus siRNA sense strand
ccaccuggaccaucacuuuau

SEQ ID NO: 4719 - RNA, 21 nt, Artificial Sequence
  Ebola virus siRNA sense strand
caccuggaccaucacuuuaug

SEQ ID NO: 4720 - RNA, 21 nt, Artificial Sequence
  Ebola virus siRNA sense strand
accuggaccaucacuuuauga

SEQ ID NO: 4721 - RNA, 21 nt, Artificial Sequence
  Ebola virus siRNA sense strand
ccuggaccaucacuuuaugaa

SEQ ID NO: 4722 - RNA, 21 nt, Artificial Sequence
  Ebola virus siRNA sense strand
cuggaccaucacuuuaugaag

SEQ ID NO: 4723 - RNA, 21 nt, Artificial Sequence
  Ebola virus siRNA sense strand
uggaccaucacuuuaugaaga

SEQ ID NO: 4724 - RNA, 21 nt, Artificial Sequence
  Ebola virus siRNA sense strand
ggaccaucacuuuaugaagaa

SEQ ID NO: 4725 - RNA, 21 nt, Artificial Sequence
  Ebola virus siRNA sense strand
gaccaucacuuuaugaagaaa

SEQ ID NO: 4726 - RNA, 21 nt, Artificial Sequence
  Ebola virus siRNA sense strand
accaucacuuuaugaagaaag

SEQ ID NO: 4727 - RNA, 21 nt, Artificial Sequence
  Ebola virus siRNA sense strand
ccaucacuuuaugaagaaagu

SEQ ID NO: 4728 - RNA, 21 nt, Artificial Sequence
  Ebola virus siRNA sense strand
caucacuuuaugaagaaagug

SEQ ID NO: 4729 - RNA, 21 nt, Artificial Sequence
  Ebola virus siRNA sense strand
aucacuuuaugaagaaagugc

SEQ ID NO: 4730 - RNA, 21 nt, Artificial Sequence
  Ebola virus siRNA sense strand
ucacuuuaugaagaaagugcg

SEQ ID NO: 4731 - RNA, 21 nt, Artificial Sequence
  Ebola virus siRNA sense strand
cacuuuaugaagaaagugcga

SEQ ID NO: 4732 - RNA, 21 nt, Artificial Sequence
  Ebola virus siRNA sense strand
acuuuaugaagaaagugcgau

SEQ ID NO: 4733 - RNA, 21 nt, Artificial Sequence
  Ebola virus siRNA sense strand
cuuuaugaagaaagugcgauu

SEQ ID NO: 4734 - RNA, 21 nt, Artificial Sequence
  Ebola virus siRNA sense strand
uuuaugaagaaagugcgauuc

SEQ ID NO: 4735 - RNA, 21 nt, Artificial Sequence
  Ebola virus siRNA sense strand
uuaugaagaaagugcgauucg

SEQ ID NO: 4736 - RNA, 21 nt, Artificial Sequence
  Ebola virus siRNA sense strand
uaugaagaaagugcgauucgg

SEQ ID NO: 4737 - RNA, 21 nt, Artificial Sequence
  Ebola virus siRNA sense strand
augaagaaagugcgauucggg

SEQ ID NO: 4738 - RNA, 21 nt, Artificial Sequence
  Ebola virus siRNA sense strand
ugaagaaagugcgauucgggg

SEQ ID NO: 4739 - RNA, 21 nt, Artificial Sequence
  Ebola virus siRNA sense strand
gaagaaagugcgauucggggu

SEQ ID NO: 4740 - RNA, 21 nt, Artificial Sequence
  Ebola virus siRNA sense strand
aagaaagugcgauucggggua

SEQ ID NO: 4741 - RNA, 21 nt, Artificial Sequence
  Ebola virus siRNA sense strand
agaaagugcgauucgggguaa

SEQ ID NO: 4742 - RNA, 21 nt, Artificial Sequence
  Ebola virus siRNA sense strand
gaaagugcgauucgggguaag

SEQ ID NO: 4743 - RNA, 21 nt, Artificial Sequence
  Ebola virus siRNA sense strand
aaagugcgauucgggguaaga

SEQ ID NO: 4744 - RNA, 21 nt, Artificial Sequence
  Ebola virus siRNA sense strand
aagugcgauucgggguaagau

SEQ ID NO: 4745 - RNA, 21 nt, Artificial Sequence
  Ebola virus siRNA sense strand
agugcgauucgggguaagauu

SEQ ID NO: 4746 - RNA, 21 nt, Artificial Sequence
  Ebola virus siRNA sense strand
gugcgauucgggguaagauug

SEQ ID NO: 4747 - RNA, 21 nt, Artificial Sequence
  Ebola virus siRNA sense strand
ugcgauucgggguaagauuga

SEQ ID NO: 4748 - RNA, 21 nt, Artificial Sequence
  Ebola virus siRNA sense strand
gcgauucgggguaagauugaa

SEQ ID NO: 4749 - RNA, 21 nt, Artificial Sequence
  Ebola virus siRNA sense strand
cgauucgggguaagauugaau

SEQ ID NO: 4750 - RNA, 21 nt, Artificial Sequence
  Ebola virus siRNA sense strand
gauucgggguaagauugaauc

SEQ ID NO: 4751 - RNA, 21 nt, Artificial Sequence
  Ebola virus siRNA sense strand
auucgggguaagauugaaucu

SEQ ID NO: 4752 - RNA, 21 nt, Artificial Sequence
  Ebola virus siRNA sense strand
uucgggguaagauugaaucua

SEQ ID NO: 4753 - RNA, 21 nt, Artificial Sequence
  Ebola virus siRNA sense strand
ucgggguaagauugaaucuag

SEQ ID NO: 4754 - RNA, 21 nt, Artificial Sequence
  Ebola virus siRNA sense strand
cgggguaagauugaaucuaga

SEQ ID NO: 4755 - RNA, 21 nt, Artificial Sequence
  Ebola virus siRNA sense strand
gggguaagauugaaucuagag

SEQ ID NO: 4756 - RNA, 21 nt, Artificial Sequence
  Ebola virus siRNA sense strand
ggguaagauugaaucuagaga

SEQ ID NO: 4757 - RNA, 21 nt, Artificial Sequence
  Ebola virus siRNA sense strand
gguaagauugaaucuagagau

SEQ ID NO: 4758 - RNA, 21 nt, Artificial Sequence
  Ebola virus siRNA sense strand
guaagauugaaucuagagaug

SEQ ID NO: 4759 - RNA, 21 nt, Artificial Sequence
  Ebola virus siRNA sense strand
uaagauugaaucuagagauga

SEQ ID NO: 4760 - RNA, 21 nt, Artificial Sequence
  Ebola virus siRNA sense strand
aagauugaaucuagagaugag

SEQ ID NO: 4761 - RNA, 21 nt, Artificial Sequence
  Ebola virus siRNA sense strand
agauugaaucuagagaugaga

SEQ ID NO: 4762 - RNA, 21 nt, Artificial Sequence
  Ebola virus siRNA sense strand
gauugaaucuagagaugagac

SEQ ID NO: 4763 - RNA, 21 nt, Artificial Sequence
  Ebola virus siRNA sense strand
auugaaucuagagaugagacc

SEQ ID NO: 4764 - RNA, 21 nt, Artificial Sequence
  Ebola virus siRNA sense strand
uugaaucuagagaugagaccg

SEQ ID NO: 4765 - RNA, 21 nt, Artificial Sequence
  Ebola virus siRNA sense strand
ugaaucuagagaugagaccgu

SEQ ID NO: 4766 - RNA, 21 nt, Artificial Sequence
  Ebola virus siRNA sense strand
gaaucuagagaugagaccguc

SEQ ID NO: 4767 - RNA, 21 nt, Artificial Sequence
  Ebola virus siRNA sense strand
aaucuagagaugagaccgucc

SEQ ID NO: 4768 - RNA, 21 nt, Artificial Sequence
  Ebola virus siRNA sense strand
aucuagagaugagaccguccc

SEQ ID NO: 4769 - RNA, 21 nt, Artificial Sequence
  Ebola virus siRNA sense strand
ucuagagaugagaccgucccu

SEQ ID NO: 4770 - RNA, 21 nt, Artificial Sequence
  Ebola virus siRNA sense strand
cuagagaugagaccgucccuc

SEQ ID NO: 4771 - RNA, 21 nt, Artificial Sequence
  Ebola virus siRNA sense strand
uagagaugagaccgucccuca

SEQ ID NO: 4772 - RNA, 21 nt, Artificial Sequence
  Ebola virus siRNA sense strand
agagaugagaccgucccucaa

SEQ ID NO: 4773 - RNA, 21 nt, Artificial Sequence
  Ebola virus siRNA sense strand
gagaugagaccgucccucaaa

SEQ ID NO: 4774 - RNA, 21 nt, Artificial Sequence
  Ebola virus siRNA sense strand
agaugagaccgucccucaaag

SEQ ID NO: 4775 - RNA, 21 nt, Artificial Sequence
  Ebola virus siRNA sense strand
gaugagaccgucccucaaagu

SEQ ID NO: 4776 - RNA, 21 nt, Artificial Sequence
  Ebola virus siRNA sense strand
augagaccgucccucaaagug

SEQ ID NO: 4777 - RNA, 21 nt, Artificial Sequence
  Ebola virus siRNA sense strand
ugagaccgucccucaaagugu

SEQ ID NO: 4778 - RNA, 21 nt, Artificial Sequence
  Ebola virus siRNA sense strand
gagaccgucccucaaaguguu

SEQ ID NO: 4779 - RNA, 21 nt, Artificial Sequence
  Ebola virus siRNA sense strand
agaccgucccucaaaguguua

SEQ ID NO: 4780 - RNA, 21 nt, Artificial Sequence
  Ebola virus siRNA sense strand
gaccgucccucaaaguguuag

SEQ ID NO: 4781 - RNA, 21 nt, Artificial Sequence
  Ebola virus siRNA sense strand
accgucccucaaaguguuagg

SEQ ID NO: 4782 - RNA, 21 nt, Artificial Sequence
  Ebola virus siRNA sense strand
ccgucccucaaaguguuaggg

SEQ ID NO: 4783 - RNA, 21 nt, Artificial Sequence
  Ebola virus siRNA sense strand
cgucccucaaaguguuaggga

SEQ ID NO: 4784 - RNA, 21 nt, Artificial Sequence
  Ebola virus siRNA sense strand
gucccucaaaguguuagggag

SEQ ID NO: 4785 - RNA, 21 nt, Artificial Sequence
  Ebola virus siRNA sense strand
ucccucaaaguguuagggagg

SEQ ID NO: 4786 - RNA, 21 nt, Artificial Sequence
  Ebola virus siRNA sense strand
cccucaaaguguuagggaggc

SEQ ID NO: 4787 - RNA, 21 nt, Artificial Sequence
  Ebola virus siRNA sense strand
ccucaaaguguuagggaggca

SEQ ID NO: 4788 - RNA, 21 nt, Artificial Sequence
  Ebola virus siRNA sense strand
cucaaaguguuagggaggcau

SEQ ID NO: 4789 - RNA, 21 nt, Artificial Sequence
  Ebola virus siRNA sense strand
ucaaaguguuagggaggcauu

SEQ ID NO: 4790 - RNA, 21 nt, Artificial Sequence
  Ebola virus siRNA sense strand
caaaguguuagggaggcauuc

SEQ ID NO: 4791 - RNA, 21 nt, Artificial Sequence
  Ebola virus siRNA sense strand
aaaguguuagggaggcauuca

SEQ ID NO: 4792 - RNA, 21 nt, Artificial Sequence
  Ebola virus siRNA sense strand
aaguguuagggaggcauucaa

SEQ ID NO: 4793 - RNA, 21 nt, Artificial Sequence
  Ebola virus siRNA sense strand
aguguuagggaggcauucaac

SEQ ID NO: 4794 - RNA, 21 nt, Artificial Sequence
  Ebola virus siRNA sense strand
guguuagggaggcauucaaca

SEQ ID NO: 4795 - RNA, 21 nt, Artificial Sequence
  Ebola virus siRNA sense strand
uguuagggaggcauucaacaa

SEQ ID NO: 4796 - RNA, 21 nt, Artificial Sequence
  Ebola virus siRNA sense strand
guuagggaggcauucaacaau

SEQ ID NO: 4797 - RNA, 21 nt, Artificial Sequence
  Ebola virus siRNA sense strand
uuagggaggcauucaacaauc

SEQ ID NO: 4798 - RNA, 21 nt, Artificial Sequence
  Ebola virus siRNA sense strand
uagggaggcauucaacaaucu

SEQ ID NO: 4799 - RNA, 21 nt, Artificial Sequence
  Ebola virus siRNA sense strand
agggaggcauucaacaaucua

SEQ ID NO: 4800 - RNA, 21 nt, Artificial Sequence
  Ebola virus siRNA sense strand
gggaggcauucaacaaucuaa

SEQ ID NO: 4801 - RNA, 21 nt, Artificial Sequence
  Ebola virus siRNA sense strand
ggaggcauucaacaaucuaaa

SEQ ID NO: 4802 - RNA, 21 nt, Artificial Sequence
  Ebola virus siRNA sense strand
gaggcauucaacaaucuaaac

SEQ ID NO: 4803 - RNA, 21 nt, Artificial Sequence
  Ebola virus siRNA sense strand
aggcauucaacaaucuaaaca

SEQ ID NO: 4804 - RNA, 21 nt, Artificial Sequence
  Ebola virus siRNA sense strand
ggcauucaacaaucuaaacag

SEQ ID NO: 4805 - RNA, 21 nt, Artificial Sequence
  Ebola virus siRNA sense strand
gcauucaacaaucuaaacagu

SEQ ID NO: 4806 - RNA, 21 nt, Artificial Sequence
  Ebola virus siRNA sense strand
cauucaacaaucuaaacagua

SEQ ID NO: 4807 - RNA, 21 nt, Artificial Sequence
  Ebola virus siRNA sense strand
auucaacaaucuaaacaguac

SEQ ID NO: 4808 - RNA, 21 nt, Artificial Sequence
  Ebola virus siRNA sense strand
uucaacaaucuaaacaguacc

SEQ ID NO: 4809 - RNA, 21 nt, Artificial Sequence
  Ebola virus siRNA sense strand
ucaacaaucuaaacaguacca

SEQ ID NO: 4810 - RNA, 21 nt, Artificial Sequence
  Ebola virus siRNA sense strand
caacaaucuaaacaguaccac

SEQ ID NO: 4811 - RNA, 21 nt, Artificial Sequence
  Ebola virus siRNA sense strand
aacaaucuaaacaguaccacu

SEQ ID NO: 4812 - RNA, 21 nt, Artificial Sequence
  Ebola virus siRNA sense strand
acaaucuaaacaguaccacuu

SEQ ID NO: 4813 - RNA, 21 nt, Artificial Sequence
  Ebola virus siRNA sense strand
caaucuaaacaguaccacuuc

SEQ ID NO: 4814 - RNA, 21 nt, Artificial Sequence
  Ebola virus siRNA sense strand
aaucuaaacaguaccacuuca

SEQ ID NO: 4815 - RNA, 21 nt, Artificial Sequence
  Ebola virus siRNA sense strand
aucuaaacaguaccacuucac

SEQ ID NO: 4816 - RNA, 21 nt, Artificial Sequence
  Ebola virus siRNA sense strand
ucuaaacaguaccacuucacu

SEQ ID NO: 4817 - RNA, 21 nt, Artificial Sequence
  Ebola virus siRNA sense strand
cuaaacaguaccacuucacua

SEQ ID NO: 4818 - RNA, 21 nt, Artificial Sequence
  Ebola virus siRNA sense strand
uaaacaguaccacuucacuaa

SEQ ID NO: 4819 - RNA, 21 nt, Artificial Sequence
  Ebola virus siRNA sense strand
aaacaguaccacuucacuaac

SEQ ID NO: 4820 - RNA, 21 nt, Artificial Sequence
  Ebola virus siRNA sense strand
aacaguaccacuucacuaacu

SEQ ID NO: 4821 - RNA, 21 nt, Artificial Sequence
  Ebola virus siRNA sense strand
acaguaccacuucacuaacug

SEQ ID NO: 4822 - RNA, 21 nt, Artificial Sequence
  Ebola virus siRNA sense strand
caguaccacuucacuaacuga

SEQ ID NO: 4823 - RNA, 21 nt, Artificial Sequence
  Ebola virus siRNA sense strand
aguaccacuucacuaacugag

SEQ ID NO: 4824 - RNA, 21 nt, Artificial Sequence
  Ebola virus siRNA sense strand
guaccacuucacuaacugagg

SEQ ID NO: 4825 - RNA, 21 nt, Artificial Sequence
  Ebola virus siRNA sense strand
uaccacuucacuaacugagga

SEQ ID NO: 4826 - RNA, 21 nt, Artificial Sequence
  Ebola virus siRNA sense strand
accacuucacuaacugaggaa

SEQ ID NO: 4827 - RNA, 21 nt, Artificial Sequence
  Ebola virus siRNA sense strand
ccacuucacuaacugaggaaa

SEQ ID NO: 4828 - RNA, 21 nt, Artificial Sequence
  Ebola virus siRNA sense strand
cacuucacuaacugaggaaaa

SEQ ID NO: 4829 - RNA, 21 nt, Artificial Sequence
  Ebola virus siRNA sense strand
acuucacuaacugaggaaaau

SEQ ID NO: 4830 - RNA, 21 nt, Artificial Sequence
  Ebola virus siRNA sense strand
cuucacuaacugaggaaaauu

SEQ ID NO: 4831 - RNA, 21 nt, Artificial Sequence
  Ebola virus siRNA sense strand
uucacuaacugaggaaaauuu

SEQ ID NO: 4832 - RNA, 21 nt, Artificial Sequence
  Ebola virus siRNA sense strand
ucacuaacugaggaaaauuuu

SEQ ID NO: 4833 - RNA, 21 nt, Artificial Sequence
  Ebola virus siRNA sense strand
cacuaacugaggaaaauuuug

SEQ ID NO: 4834 - RNA, 21 nt, Artificial Sequence
  Ebola virus siRNA sense strand
acuaacugaggaaaauuuugg

SEQ ID NO: 4835 - RNA, 21 nt, Artificial Sequence
  Ebola virus siRNA sense strand
cuaacugaggaaaauuuuggg

SEQ ID NO: 4836 - RNA, 21 nt, Artificial Sequence
  Ebola virus siRNA sense strand
uaacugaggaaaauuuuggga

SEQ ID NO: 4837 - RNA, 21 nt, Artificial Sequence
  Ebola virus siRNA sense strand
aacugaggaaaauuuugggaa

SEQ ID NO: 4838 - RNA, 21 nt, Artificial Sequence
  Ebola virus siRNA sense strand
acugaggaaaauuuugggaaa

SEQ ID NO: 4839 - RNA, 21 nt, Artificial Sequence
  Ebola virus siRNA sense strand
cugaggaaaauuuugggaaac

SEQ ID NO: 4840 - RNA, 21 nt, Artificial Sequence
  Ebola virus siRNA sense strand
ugaggaaaauuuugggaaacc

SEQ ID NO: 4841 - RNA, 21 nt, Artificial Sequence
  Ebola virus siRNA sense strand
gaggaaaauuuugggaaaccu

SEQ ID NO: 4842 - RNA, 21 nt, Artificial Sequence
  Ebola virus siRNA sense strand
aggaaaauuuugggaaaccug

SEQ ID NO: 4843 - RNA, 21 nt, Artificial Sequence
  Ebola virus siRNA sense strand
ggaaaauuuugggaaaccuga

SEQ ID NO: 4844 - RNA, 21 nt, Artificial Sequence
  Ebola virus siRNA sense strand
gaaaauuuugggaaaccugac

SEQ ID NO: 4845 - RNA, 21 nt, Artificial Sequence
  Ebola virus siRNA sense strand
aaaauuuugggaaaccugaca

SEQ ID NO: 4846 - RNA, 21 nt, Artificial Sequence
  Ebola virus siRNA sense strand
aaauuuugggaaaccugacau

SEQ ID NO: 4847 - RNA, 21 nt, Artificial Sequence
  Ebola virus siRNA sense strand
aauuuugggaaaccugacauu

SEQ ID NO: 4848 - RNA, 21 nt, Artificial Sequence
  Ebola virus siRNA sense strand
auuuugggaaaccugacauuu

SEQ ID NO: 4849 - RNA, 21 nt, Artificial Sequence
  Ebola virus siRNA sense strand
uuuugggaaaccugacauuuc

SEQ ID NO: 4850 - RNA, 21 nt, Artificial Sequence
  Ebola virus siRNA sense strand
uuugggaaaccugacauuucg

SEQ ID NO: 4851 - RNA, 21 nt, Artificial Sequence
  Ebola virus siRNA sense strand
uugggaaaccugacauuucgg

SEQ ID NO: 4852 - RNA, 21 nt, Artificial Sequence
  Ebola virus siRNA sense strand
ugggaaaccugacauuucggc

SEQ ID NO: 4853 - RNA, 21 nt, Artificial Sequence
  Ebola virus siRNA sense strand
gggaaaccugacauuucggca

SEQ ID NO: 4854 - RNA, 21 nt, Artificial Sequence
  Ebola virus siRNA sense strand
ggaaaccugacauuucggcaa

SEQ ID NO: 4855 - RNA, 21 nt, Artificial Sequence
  Ebola virus siRNA sense strand
gaaaccugacauuucggcaaa

SEQ ID NO: 4856 - RNA, 21 nt, Artificial Sequence
  Ebola virus siRNA sense strand
aaaccugacauuucggcaaag

SEQ ID NO: 4857 - RNA, 21 nt, Artificial Sequence
  Ebola virus siRNA sense strand
aaccugacauuucggcaaagg

SEQ ID NO: 4858 - RNA, 21 nt, Artificial Sequence
  Ebola virus siRNA sense strand
accugacauuucggcaaagga

SEQ ID NO: 4859 - RNA, 21 nt, Artificial Sequence
  Ebola virus siRNA sense strand
ccugacauuucggcaaaggau

SEQ ID NO: 4860 - RNA, 21 nt, Artificial Sequence
  Ebola virus siRNA sense strand
cugacauuucggcaaaggauu

SEQ ID NO: 4861 - RNA, 21 nt, Artificial Sequence
  Ebola virus siRNA sense strand
ugacauuucggcaaaggauuu

SEQ ID NO: 4862 - RNA, 21 nt, Artificial Sequence
  Ebola virus siRNA sense strand
gacauuucggcaaaggauuug

SEQ ID NO: 4863 - RNA, 21 nt, Artificial Sequence
  Ebola virus siRNA sense strand
acauuucggcaaaggauuuga

SEQ ID NO: 4864 - RNA, 21 nt, Artificial Sequence
  Ebola virus siRNA sense strand
cauuucggcaaaggauuugag

SEQ ID NO: 4865 - RNA, 21 nt, Artificial Sequence
  Ebola virus siRNA sense strand
auuucggcaaaggauuugaga

SEQ ID NO: 4866 - RNA, 21 nt, Artificial Sequence
  Ebola virus siRNA sense strand
uuucggcaaaggauuugagaa

SEQ ID NO: 4867 - RNA, 21 nt, Artificial Sequence
  Ebola virus siRNA sense strand
uucggcaaaggauuugagaaa

SEQ ID NO: 4868 - RNA, 21 nt, Artificial Sequence
  Ebola virus siRNA sense strand
ucggcaaaggauuugagaaac

SEQ ID NO: 4869 - RNA, 21 nt, Artificial Sequence
  Ebola virus siRNA sense strand
cggcaaaggauuugagaaaca

SEQ ID NO: 4870 - RNA, 21 nt, Artificial Sequence
  Ebola virus siRNA sense strand
ggcaaaggauuugagaaacau

SEQ ID NO: 4871 - RNA, 21 nt, Artificial Sequence
  Ebola virus siRNA sense strand
gcaaaggauuugagaaacauu

SEQ ID NO: 4872 - RNA, 21 nt, Artificial Sequence
  Ebola virus siRNA sense strand
caaaggauuugagaaacauua

SEQ ID NO: 4873 - RNA, 21 nt, Artificial Sequence
  Ebola virus siRNA sense strand
aaaggauuugagaaacauuau

SEQ ID NO: 4874 - RNA, 21 nt, Artificial Sequence
  Ebola virus siRNA sense strand
aaggauuugagaaacauuaug

SEQ ID NO: 4875 - RNA, 21 nt, Artificial Sequence
  Ebola virus siRNA sense strand
aggauuugagaaacauuaugu

SEQ ID NO: 4876 - RNA, 21 nt, Artificial Sequence
  Ebola virus siRNA sense strand
ggauuugagaaacauuaugua

SEQ ID NO: 4877 - RNA, 21 nt, Artificial Sequence
  Ebola virus siRNA sense strand
gauuugagaaacauuauguau

SEQ ID NO: 4878 - RNA, 21 nt, Artificial Sequence
  Ebola virus siRNA sense strand
auuugagaaacauuauguaug

SEQ ID NO: 4879 - RNA, 21 nt, Artificial Sequence
  Ebola virus siRNA sense strand
uuugagaaacauuauguauga

SEQ ID NO: 4880 - RNA, 21 nt, Artificial Sequence
  Ebola virus siRNA sense strand
uugagaaacauuauguaugau

SEQ ID NO: 4881 - RNA, 21 nt, Artificial Sequence
  Ebola virus siRNA sense strand
ugagaaacauuauguaugauc

SEQ ID NO: 4882 - RNA, 21 nt, Artificial Sequence
  Ebola virus siRNA sense strand
gagaaacauuauguaugauca

SEQ ID NO: 4883 - RNA, 21 nt, Artificial Sequence
  Ebola virus siRNA sense strand
agaaacauuauguaugaucac

SEQ ID NO: 4884 - RNA, 21 nt, Artificial Sequence
  Ebola virus siRNA sense strand
gaaacauuauguaugaucacu

SEQ ID NO: 4885 - RNA, 21 nt, Artificial Sequence
  Ebola virus siRNA sense strand
aaacauuauguaugaucacuu

SEQ ID NO: 4886 - RNA, 21 nt, Artificial Sequence
  Ebola virus siRNA sense strand
aacauuauguaugaucacuug

SEQ ID NO: 4887 - RNA, 21 nt, Artificial Sequence
  Ebola virus siRNA sense strand
acauuauguaugaucacuugc

SEQ ID NO: 4888 - RNA, 21 nt, Artificial Sequence
  Ebola virus siRNA sense strand
cauuauguaugaucacuugcc

SEQ ID NO: 4889 - RNA, 21 nt, Artificial Sequence
  Ebola virus siRNA sense strand
auuauguaugaucacuugccu

SEQ ID NO: 4890 - RNA, 21 nt, Artificial Sequence
  Ebola virus siRNA sense strand
uuauguaugaucacuugccug

SEQ ID NO: 4891 - RNA, 21 nt, Artificial Sequence
  Ebola virus siRNA sense strand
uauguaugaucacuugccugg

SEQ ID NO: 4892 - RNA, 21 nt, Artificial Sequence
  Ebola virus siRNA sense strand
auguaugaucacuugccuggu

SEQ ID NO: 4893 - RNA, 21 nt, Artificial Sequence
  Ebola virus siRNA sense strand
uguaugaucacuugccugguu

SEQ ID NO: 4894 - RNA, 21 nt, Artificial Sequence
  Ebola virus siRNA sense strand
guaugaucacuugccugguuu

SEQ ID NO: 4895 - RNA, 21 nt, Artificial Sequence
  Ebola virus siRNA sense strand
uaugaucacuugccugguuuu

SEQ ID NO: 4896 - RNA, 21 nt, Artificial Sequence
  Ebola virus siRNA sense strand
augaucacuugccugguuuug

SEQ ID NO: 4897 - RNA, 21 nt, Artificial Sequence
  Ebola virus siRNA sense strand
ugaucacuugccugguuuugg

SEQ ID NO: 4898 - RNA, 21 nt, Artificial Sequence
  Ebola virus siRNA sense strand
gaucacuugccugguuuugga

SEQ ID NO: 4899 - RNA, 21 nt, Artificial Sequence
  Ebola virus siRNA sense strand
aucacuugccugguuuuggaa

SEQ ID NO: 4900 - RNA, 21 nt, Artificial Sequence
  Ebola virus siRNA sense strand
ucacuugccugguuuuggaac

SEQ ID NO: 4901 - RNA, 21 nt, Artificial Sequence
  Ebola virus siRNA sense strand
cacuugccugguuuuggaacu

SEQ ID NO: 4902 - RNA, 21 nt, Artificial Sequence
  Ebola virus siRNA sense strand
acuugccugguuuuggaacug

SEQ ID NO: 4903 - RNA, 21 nt, Artificial Sequence
  Ebola virus siRNA sense strand
cuugccugguuuuggaacugc

SEQ ID NO: 4904 - RNA, 21 nt, Artificial Sequence
  Ebola virus siRNA sense strand
uugccugguuuuggaacugcu

SEQ ID NO: 4905 - RNA, 21 nt, Artificial Sequence
  Ebola virus siRNA sense strand
ugccugguuuuggaacugcuu

SEQ ID NO: 4906 - RNA, 21 nt, Artificial Sequence
  Ebola virus siRNA sense strand
gccugguuuuggaacugcuuu

SEQ ID NO: 4907 - RNA, 21 nt, Artificial Sequence
  Ebola virus siRNA sense strand
ccugguuuuggaacugcuuuc

SEQ ID NO: 4908 - RNA, 21 nt, Artificial Sequence
  Ebola virus siRNA sense strand
cugguuuuggaacugcuuucc

SEQ ID NO: 4909 - RNA, 21 nt, Artificial Sequence
  Ebola virus siRNA sense strand
ugguuuuggaacugcuuucca

SEQ ID NO: 4910 - RNA, 21 nt, Artificial Sequence
  Ebola virus siRNA sense strand
gguuuuggaacugcuuuccac

SEQ ID NO: 4911 - RNA, 21 nt, Artificial Sequence
  Ebola virus siRNA sense strand
guuuuggaacugcuuuccacc

SEQ ID NO: 4912 - RNA, 21 nt, Artificial Sequence
  Ebola virus siRNA sense strand
uuuuggaacugcuuuccacca

SEQ ID NO: 4913 - RNA, 21 nt, Artificial Sequence
  Ebola virus siRNA sense strand
uuuggaacugcuuuccaccaa

SEQ ID NO: 4914 - RNA, 21 nt, Artificial Sequence
  Ebola virus siRNA sense strand
uuggaacugcuuuccaccaau

SEQ ID NO: 4915 - RNA, 21 nt, Artificial Sequence
  Ebola virus siRNA sense strand
uggaacugcuuuccaccaauu

SEQ ID NO: 4916 - RNA, 21 nt, Artificial Sequence
  Ebola virus siRNA sense strand
ggaacugcuuuccaccaauua

SEQ ID NO: 4917 - RNA, 21 nt, Artificial Sequence
  Ebola virus siRNA sense strand
gaacugcuuuccaccaauuag

SEQ ID NO: 4918 - RNA, 21 nt, Artificial Sequence
  Ebola virus siRNA sense strand
aacugcuuuccaccaauuagu

SEQ ID NO: 4919 - RNA, 21 nt, Artificial Sequence
  Ebola virus siRNA sense strand
acugcuuuccaccaauuagua

SEQ ID NO: 4920 - RNA, 21 nt, Artificial Sequence
  Ebola virus siRNA sense strand
cugcuuuccaccaauuaguac

SEQ ID NO: 4921 - RNA, 21 nt, Artificial Sequence
  Ebola virus siRNA sense strand
ugcuuuccaccaauuaguaca

SEQ ID NO: 4922 - RNA, 21 nt, Artificial Sequence
  Ebola virus siRNA sense strand
gcuuuccaccaauuaguacaa

SEQ ID NO: 4923 - RNA, 21 nt, Artificial Sequence
  Ebola virus siRNA sense strand
cuuuccaccaauuaguacaag

SEQ ID NO: 4924 - RNA, 21 nt, Artificial Sequence
  Ebola virus siRNA sense strand
uuuccaccaauuaguacaagu

SEQ ID NO: 4925 - RNA, 21 nt, Artificial Sequence
  Ebola virus siRNA sense strand
uuccaccaauuaguacaagug

SEQ ID NO: 4926 - RNA, 21 nt, Artificial Sequence
  Ebola virus siRNA sense strand
uccaccaauuaguacaaguga

SEQ ID NO: 4927 - RNA, 21 nt, Artificial Sequence
  Ebola virus siRNA sense strand
ccaccaauuaguacaagugau

SEQ ID NO: 4928 - RNA, 21 nt, Artificial Sequence
  Ebola virus siRNA sense strand
caccaauuaguacaagugauu

SEQ ID NO: 4929 - RNA, 21 nt, Artificial Sequence
  Ebola virus siRNA sense strand
accaauuaguacaagugauuu

SEQ ID NO: 4930 - RNA, 21 nt, Artificial Sequence
  Ebola virus siRNA sense strand
ccaauuaguacaagugauuug

SEQ ID NO: 4931 - RNA, 21 nt, Artificial Sequence
  Ebola virus siRNA sense strand
caauuaguacaagugauuugu

SEQ ID NO: 4932 - RNA, 21 nt, Artificial Sequence
  Ebola virus siRNA sense strand
aauuaguacaagugauuugua

SEQ ID NO: 4933 - RNA, 21 nt, Artificial Sequence
  Ebola virus siRNA sense strand
auuaguacaagugauuuguaa

SEQ ID NO: 4934 - RNA, 21 nt, Artificial Sequence
  Ebola virus siRNA sense strand
uuaguacaagugauuuguaaa

SEQ ID NO: 4935 - RNA, 21 nt, Artificial Sequence
  Ebola virus siRNA sense strand
uaguacaagugauuuguaaau

SEQ ID NO: 4936 - RNA, 21 nt, Artificial Sequence
  Ebola virus siRNA sense strand
aguacaagugauuuguaaauu

SEQ ID NO: 4937 - RNA, 21 nt, Artificial Sequence
  Ebola virus siRNA sense strand
guacaagugauuuguaaauug

SEQ ID NO: 4938 - RNA, 21 nt, Artificial Sequence
  Ebola virus siRNA sense strand
uacaagugauuuguaaauugg

SEQ ID NO: 4939 - RNA, 21 nt, Artificial Sequence
  Ebola virus siRNA sense strand
acaagugauuuguaaauuggg

SEQ ID NO: 4940 - RNA, 21 nt, Artificial Sequence
  Ebola virus siRNA sense strand
caagugauuuguaaauuggga

SEQ ID NO: 4941 - RNA, 21 nt, Artificial Sequence
  Ebola virus siRNA sense strand
aagugauuuguaaauugggaa

SEQ ID NO: 4942 - RNA, 21 nt, Artificial Sequence
  Ebola virus siRNA sense strand
agugauuuguaaauugggaaa

SEQ ID NO: 4943 - RNA, 21 nt, Artificial Sequence
  Ebola virus siRNA sense strand
gugauuuguaaauugggaaaa

SEQ ID NO: 4944 - RNA, 21 nt, Artificial Sequence
  Ebola virus siRNA sense strand
ugauuuguaaauugggaaaag

SEQ ID NO: 4945 - RNA, 21 nt, Artificial Sequence
  Ebola virus siRNA sense strand
gauuuguaaauugggaaaaga

SEQ ID NO: 4946 - RNA, 21 nt, Artificial Sequence
  Ebola virus siRNA sense strand
auuuguaaauugggaaaagau

SEQ ID NO: 4947 - RNA, 21 nt, Artificial Sequence
  Ebola virus siRNA sense strand
uuuguaaauugggaaaagaua

SEQ ID NO: 4948 - RNA, 21 nt, Artificial Sequence
  Ebola virus siRNA sense strand
uuguaaauugggaaaagauag

SEQ ID NO: 4949 - RNA, 21 nt, Artificial Sequence
  Ebola virus siRNA sense strand
uguaaauugggaaaagauagc

SEQ ID NO: 4950 - RNA, 21 nt, Artificial Sequence
  Ebola virus siRNA sense strand
guaaauugggaaaagauagca

SEQ ID NO: 4951 - RNA, 21 nt, Artificial Sequence
  Ebola virus siRNA sense strand
uaaauugggaaaagauagcaa

SEQ ID NO: 4952 - RNA, 21 nt, Artificial Sequence
  Ebola virus siRNA sense strand
aaauugggaaaagauagcaac

SEQ ID NO: 4953 - RNA, 21 nt, Artificial Sequence
  Ebola virus siRNA sense strand
aauugggaaaagauagcaacu

SEQ ID NO: 4954 - RNA, 21 nt, Artificial Sequence
  Ebola virus siRNA sense strand
auugggaaaagauagcaacuc

SEQ ID NO: 4955 - RNA, 21 nt, Artificial Sequence
  Ebola virus siRNA sense strand
uugggaaaagauagcaacuca

SEQ ID NO: 4956 - RNA, 21 nt, Artificial Sequence
  Ebola virus siRNA sense strand
ugggaaaagauagcaacucau

SEQ ID NO: 4957 - RNA, 21 nt, Artificial Sequence
  Ebola virus siRNA sense strand
gggaaaagauagcaacucauu

SEQ ID NO: 4958 - RNA, 21 nt, Artificial Sequence
  Ebola virus siRNA sense strand
ggaaaagauagcaacucauug

SEQ ID NO: 4959 - RNA, 21 nt, Artificial Sequence
  Ebola virus siRNA sense strand
gaaaagauagcaacucauugg

SEQ ID NO: 4960 - RNA, 21 nt, Artificial Sequence
  Ebola virus siRNA sense strand
aaaagauagcaacucauugga

SEQ ID NO: 4961 - RNA, 21 nt, Artificial Sequence
  Ebola virus siRNA sense strand
aaagauagcaacucauuggac

SEQ ID NO: 4962 - RNA, 21 nt, Artificial Sequence
  Ebola virus siRNA sense strand
aagauagcaacucauuggaca

SEQ ID NO: 4963 - RNA, 21 nt, Artificial Sequence
  Ebola virus siRNA sense strand
agauagcaacucauuggacau

SEQ ID NO: 4964 - RNA, 21 nt, Artificial Sequence
  Ebola virus siRNA sense strand
gauagcaacucauuggacauc

SEQ ID NO: 4965 - RNA, 21 nt, Artificial Sequence
  Ebola virus siRNA sense strand
auagcaacucauuggacauca

SEQ ID NO: 4966 - RNA, 21 nt, Artificial Sequence
  Ebola virus siRNA sense strand
uagcaacucauuggacaucau

SEQ ID NO: 4967 - RNA, 21 nt, Artificial Sequence
  Ebola virus siRNA sense strand
agcaacucauuggacaucauu

SEQ ID NO: 4968 - RNA, 21 nt, Artificial Sequence
  Ebola virus siRNA sense strand
gcaacucauuggacaucauuc

SEQ ID NO: 4969 - RNA, 21 nt, Artificial Sequence
  Ebola virus siRNA sense strand
caacucauuggacaucauuca

SEQ ID NO: 4970 - RNA, 21 nt, Artificial Sequence
  Ebola virus siRNA sense strand
aacucauuggacaucauucau

SEQ ID NO: 4971 - RNA, 21 nt, Artificial Sequence
  Ebola virus siRNA sense strand
acucauuggacaucauucaug

SEQ ID NO: 4972 - RNA, 21 nt, Artificial Sequence
  Ebola virus siRNA sense strand
cucauuggacaucauucaugc

SEQ ID NO: 4973 - RNA, 21 nt, Artificial Sequence
  Ebola virus siRNA sense strand
ucauuggacaucauucaugcu

SEQ ID NO: 4974 - RNA, 21 nt, Artificial Sequence
  Ebola virus siRNA sense strand
cauuggacaucauucaugcug

SEQ ID NO: 4975 - RNA, 21 nt, Artificial Sequence
  Ebola virus siRNA sense strand
auuggacaucauucaugcuga

SEQ ID NO: 4976 - RNA, 21 nt, Artificial Sequence
  Ebola virus siRNA sense strand
uuggacaucauucaugcugag

SEQ ID NO: 4977 - RNA, 21 nt, Artificial Sequence
  Ebola virus siRNA sense strand
uggacaucauucaugcugagu

SEQ ID NO: 4978 - RNA, 21 nt, Artificial Sequence
  Ebola virus siRNA sense strand
ggacaucauucaugcugaguu

SEQ ID NO: 4979 - RNA, 21 nt, Artificial Sequence
  Ebola virus siRNA sense strand
gacaucauucaugcugaguuc

SEQ ID NO: 4980 - RNA, 21 nt, Artificial Sequence
  Ebola virus siRNA sense strand
acaucauucaugcugaguucc

SEQ ID NO: 4981 - RNA, 21 nt, Artificial Sequence
  Ebola virus siRNA sense strand
caucauucaugcugaguucca

SEQ ID NO: 4982 - RNA, 21 nt, Artificial Sequence
  Ebola virus siRNA sense strand
aucauucaugcugaguuccag

SEQ ID NO: 4983 - RNA, 21 nt, Artificial Sequence
  Ebola virus siRNA sense strand
ucauucaugcugaguuccagg

SEQ ID NO: 4984 - RNA, 21 nt, Artificial Sequence
  Ebola virus siRNA sense strand
cauucaugcugaguuccaggc

SEQ ID NO: 4985 - RNA, 21 nt, Artificial Sequence
  Ebola virus siRNA sense strand
auucaugcugaguuccaggcc

SEQ ID NO: 4986 - RNA, 21 nt, Artificial Sequence
  Ebola virus siRNA sense strand
uucaugcugaguuccaggcca

SEQ ID NO: 4987 - RNA, 21 nt, Artificial Sequence
  Ebola virus siRNA sense strand
ucaugcugaguuccaggccag

SEQ ID NO: 4988 - RNA, 21 nt, Artificial Sequence
  Ebola virus siRNA sense strand
caugcugaguuccaggccagc

SEQ ID NO: 4989 - RNA, 21 nt, Artificial Sequence
  Ebola virus siRNA sense strand
augcugaguuccaggccagcc

SEQ ID NO: 4990 - RNA, 21 nt, Artificial Sequence
  Ebola virus siRNA sense strand
ugcugaguuccaggccagccu

SEQ ID NO: 4991 - RNA, 21 nt, Artificial Sequence
  Ebola virus siRNA sense strand
gcugaguuccaggccagccug

SEQ ID NO: 4992 - RNA, 21 nt, Artificial Sequence
  Ebola virus siRNA sense strand
cugaguuccaggccagccugg

SEQ ID NO: 4993 - RNA, 21 nt, Artificial Sequence
  Ebola virus siRNA sense strand
ugaguuccaggccagccuggc

SEQ ID NO: 4994 - RNA, 21 nt, Artificial Sequence
  Ebola virus siRNA sense strand
gaguuccaggccagccuggcu

SEQ ID NO: 4995 - RNA, 21 nt, Artificial Sequence
  Ebola virus siRNA sense strand
aguuccaggccagccuggcug

SEQ ID NO: 4996 - RNA, 21 nt, Artificial Sequence
  Ebola virus siRNA sense strand
guuccaggccagccuggcuga

SEQ ID NO: 4997 - RNA, 21 nt, Artificial Sequence
  Ebola virus siRNA sense strand
uuccaggccagccuggcugaa

SEQ ID NO: 4998 - RNA, 21 nt, Artificial Sequence
  Ebola virus siRNA sense strand
uccaggccagccuggcugaag

SEQ ID NO: 4999 - RNA, 21 nt, Artificial Sequence
  Ebola virus siRNA sense strand
ccaggccagccuggcugaagg

SEQ ID NO: 5000 - RNA, 21 nt, Artificial Sequence
  Ebola virus siRNA sense strand
caggccagccuggcugaagga

SEQ ID NO: 5001 - RNA, 21 nt, Artificial Sequence
  Ebola virus siRNA sense strand
aggccagccuggcugaaggag

SEQ ID NO: 5002 - RNA, 21 nt, Artificial Sequence
  Ebola virus siRNA sense strand
ggccagccuggcugaaggaga

SEQ ID NO: 5003 - RNA, 21 nt, Artificial Sequence
  Ebola virus siRNA sense strand
gccagccuggcugaaggagac

SEQ ID NO: 5004 - RNA, 21 nt, Artificial Sequence
  Ebola virus siRNA sense strand
ccagccuggcugaaggagacu

SEQ ID NO: 5005 - RNA, 21 nt, Artificial Sequence
  Ebola virus siRNA sense strand
cagccuggcugaaggagacuc

SEQ ID NO: 5006 - RNA, 21 nt, Artificial Sequence
  Ebola virus siRNA sense strand
agccuggcugaaggagacucu

SEQ ID NO: 5007 - RNA, 21 nt, Artificial Sequence
  Ebola virus siRNA sense strand
gccuggcugaaggagacucuc

SEQ ID NO: 5008 - RNA, 21 nt, Artificial Sequence
  Ebola virus siRNA sense strand
ccuggcugaaggagacucucc

SEQ ID NO: 5009 - RNA, 21 nt, Artificial Sequence
  Ebola virus siRNA sense strand
cuggcugaaggagacucuccu

SEQ ID NO: 5010 - RNA, 21 nt, Artificial Sequence
  Ebola virus siRNA sense strand
uggcugaaggagacucuccuc

SEQ ID NO: 5011 - RNA, 21 nt, Artificial Sequence
  Ebola virus siRNA sense strand
ggcugaaggagacucuccuca

SEQ ID NO: 5012 - RNA, 21 nt, Artificial Sequence
  Ebola virus siRNA sense strand
gcugaaggagacucuccucaa

SEQ ID NO: 5013 - RNA, 21 nt, Artificial Sequence
  Ebola virus siRNA sense strand
cugaaggagacucuccucaau

SEQ ID NO: 5014 - RNA, 21 nt, Artificial Sequence
  Ebola virus siRNA sense strand
ugaaggagacucuccucaaug

SEQ ID NO: 5015 - RNA, 21 nt, Artificial Sequence
  Ebola virus siRNA sense strand
gaaggagacucuccucaaugu

SEQ ID NO: 5016 - RNA, 21 nt, Artificial Sequence
  Ebola virus siRNA sense strand
aaggagacucuccucaaugug

SEQ ID NO: 5017 - RNA, 21 nt, Artificial Sequence
  Ebola virus siRNA sense strand
aggagacucuccucaaugugc

SEQ ID NO: 5018 - RNA, 21 nt, Artificial Sequence
  Ebola virus siRNA sense strand
ggagacucuccucaaugugcc

SEQ ID NO: 5019 - RNA, 21 nt, Artificial Sequence
  Ebola virus siRNA sense strand
gagacucuccucaaugugccc

SEQ ID NO: 5020 - RNA, 21 nt, Artificial Sequence
  Ebola virus siRNA sense strand
agacucuccucaaugugcccu

SEQ ID NO: 5021 - RNA, 21 nt, Artificial Sequence
  Ebola virus siRNA sense strand
gacucuccucaaugugcccua

SEQ ID NO: 5022 - RNA, 21 nt, Artificial Sequence
  Ebola virus siRNA sense strand
acucuccucaaugugcccuaa

SEQ ID NO: 5023 - RNA, 21 nt, Artificial Sequence
  Ebola virus siRNA sense strand
cucuccucaaugugcccuaau

SEQ ID NO: 5024 - RNA, 21 nt, Artificial Sequence
  Ebola virus siRNA sense strand
ucuccucaaugugcccuaauu

SEQ ID NO: 5025 - RNA, 21 nt, Artificial Sequence
  Ebola virus siRNA sense strand
cuccucaaugugcccuaauuc

SEQ ID NO: 5026 - RNA, 21 nt, Artificial Sequence
  Ebola virus siRNA sense strand
uccucaaugugcccuaauuca

SEQ ID NO: 5027 - RNA, 21 nt, Artificial Sequence
  Ebola virus siRNA sense strand
ccucaaugugcccuaauucaa

SEQ ID NO: 5028 - RNA, 21 nt, Artificial Sequence
  Ebola virus siRNA sense strand
cucaaugugcccuaauucaaa

SEQ ID NO: 5029 - RNA, 21 nt, Artificial Sequence
  Ebola virus siRNA sense strand
ucaaugugcccuaauucaaau

SEQ ID NO: 5030 - RNA, 21 nt, Artificial Sequence
  Ebola virus siRNA sense strand
caaugugcccuaauucaaauu

SEQ ID NO: 5031 - RNA, 21 nt, Artificial Sequence
  Ebola virus siRNA sense strand
aaugugcccuaauucaaauua

SEQ ID NO: 5032 - RNA, 21 nt, Artificial Sequence
  Ebola virus siRNA sense strand
augugcccuaauucaaauuac

SEQ ID NO: 5033 - RNA, 21 nt, Artificial Sequence
  Ebola virus siRNA sense strand
ugugcccuaauucaaauuaca

SEQ ID NO: 5034 - RNA, 21 nt, Artificial Sequence
  Ebola virus siRNA sense strand
gugcccuaauucaaauuacaa

SEQ ID NO: 5035 - RNA, 21 nt, Artificial Sequence
  Ebola virus siRNA sense strand
ugcccuaauucaaauuacaaa

SEQ ID NO: 5036 - RNA, 21 nt, Artificial Sequence
  Ebola virus siRNA sense strand
gcccuaauucaaauuacaaaa

SEQ ID NO: 5037 - RNA, 21 nt, Artificial Sequence
  Ebola virus siRNA sense strand
cccuaauucaaauuacaaaaa

SEQ ID NO: 5038 - RNA, 21 nt, Artificial Sequence
  Ebola virus siRNA sense strand
ccuaauucaaauuacaaaaag

SEQ ID NO: 5039 - RNA, 21 nt, Artificial Sequence
  Ebola virus siRNA sense strand
cuaauucaaauuacaaaaaga

SEQ ID NO: 5040 - RNA, 21 nt, Artificial Sequence
  Ebola virus siRNA sense strand
uaauucaaauuacaaaaagag

SEQ ID NO: 5041 - RNA, 21 nt, Artificial Sequence
  Ebola virus siRNA sense strand
aauucaaauuacaaaaagagu

SEQ ID NO: 5042 - RNA, 21 nt, Artificial Sequence
  Ebola virus siRNA sense strand
auucaaauuacaaaaagaguu

SEQ ID NO: 5043 - RNA, 21 nt, Artificial Sequence
  Ebola virus siRNA sense strand
uucaaauuacaaaaagaguuc

SEQ ID NO: 5044 - RNA, 21 nt, Artificial Sequence
  Ebola virus siRNA sense strand
ucaaauuacaaaaagaguucc

SEQ ID NO: 5045 - RNA, 21 nt, Artificial Sequence
  Ebola virus siRNA sense strand
caaauuacaaaaagaguucca

SEQ ID NO: 5046 - RNA, 21 nt, Artificial Sequence
  Ebola virus siRNA sense strand
aaauuacaaaaagaguuccaa

SEQ ID NO: 5047 - RNA, 21 nt, Artificial Sequence
  Ebola virus siRNA sense strand
aauuacaaaaagaguuccaau

SEQ ID NO: 5048 - RNA, 21 nt, Artificial Sequence
  Ebola virus siRNA sense strand
auuacaaaaagaguuccaauc

SEQ ID NO: 5049 - RNA, 21 nt, Artificial Sequence
  Ebola virus siRNA sense strand
uuacaaaaagaguuccaaucu

SEQ ID NO: 5050 - RNA, 21 nt, Artificial Sequence
  Ebola virus siRNA sense strand
uacaaaaagaguuccaaucuu

SEQ ID NO: 5051 - RNA, 21 nt, Artificial Sequence
  Ebola virus siRNA sense strand
acaaaaagaguuccaaucuuc

SEQ ID NO: 5052 - RNA, 21 nt, Artificial Sequence
  Ebola virus siRNA sense strand
caaaaagaguuccaaucuucc

SEQ ID NO: 5053 - RNA, 21 nt, Artificial Sequence
  Ebola virus siRNA sense strand
aaaaagaguuccaaucuucca

SEQ ID NO: 5054 - RNA, 21 nt, Artificial Sequence
  Ebola virus siRNA sense strand
aaaagaguuccaaucuuccaa

SEQ ID NO: 5055 - RNA, 21 nt, Artificial Sequence
  Ebola virus siRNA sense strand
aaagaguuccaaucuuccaag

SEQ ID NO: 5056 - RNA, 21 nt, Artificial Sequence
  Ebola virus siRNA sense strand
aagaguuccaaucuuccaaga

SEQ ID NO: 5057 - RNA, 21 nt, Artificial Sequence
  Ebola virus siRNA sense strand
agaguuccaaucuuccaagau

SEQ ID NO: 5058 - RNA, 21 nt, Artificial Sequence
  Ebola virus siRNA sense strand
gaguuccaaucuuccaagaug

SEQ ID NO: 5059 - RNA, 21 nt, Artificial Sequence
  Ebola virus siRNA sense strand
aguuccaaucuuccaagaugc

SEQ ID NO: 5060 - RNA, 21 nt, Artificial Sequence
  Ebola virus siRNA sense strand
guuccaaucuuccaagaugcu

SEQ ID NO: 5061 - RNA, 21 nt, Artificial Sequence
  Ebola virus siRNA sense strand
uuccaaucuuccaagaugcug

SEQ ID NO: 5062 - RNA, 21 nt, Artificial Sequence
  Ebola virus siRNA sense strand
uccaaucuuccaagaugcugc

SEQ ID NO: 5063 - RNA, 21 nt, Artificial Sequence
  Ebola virus siRNA sense strand
ccaaucuuccaagaugcugcu

SEQ ID NO: 5064 - RNA, 21 nt, Artificial Sequence
  Ebola virus siRNA sense strand
caaucuuccaagaugcugcuc

SEQ ID NO: 5065 - RNA, 21 nt, Artificial Sequence
  Ebola virus siRNA sense strand
aaucuuccaagaugcugcucc

SEQ ID NO: 5066 - RNA, 21 nt, Artificial Sequence
  Ebola virus siRNA sense strand
aucuuccaagaugcugcucca

SEQ ID NO: 5067 - RNA, 21 nt, Artificial Sequence
  Ebola virus siRNA sense strand
ucuuccaagaugcugcuccac

SEQ ID NO: 5068 - RNA, 21 nt, Artificial Sequence
  Ebola virus siRNA sense strand
cuuccaagaugcugcuccacc

SEQ ID NO: 5069 - RNA, 21 nt, Artificial Sequence
  Ebola virus siRNA sense strand
uuccaagaugcugcuccaccu

SEQ ID NO: 5070 - RNA, 21 nt, Artificial Sequence
  Ebola virus siRNA sense strand
uccaagaugcugcuccaccug

SEQ ID NO: 5071 - RNA, 21 nt, Artificial Sequence
  Ebola virus siRNA sense strand
ccaagaugcugcuccaccugu

SEQ ID NO: 5072 - RNA, 21 nt, Artificial Sequence
  Ebola virus siRNA sense strand
caagaugcugcuccaccuguc

SEQ ID NO: 5073 - RNA, 21 nt, Artificial Sequence
  Ebola virus siRNA sense strand
aagaugcugcuccaccuguca

SEQ ID NO: 5074 - RNA, 21 nt, Artificial Sequence
  Ebola virus siRNA sense strand
agaugcugcuccaccugucau

SEQ ID NO: 5075 - RNA, 21 nt, Artificial Sequence
  Ebola virus siRNA sense strand
gaugcugcuccaccugucauc

SEQ ID NO: 5076 - RNA, 21 nt, Artificial Sequence
  Ebola virus siRNA sense strand
augcugcuccaccugucaucc

SEQ ID NO: 5077 - RNA, 21 nt, Artificial Sequence
  Ebola virus siRNA sense strand
ugcugcuccaccugucaucca

SEQ ID NO: 5078 - RNA, 21 nt, Artificial Sequence
  Ebola virus siRNA sense strand
gcugcuccaccugucauccac

SEQ ID NO: 5079 - RNA, 21 nt, Artificial Sequence
  Ebola virus siRNA sense strand
cugcuccaccugucauccaca

SEQ ID NO: 5080 - RNA, 21 nt, Artificial Sequence
  Ebola virus siRNA sense strand
ugcuccaccugucauccacau

SEQ ID NO: 5081 - RNA, 21 nt, Artificial Sequence
  Ebola virus siRNA sense strand
gcuccaccugucauccacauc

SEQ ID NO: 5082 - RNA, 21 nt, Artificial Sequence
  Ebola virus siRNA sense strand
cuccaccugucauccacaucc

SEQ ID NO: 5083 - RNA, 21 nt, Artificial Sequence
  Ebola virus siRNA sense strand
uccaccugucauccacauccg

SEQ ID NO: 5084 - RNA, 21 nt, Artificial Sequence
  Ebola virus siRNA sense strand
ccaccugucauccacauccgc

SEQ ID NO: 5085 - RNA, 21 nt, Artificial Sequence
  Ebola virus siRNA sense strand
caccugucauccacauccgcu

SEQ ID NO: 5086 - RNA, 21 nt, Artificial Sequence
  Ebola virus siRNA sense strand
accugucauccacauccgcuc

SEQ ID NO: 5087 - RNA, 21 nt, Artificial Sequence
  Ebola virus siRNA sense strand
ccugucauccacauccgcucu

SEQ ID NO: 5088 - RNA, 21 nt, Artificial Sequence
  Ebola virus siRNA sense strand
cugucauccacauccgcucuc

SEQ ID NO: 5089 - RNA, 21 nt, Artificial Sequence
  Ebola virus siRNA sense strand
ugucauccacauccgcucucg

SEQ ID NO: 5090 - RNA, 21 nt, Artificial Sequence
  Ebola virus siRNA sense strand
gucauccacauccgcucucga

SEQ ID NO: 5091 - RNA, 21 nt, Artificial Sequence
  Ebola virus siRNA sense strand
ucauccacauccgcucucgag

SEQ ID NO: 5092 - RNA, 21 nt, Artificial Sequence
  Ebola virus siRNA sense strand
cauccacauccgcucucgagg

SEQ ID NO: 5093 - RNA, 21 nt, Artificial Sequence
  Ebola virus siRNA sense strand
auccacauccgcucucgaggu

SEQ ID NO: 5094 - RNA, 21 nt, Artificial Sequence
  Ebola virus siRNA sense strand
uccacauccgcucucgaggug

SEQ ID NO: 5095 - RNA, 21 nt, Artificial Sequence
  Ebola virus siRNA sense strand
ccacauccgcucucgagguga

SEQ ID NO: 5096 - RNA, 21 nt, Artificial Sequence
  Ebola virus siRNA sense strand
cacauccgcucucgaggugac

SEQ ID NO: 5097 - RNA, 21 nt, Artificial Sequence
  Ebola virus siRNA sense strand
acauccgcucucgaggugaca

SEQ ID NO: 5098 - RNA, 21 nt, Artificial Sequence
  Ebola virus siRNA sense strand
cauccgcucucgaggugacau

SEQ ID NO: 5099 - RNA, 21 nt, Artificial Sequence
  Ebola virus siRNA sense strand
auccgcucucgaggugacauu

SEQ ID NO: 5100 - RNA, 21 nt, Artificial Sequence
  Ebola virus siRNA sense strand
uccgcucucgaggugacauuc

SEQ ID NO: 5101 - RNA, 21 nt, Artificial Sequence
  Ebola virus siRNA sense strand
ccgcucucgaggugacauucc

SEQ ID NO: 5102 - RNA, 21 nt, Artificial Sequence
  Ebola virus siRNA sense strand
cgcucucgaggugacauuccc

SEQ ID NO: 5103 - RNA, 21 nt, Artificial Sequence
  Ebola virus siRNA sense strand
gcucucgaggugacauucccc

SEQ ID NO: 5104 - RNA, 21 nt, Artificial Sequence
  Ebola virus siRNA sense strand
cucucgaggugacauuccccg

SEQ ID NO: 5105 - RNA, 21 nt, Artificial Sequence
  Ebola virus siRNA sense strand
ucucgaggugacauuccccga

SEQ ID NO: 5106 - RNA, 21 nt, Artificial Sequence
  Ebola virus siRNA sense strand
cucgaggugacauuccccgag

SEQ ID NO: 5107 - RNA, 21 nt, Artificial Sequence
  Ebola virus siRNA sense strand
ucgaggugacauuccccgagc

SEQ ID NO: 5108 - RNA, 21 nt, Artificial Sequence
  Ebola virus siRNA sense strand
cgaggugacauuccccgagcu

SEQ ID NO: 5109 - RNA, 21 nt, Artificial Sequence
  Ebola virus siRNA sense strand
gaggugacauuccccgagcuu

SEQ ID NO: 5110 - RNA, 21 nt, Artificial Sequence
  Ebola virus siRNA sense strand
aggugacauuccccgagcuug

SEQ ID NO: 5111 - RNA, 21 nt, Artificial Sequence
  Ebola virus siRNA sense strand
ggugacauuccccgagcuugc

SEQ ID NO: 5112 - RNA, 21 nt, Artificial Sequence
  Ebola virus siRNA sense strand
gugacauuccccgagcuugcc

SEQ ID NO: 5113 - RNA, 21 nt, Artificial Sequence
  Ebola virus siRNA sense strand
ugacauuccccgagcuugcca

SEQ ID NO: 5114 - RNA, 21 nt, Artificial Sequence
  Ebola virus siRNA sense strand
gacauuccccgagcuugccag

SEQ ID NO: 5115 - RNA, 21 nt, Artificial Sequence
  Ebola virus siRNA sense strand
acauuccccgagcuugccaga

SEQ ID NO: 5116 - RNA, 21 nt, Artificial Sequence
  Ebola virus siRNA sense strand
cauuccccgagcuugccagaa

SEQ ID NO: 5117 - RNA, 21 nt, Artificial Sequence
  Ebola virus siRNA sense strand
auuccccgagcuugccagaaa

SEQ ID NO: 5118 - RNA, 21 nt, Artificial Sequence
  Ebola virus siRNA sense strand
uuccccgagcuugccagaaaa

SEQ ID NO: 5119 - RNA, 21 nt, Artificial Sequence
  Ebola virus siRNA sense strand
uccccgagcuugccagaaaag

SEQ ID NO: 5120 - RNA, 21 nt, Artificial Sequence
  Ebola virus siRNA sense strand
ccccgagcuugccagaaaagc

SEQ ID NO: 5121 - RNA, 21 nt, Artificial Sequence
  Ebola virus siRNA sense strand
cccgagcuugccagaaaagcu

SEQ ID NO: 5122 - RNA, 21 nt, Artificial Sequence
  Ebola virus siRNA sense strand
ccgagcuugccagaaaagcuu

SEQ ID NO: 5123 - RNA, 21 nt, Artificial Sequence
  Ebola virus siRNA sense strand
cgagcuugccagaaaagcuug

SEQ ID NO: 5124 - RNA, 21 nt, Artificial Sequence
  Ebola virus siRNA sense strand
gagcuugccagaaaagcuugc

SEQ ID NO: 5125 - RNA, 21 nt, Artificial Sequence
  Ebola virus siRNA sense strand
agcuugccagaaaagcuugcg

SEQ ID NO: 5126 - RNA, 21 nt, Artificial Sequence
  Ebola virus siRNA sense strand
gcuugccagaaaagcuugcgu

SEQ ID NO: 5127 - RNA, 21 nt, Artificial Sequence
  Ebola virus siRNA sense strand
cuugccagaaaagcuugcguc

SEQ ID NO: 5128 - RNA, 21 nt, Artificial Sequence
  Ebola virus siRNA sense strand
uugccagaaaagcuugcgucc

SEQ ID NO: 5129 - RNA, 21 nt, Artificial Sequence
  Ebola virus siRNA sense strand
ugccagaaaagcuugcgucca

SEQ ID NO: 5130 - RNA, 21 nt, Artificial Sequence
  Ebola virus siRNA sense strand
gccagaaaagcuugcguccag

SEQ ID NO: 5131 - RNA, 21 nt, Artificial Sequence
  Ebola virus siRNA sense strand
ccagaaaagcuugcguccagu

SEQ ID NO: 5132 - RNA, 21 nt, Artificial Sequence
  Ebola virus siRNA sense strand
cagaaaagcuugcguccaguc

SEQ ID NO: 5133 - RNA, 21 nt, Artificial Sequence
  Ebola virus siRNA sense strand
agaaaagcuugcguccagucc

SEQ ID NO: 5134 - RNA, 21 nt, Artificial Sequence
  Ebola virus siRNA sense strand
gaaaagcuugcguccaguccc

SEQ ID NO: 5135 - RNA, 21 nt, Artificial Sequence
  Ebola virus siRNA sense strand
aaaagcuugcguccaguccca

SEQ ID NO: 5136 - RNA, 21 nt, Artificial Sequence
  Ebola virus siRNA sense strand
aaagcuugcguccagucccac

SEQ ID NO: 5137 - RNA, 21 nt, Artificial Sequence
  Ebola virus siRNA sense strand
aagcuugcguccagucccacc

SEQ ID NO: 5138 - RNA, 21 nt, Artificial Sequence
  Ebola virus siRNA sense strand
agcuugcguccagucccacca

SEQ ID NO: 5139 - RNA, 21 nt, Artificial Sequence
  Ebola virus siRNA sense strand
gcuugcguccagucccaccau

SEQ ID NO: 5140 - RNA, 21 nt, Artificial Sequence
  Ebola virus siRNA sense strand
cuugcguccagucccaccauc

SEQ ID NO: 5141 - RNA, 21 nt, Artificial Sequence
  Ebola virus siRNA sense strand
uugcguccagucccaccaucg

SEQ ID NO: 5142 - RNA, 21 nt, Artificial Sequence
  Ebola virus siRNA sense strand
ugcguccagucccaccaucgc

SEQ ID NO: 5143 - RNA, 21 nt, Artificial Sequence
  Ebola virus siRNA sense strand
gcguccagucccaccaucgcc

SEQ ID NO: 5144 - RNA, 21 nt, Artificial Sequence
  Ebola virus siRNA sense strand
cguccagucccaccaucgccc

SEQ ID NO: 5145 - RNA, 21 nt, Artificial Sequence
  Ebola virus siRNA sense strand
guccagucccaccaucgccca

SEQ ID NO: 5146 - RNA, 21 nt, Artificial Sequence
  Ebola virus siRNA sense strand
uccagucccaccaucgcccaa

SEQ ID NO: 5147 - RNA, 21 nt, Artificial Sequence
  Ebola virus siRNA sense strand
ccagucccaccaucgcccaag

SEQ ID NO: 5148 - RNA, 21 nt, Artificial Sequence
  Ebola virus siRNA sense strand
cagucccaccaucgcccaaga

SEQ ID NO: 5149 - RNA, 21 nt, Artificial Sequence
  Ebola virus siRNA sense strand
agucccaccaucgcccaagau

SEQ ID NO: 5150 - RNA, 21 nt, Artificial Sequence
  Ebola virus siRNA sense strand
gucccaccaucgcccaagauu

SEQ ID NO: 5151 - RNA, 21 nt, Artificial Sequence
  Ebola virus siRNA sense strand
ucccaccaucgcccaagauug

SEQ ID NO: 5152 - RNA, 21 nt, Artificial Sequence
  Ebola virus siRNA sense strand
cccaccaucgcccaagauuga

SEQ ID NO: 5153 - RNA, 21 nt, Artificial Sequence
  Ebola virus siRNA sense strand
ccaccaucgcccaagauugau

SEQ ID NO: 5154 - RNA, 21 nt, Artificial Sequence
  Ebola virus siRNA sense strand
caccaucgcccaagauugauc

SEQ ID NO: 5155 - RNA, 21 nt, Artificial Sequence
  Ebola virus siRNA sense strand
accaucgcccaagauugaucg

SEQ ID NO: 5156 - RNA, 21 nt, Artificial Sequence
  Ebola virus siRNA sense strand
ccaucgcccaagauugaucga

SEQ ID NO: 5157 - RNA, 21 nt, Artificial Sequence
  Ebola virus siRNA sense strand
caucgcccaagauugaucgag

SEQ ID NO: 5158 - RNA, 21 nt, Artificial Sequence
  Ebola virus siRNA sense strand
aucgcccaagauugaucgagg

SEQ ID NO: 5159 - RNA, 21 nt, Artificial Sequence
  Ebola virus siRNA sense strand
ucgcccaagauugaucgaggu

SEQ ID NO: 5160 - RNA, 21 nt, Artificial Sequence
  Ebola virus siRNA sense strand
cgcccaagauugaucgagguu

SEQ ID NO: 5161 - RNA, 21 nt, Artificial Sequence
  Ebola virus siRNA sense strand
gcccaagauugaucgagguug

SEQ ID NO: 5162 - RNA, 21 nt, Artificial Sequence
  Ebola virus siRNA sense strand
cccaagauugaucgagguugg

SEQ ID NO: 5163 - RNA, 21 nt, Artificial Sequence
  Ebola virus siRNA sense strand
ccaagauugaucgagguuggg

SEQ ID NO: 5164 - RNA, 21 nt, Artificial Sequence
  Ebola virus siRNA sense strand
caagauugaucgagguugggu

SEQ ID NO: 5165 - RNA, 21 nt, Artificial Sequence
  Ebola virus siRNA sense strand
aagauugaucgagguugggua

SEQ ID NO: 5166 - RNA, 21 nt, Artificial Sequence
  Ebola virus siRNA sense strand
agauugaucgagguuggguau

SEQ ID NO: 5167 - RNA, 21 nt, Artificial Sequence
  Ebola virus siRNA sense strand
gauugaucgagguuggguaug

SEQ ID NO: 5168 - RNA, 21 nt, Artificial Sequence
  Ebola virus siRNA sense strand
auugaucgagguuggguaugu

SEQ ID NO: 5169 - RNA, 21 nt, Artificial Sequence
  Ebola virus siRNA sense strand
uugaucgagguuggguaugug

SEQ ID NO: 5170 - RNA, 21 nt, Artificial Sequence
  Ebola virus siRNA sense strand
ugaucgagguuggguaugugu

SEQ ID NO: 5171 - RNA, 21 nt, Artificial Sequence
  Ebola virus siRNA sense strand
gaucgagguuggguauguguu

SEQ ID NO: 5172 - RNA, 21 nt, Artificial Sequence
  Ebola virus siRNA sense strand
aucgagguuggguauguguuu

SEQ ID NO: 5173 - RNA, 21 nt, Artificial Sequence
  Ebola virus siRNA sense strand
ucgagguuggguauguguuuu

SEQ ID NO: 5174 - RNA, 21 nt, Artificial Sequence
  Ebola virus siRNA sense strand
cgagguuggguauguguuuuu

SEQ ID NO: 5175 - RNA, 21 nt, Artificial Sequence
  Ebola virus siRNA sense strand
gagguuggguauguguuuuuc

SEQ ID NO: 5176 - RNA, 21 nt, Artificial Sequence
  Ebola virus siRNA sense strand
agguuggguauguguuuuuca

SEQ ID NO: 5177 - RNA, 21 nt, Artificial Sequence
  Ebola virus siRNA sense strand
gguuggguauguguuuuucag

SEQ ID NO: 5178 - RNA, 21 nt, Artificial Sequence
  Ebola virus siRNA sense strand
guuggguauguguuuuucagc

SEQ ID NO: 5179 - RNA, 21 nt, Artificial Sequence
  Ebola virus siRNA sense strand
uuggguauguguuuuucagcu

SEQ ID NO: 5180 - RNA, 21 nt, Artificial Sequence
  Ebola virus siRNA sense strand
uggguauguguuuuucagcuu

SEQ ID NO: 5181 - RNA, 21 nt, Artificial Sequence
  Ebola virus siRNA sense strand
ggguauguguuuuucagcuuc

SEQ ID NO: 5182 - RNA, 21 nt, Artificial Sequence
  Ebola virus siRNA sense strand
gguauguguuuuucagcuuca

SEQ ID NO: 5183 - RNA, 21 nt, Artificial Sequence
  Ebola virus siRNA sense strand
guauguguuuuucagcuucaa

SEQ ID NO: 5184 - RNA, 21 nt, Artificial Sequence
  Ebola virus siRNA sense strand
uauguguuuuucagcuucaag

SEQ ID NO: 5185 - RNA, 21 nt, Artificial Sequence
  Ebola virus siRNA sense strand
auguguuuuucagcuucaaga

SEQ ID NO: 5186 - RNA, 21 nt, Artificial Sequence
  Ebola virus siRNA sense strand
uguguuuuucagcuucaagau

SEQ ID NO: 5187 - RNA, 21 nt, Artificial Sequence
  Ebola virus siRNA sense strand
guguuuuucagcuucaagaug

SEQ ID NO: 5188 - RNA, 21 nt, Artificial Sequence
  Ebola virus siRNA sense strand
uguuuuucagcuucaagaugg

SEQ ID NO: 5189 - RNA, 21 nt, Artificial Sequence
  Ebola virus siRNA sense strand
guuuuucagcuucaagauggu

SEQ ID NO: 5190 - RNA, 21 nt, Artificial Sequence
  Ebola virus siRNA sense strand
uuuuucagcuucaagauggua

SEQ ID NO: 5191 - RNA, 21 nt, Artificial Sequence
  Ebola virus siRNA sense strand
uuuucagcuucaagaugguaa

SEQ ID NO: 5192 - RNA, 21 nt, Artificial Sequence
  Ebola virus siRNA sense strand
uuucagcuucaagaugguaaa

SEQ ID NO: 5193 - RNA, 21 nt, Artificial Sequence
  Ebola virus siRNA sense strand
uucagcuucaagaugguaaaa

SEQ ID NO: 5194 - RNA, 21 nt, Artificial Sequence
  Ebola virus siRNA sense strand
ucagcuucaagaugguaaaac

SEQ ID NO: 5195 - RNA, 21 nt, Artificial Sequence
  Ebola virus siRNA sense strand
cagcuucaagaugguaaaaca

SEQ ID NO: 5196 - RNA, 21 nt, Artificial Sequence
  Ebola virus siRNA sense strand
agcuucaagaugguaaaacac

SEQ ID NO: 5197 - RNA, 21 nt, Artificial Sequence
  Ebola virus siRNA sense strand
gcuucaagaugguaaaacacu

SEQ ID NO: 5198 - RNA, 21 nt, Artificial Sequence
  Ebola virus siRNA sense strand
cuucaagaugguaaaacacuu

SEQ ID NO: 5199 - RNA, 21 nt, Artificial Sequence
  Ebola virus siRNA sense strand
uucaagaugguaaaacacuug

SEQ ID NO: 5200 - RNA, 21 nt, Artificial Sequence
  Ebola virus siRNA sense strand
ucaagaugguaaaacacuugg

SEQ ID NO: 5201 - RNA, 21 nt, Artificial Sequence
  Ebola virus siRNA sense strand
caagaugguaaaacacuugga

SEQ ID NO: 5202 - RNA, 21 nt, Artificial Sequence
  Ebola virus siRNA sense strand
aagaugguaaaacacuuggac

SEQ ID NO: 5203 - RNA, 21 nt, Artificial Sequence
  Ebola virus siRNA sense strand
agaugguaaaacacuuggacu

SEQ ID NO: 5204 - RNA, 21 nt, Artificial Sequence
  Ebola virus siRNA sense strand
gaugguaaaacacuuggacuc

SEQ ID NO: 5205 - RNA, 21 nt, Artificial Sequence
  Ebola virus siRNA sense strand
augguaaaacacuuggacuca

SEQ ID NO: 5206 - RNA, 21 nt, Artificial Sequence
  Ebola virus siRNA sense strand
ugguaaaacacuuggacucaa

SEQ ID NO: 5207 - RNA, 21 nt, Artificial Sequence
  Ebola virus siRNA sense strand
gguaaaacacuuggacucaaa

SEQ ID NO: 5208 - RNA, 21 nt, Artificial Sequence
  Ebola virus siRNA sense strand
guaaaacacuuggacucaaaa

SEQ ID NO: 5209 - RNA, 21 nt, Artificial Sequence
  Ebola virus siRNA sense strand
uaaaacacuuggacucaaaau

SEQ ID NO: 5210 - RNA, 21 nt, Artificial Sequence
  Ebola virus siRNA sense strand
aaaacacuuggacucaaaauu

SEQ ID NO: 5211 - RNA, 21 nt, Artificial Sequence
  Ebola virus siRNA sense strand
aaacacuuggacucaaaauuu

SEQ ID NO: 5212 - RNA, 21 nt, Artificial Sequence
  Ebola virus siRNA sense strand
aacacuuggacucaaaauuug

SEQ ID NO: 5213 - RNA, 21 nt, Artificial Sequence
  Ebola virus siRNA sense strand
acacuuggacucaaaauuuga

SEQ ID NO: 5214 - RNA, 21 nt, Artificial Sequence
  Ebola virus siRNA sense strand
cacuuggacucaaaauuugag

SEQ ID NO: 5215 - RNA, 21 nt, Artificial Sequence
  Ebola virus siRNA sense strand
acuuggacucaaaauuugagc

SEQ ID NO: 5216 - RNA, 21 nt, Artificial Sequence
  Ebola virus siRNA sense strand
cuuggacucaaaauuugagcc

SEQ ID NO: 5217 - RNA, 21 nt, Artificial Sequence
  Ebola virus siRNA sense strand
uuggacucaaaauuugagcca

SEQ ID NO: 5218 - RNA, 21 nt, Artificial Sequence
  Ebola virus siRNA sense strand
uggacucaaaauuugagccaa

SEQ ID NO: 5219 - RNA, 21 nt, Artificial Sequence
  Ebola virus siRNA sense strand
ggacucaaaauuugagccaau

SEQ ID NO: 5220 - RNA, 21 nt, Artificial Sequence
  Ebola virus siRNA sense strand
gacucaaaauuugagccaauc

SEQ ID NO: 5221 - RNA, 21 nt, Artificial Sequence
  Ebola virus siRNA sense strand
acucaaaauuugagccaaucu

SEQ ID NO: 5222 - RNA, 21 nt, Artificial Sequence
  Ebola virus siRNA sense strand
cucaaaauuugagccaaucuc

SEQ ID NO: 5223 - RNA, 21 nt, Artificial Sequence
  Ebola virus siRNA sense strand
ucaaaauuugagccaaucucc

SEQ ID NO: 5224 - RNA, 21 nt, Artificial Sequence
  Ebola virus siRNA sense strand
caaaauuugagccaaucuccc

SEQ ID NO: 5225 - RNA, 21 nt, Artificial Sequence
  Ebola virus siRNA sense strand
aaaauuugagccaaucucccu

SEQ ID NO: 5226 - RNA, 21 nt, Artificial Sequence
  Ebola virus siRNA sense strand
aaauuugagccaaucucccuu

SEQ ID NO: 5227 - RNA, 21 nt, Artificial Sequence
  Ebola virus siRNA sense strand
aauuugagccaaucucccuuc

SEQ ID NO: 5228 - RNA, 21 nt, Artificial Sequence
  Ebola virus siRNA sense strand
auuugagccaaucucccuucc

SEQ ID NO: 5229 - RNA, 21 nt, Artificial Sequence
  Ebola virus siRNA sense strand
uuugagccaaucucccuuccc

SEQ ID NO: 5230 - RNA, 21 nt, Artificial Sequence
  Ebola virus siRNA sense strand
uugagccaaucucccuucccu

SEQ ID NO: 5231 - RNA, 21 nt, Artificial Sequence
  Ebola virus siRNA sense strand
ugagccaaucucccuucccuc

SEQ ID NO: 5232 - RNA, 21 nt, Artificial Sequence
  Ebola virus siRNA sense strand
gagccaaucucccuucccucc

SEQ ID NO: 5233 - RNA, 21 nt, Artificial Sequence
  Ebola virus siRNA sense strand
agccaaucucccuucccuccg

SEQ ID NO: 5234 - RNA, 21 nt, Artificial Sequence
  Ebola virus siRNA sense strand
gccaaucucccuucccuccga

SEQ ID NO: 5235 - RNA, 21 nt, Artificial Sequence
  Ebola virus siRNA sense strand
ccaaucucccuucccuccgaa

SEQ ID NO: 5236 - RNA, 21 nt, Artificial Sequence
  Ebola virus siRNA sense strand
caaucucccuucccuccgaaa

SEQ ID NO: 5237 - RNA, 21 nt, Artificial Sequence
  Ebola virus siRNA sense strand
aaucucccuucccuccgaaag

SEQ ID NO: 5238 - RNA, 21 nt, Artificial Sequence
  Ebola virus siRNA sense strand
aucucccuucccuccgaaaga

SEQ ID NO: 5239 - RNA, 21 nt, Artificial Sequence
  Ebola virus siRNA sense strand
ucucccuucccuccgaaagag

SEQ ID NO: 5240 - RNA, 21 nt, Artificial Sequence
  Ebola virus siRNA sense strand
cucccuucccuccgaaagagg

SEQ ID NO: 5241 - RNA, 21 nt, Artificial Sequence
  Ebola virus siRNA sense strand
ucccuucccuccgaaagaggc

SEQ ID NO: 5242 - RNA, 21 nt, Artificial Sequence
  Ebola virus siRNA sense strand
cccuucccuccgaaagaggcg

SEQ ID NO: 5243 - RNA, 21 nt, Artificial Sequence
  Ebola virus siRNA sense strand
ccuucccuccgaaagaggcga

SEQ ID NO: 5244 - RNA, 21 nt, Artificial Sequence
  Ebola virus siRNA sense strand
cuucccuccgaaagaggcgaa

SEQ ID NO: 5245 - RNA, 21 nt, Artificial Sequence
  Ebola virus siRNA sense strand
uucccuccgaaagaggcgaau

SEQ ID NO: 5246 - RNA, 21 nt, Artificial Sequence
  Ebola virus siRNA sense strand
ucccuccgaaagaggcgaaua

SEQ ID NO: 5247 - RNA, 21 nt, Artificial Sequence
  Ebola virus siRNA sense strand
cccuccgaaagaggcgaauaa

SEQ ID NO: 5248 - RNA, 21 nt, Artificial Sequence
  Ebola virus siRNA sense strand
ccuccgaaagaggcgaauaau

SEQ ID NO: 5249 - RNA, 21 nt, Artificial Sequence
  Ebola virus siRNA sense strand
cuccgaaagaggcgaauaaua

SEQ ID NO: 5250 - RNA, 21 nt, Artificial Sequence
  Ebola virus siRNA sense strand
uccgaaagaggcgaauaauag

SEQ ID NO: 5251 - RNA, 21 nt, Artificial Sequence
  Ebola virus siRNA sense strand
ccgaaagaggcgaauaauagc

SEQ ID NO: 5252 - RNA, 21 nt, Artificial Sequence
  Ebola virus siRNA sense strand
cgaaagaggcgaauaauagca

SEQ ID NO: 5253 - RNA, 21 nt, Artificial Sequence
  Ebola virus siRNA sense strand
gaaagaggcgaauaauagcag

SEQ ID NO: 5254 - RNA, 21 nt, Artificial Sequence
  Ebola virus siRNA sense strand
aaagaggcgaauaauagcaga

SEQ ID NO: 5255 - RNA, 21 nt, Artificial Sequence
  Ebola virus siRNA sense strand
aagaggcgaauaauagcagag

SEQ ID NO: 5256 - RNA, 21 nt, Artificial Sequence
  Ebola virus siRNA sense strand
agaggcgaauaauagcagagg

SEQ ID NO: 5257 - RNA, 21 nt, Artificial Sequence
  Ebola virus siRNA sense strand
gaggcgaauaauagcagaggc

SEQ ID NO: 5258 - RNA, 21 nt, Artificial Sequence
  Ebola virus siRNA sense strand
aggcgaauaauagcagaggcu

SEQ ID NO: 5259 - RNA, 21 nt, Artificial Sequence
  Ebola virus siRNA sense strand
ggcgaauaauagcagaggcuu

SEQ ID NO: 5260 - RNA, 21 nt, Artificial Sequence
  Ebola virus siRNA sense strand
gcgaauaauagcagaggcuuc

SEQ ID NO: 5261 - RNA, 21 nt, Artificial Sequence
  Ebola virus siRNA sense strand
cgaauaauagcagaggcuuca

SEQ ID NO: 5262 - RNA, 21 nt, Artificial Sequence
  Ebola virus siRNA sense strand
gaauaauagcagaggcuucaa

SEQ ID NO: 5263 - RNA, 21 nt, Artificial Sequence
  Ebola virus siRNA sense strand
aauaauagcagaggcuucaac

SEQ ID NO: 5264 - RNA, 21 nt, Artificial Sequence
  Ebola virus siRNA sense strand
auaauagcagaggcuucaacu

SEQ ID NO: 5265 - RNA, 21 nt, Artificial Sequence
  Ebola virus siRNA sense strand
uaauagcagaggcuucaacug

SEQ ID NO: 5266 - RNA, 21 nt, Artificial Sequence
  Ebola virus siRNA sense strand
aauagcagaggcuucaacugc

SEQ ID NO: 5267 - RNA, 21 nt, Artificial Sequence
  Ebola virus siRNA sense strand
auagcagaggcuucaacugcu

SEQ ID NO: 5268 - RNA, 21 nt, Artificial Sequence
  Ebola virus siRNA sense strand
uagcagaggcuucaacugcug

SEQ ID NO: 5269 - RNA, 21 nt, Artificial Sequence
  Ebola virus siRNA sense strand
agcagaggcuucaacugcuga

SEQ ID NO: 5270 - RNA, 21 nt, Artificial Sequence
  Ebola virus siRNA sense strand
gcagaggcuucaacugcugaa

SEQ ID NO: 5271 - RNA, 21 nt, Artificial Sequence
  Ebola virus siRNA sense strand
cagaggcuucaacugcugaac

SEQ ID NO: 5272 - RNA, 21 nt, Artificial Sequence
  Ebola virus siRNA sense strand
agaggcuucaacugcugaacu

SEQ ID NO: 5273 - RNA, 21 nt, Artificial Sequence
  Ebola virus siRNA sense strand
gaggcuucaacugcugaacua

SEQ ID NO: 5274 - RNA, 21 nt, Artificial Sequence
  Ebola virus siRNA sense strand
aggcuucaacugcugaacuau

SEQ ID NO: 5275 - RNA, 21 nt, Artificial Sequence
  Ebola virus siRNA sense strand
ggcuucaacugcugaacuaua

SEQ ID NO: 5276 - RNA, 21 nt, Artificial Sequence
  Ebola virus siRNA sense strand
gcuucaacugcugaacuauag

SEQ ID NO: 5277 - RNA, 21 nt, Artificial Sequence
  Ebola virus siRNA sense strand
cuucaacugcugaacuauagg

SEQ ID NO: 5278 - RNA, 21 nt, Artificial Sequence
  Ebola virus siRNA sense strand
uucaacugcugaacuauaggg

SEQ ID NO: 5279 - RNA, 21 nt, Artificial Sequence
  Ebola virus siRNA sense strand
ucaacugcugaacuauagggu

SEQ ID NO: 5280 - RNA, 21 nt, Artificial Sequence
  Ebola virus siRNA sense strand
caacugcugaacuauagggua

SEQ ID NO: 5281 - RNA, 21 nt, Artificial Sequence
  Ebola virus siRNA sense strand
aacugcugaacuauaggguac

SEQ ID NO: 5282 - RNA, 21 nt, Artificial Sequence
  Ebola virus siRNA sense strand
acugcugaacuauaggguacg

SEQ ID NO: 5283 - RNA, 21 nt, Artificial Sequence
  Ebola virus siRNA sense strand
cugcugaacuauaggguacgu

SEQ ID NO: 5284 - RNA, 21 nt, Artificial Sequence
  Ebola virus siRNA sense strand
ugcugaacuauaggguacguu

SEQ ID NO: 5285 - RNA, 21 nt, Artificial Sequence
  Ebola virus siRNA sense strand
gcugaacuauaggguacguua

SEQ ID NO: 5286 - RNA, 21 nt, Artificial Sequence
  Ebola virus siRNA sense strand
cugaacuauaggguacguuac

SEQ ID NO: 5287 - RNA, 21 nt, Artificial Sequence
  Ebola virus siRNA sense strand
ugaacuauaggguacguuaca

SEQ ID NO: 5288 - RNA, 21 nt, Artificial Sequence
  Ebola virus siRNA sense strand
gaacuauaggguacguuacau

SEQ ID NO: 5289 - RNA, 21 nt, Artificial Sequence
  Ebola virus siRNA sense strand
aacuauaggguacguuacauu

SEQ ID NO: 5290 - RNA, 21 nt, Artificial Sequence
  Ebola virus siRNA sense strand
acuauaggguacguuacauua

SEQ ID NO: 5291 - RNA, 21 nt, Artificial Sequence
  Ebola virus siRNA sense strand
cuauaggguacguuacauuaa

SEQ ID NO: 5292 - RNA, 21 nt, Artificial Sequence
  Ebola virus siRNA sense strand
uauaggguacguuacauuaau

SEQ ID NO: 5293 - RNA, 21 nt, Artificial Sequence
  Ebola virus siRNA sense strand
auaggguacguuacauuaaug

SEQ ID NO: 5294 - RNA, 21 nt, Artificial Sequence
  Ebola virus siRNA sense strand
uaggguacguuacauuaauga

SEQ ID NO: 5295 - RNA, 21 nt, Artificial Sequence
  Ebola virus siRNA sense strand
aggguacguuacauuaaugau

SEQ ID NO: 5296 - RNA, 21 nt, Artificial Sequence
  Ebola virus siRNA sense strand
ggguacguuacauuaaugaua

SEQ ID NO: 5297 - RNA, 21 nt, Artificial Sequence
  Ebola virus siRNA sense strand
gguacguuacauuaaugauac

SEQ ID NO: 5298 - RNA, 21 nt, Artificial Sequence
  Ebola virus siRNA sense strand
guacguuacauuaaugauaca

SEQ ID NO: 5299 - RNA, 21 nt, Artificial Sequence
  Ebola virus siRNA sense strand
uacguuacauuaaugauacac

SEQ ID NO: 5300 - RNA, 21 nt, Artificial Sequence
  Ebola virus siRNA sense strand
acguuacauuaaugauacacu

SEQ ID NO: 5301 - RNA, 21 nt, Artificial Sequence
  Ebola virus siRNA sense strand
cguuacauuaaugauacacuu

SEQ ID NO: 5302 - RNA, 21 nt, Artificial Sequence
  Ebola virus siRNA sense strand
guuacauuaaugauacacuug

SEQ ID NO: 5303 - RNA, 21 nt, Artificial Sequence
  Ebola virus siRNA sense strand
uuacauuaaugauacacuugu

SEQ ID NO: 5304 - RNA, 21 nt, Artificial Sequence
  Ebola virus siRNA sense strand
uacauuaaugauacacuugug

SEQ ID NO: 5305 - RNA, 21 nt, Artificial Sequence
  Ebola virus siRNA sense strand
acauuaaugauacacuuguga

SEQ ID NO: 5306 - RNA, 21 nt, Artificial Sequence
  Ebola virus siRNA sense strand
cauuaaugauacacuugugag

SEQ ID NO: 5307 - RNA, 21 nt, Artificial Sequence
  Ebola virus siRNA sense strand
auuaaugauacacuugugagu

SEQ ID NO: 5308 - RNA, 21 nt, Artificial Sequence
  Ebola virus siRNA sense strand
uuaaugauacacuugugagua

SEQ ID NO: 5309 - RNA, 21 nt, Artificial Sequence
  Ebola virus siRNA sense strand
uaaugauacacuugugaguau

SEQ ID NO: 5310 - RNA, 21 nt, Artificial Sequence
  Ebola virus siRNA sense strand
aaugauacacuugugaguauc

SEQ ID NO: 5311 - RNA, 21 nt, Artificial Sequence
  Ebola virus siRNA sense strand
augauacacuugugaguauca

SEQ ID NO: 5312 - RNA, 21 nt, Artificial Sequence
  Ebola virus siRNA sense strand
ugauacacuugugaguaucag

SEQ ID NO: 5313 - RNA, 21 nt, Artificial Sequence
  Ebola virus siRNA sense strand
gauacacuugugaguaucagc

SEQ ID NO: 5314 - RNA, 21 nt, Artificial Sequence
  Ebola virus siRNA sense strand
auacacuugugaguaucagcc

SEQ ID NO: 5315 - RNA, 21 nt, Artificial Sequence
  Ebola virus siRNA sense strand
uacacuugugaguaucagccc

SEQ ID NO: 5316 - RNA, 21 nt, Artificial Sequence
  Ebola virus siRNA sense strand
acacuugugaguaucagcccu

SEQ ID NO: 5317 - RNA, 21 nt, Artificial Sequence
  Ebola virus siRNA sense strand
cacuugugaguaucagcccug

SEQ ID NO: 5318 - RNA, 21 nt, Artificial Sequence
  Ebola virus siRNA sense strand
acuugugaguaucagcccugg

SEQ ID NO: 5319 - RNA, 21 nt, Artificial Sequence
  Ebola virus siRNA sense strand
cuugugaguaucagcccugga

SEQ ID NO: 5320 - RNA, 21 nt, Artificial Sequence
  Ebola virus siRNA sense strand
uugugaguaucagcccuggau

SEQ ID NO: 5321 - RNA, 21 nt, Artificial Sequence
  Ebola virus siRNA sense strand
ugugaguaucagcccuggaua

SEQ ID NO: 5322 - RNA, 21 nt, Artificial Sequence
  Ebola virus siRNA sense strand
gugaguaucagcccuggauaa

SEQ ID NO: 5323 - RNA, 21 nt, Artificial Sequence
  Ebola virus siRNA sense strand
ugaguaucagcccuggauaau

SEQ ID NO: 5324 - RNA, 21 nt, Artificial Sequence
  Ebola virus siRNA sense strand
gaguaucagcccuggauaaua

SEQ ID NO: 5325 - RNA, 21 nt, Artificial Sequence
  Ebola virus siRNA sense strand
aguaucagcccuggauaauau

SEQ ID NO: 5326 - RNA, 21 nt, Artificial Sequence
  Ebola virus siRNA sense strand
guaucagcccuggauaauaua

SEQ ID NO: 5327 - RNA, 21 nt, Artificial Sequence
  Ebola virus siRNA sense strand
uaucagcccuggauaauauaa

SEQ ID NO: 5328 - RNA, 21 nt, Artificial Sequence
  Ebola virus siRNA sense strand
aucagcccuggauaauauaag

SEQ ID NO: 5329 - RNA, 21 nt, Artificial Sequence
  Ebola virus siRNA sense strand
ucagcccuggauaauauaagu

SEQ ID NO: 5330 - RNA, 21 nt, Artificial Sequence
  Ebola virus siRNA sense strand
cagcccuggauaauauaaguc

SEQ ID NO: 5331 - RNA, 21 nt, Artificial Sequence
  Ebola virus siRNA sense strand
agcccuggauaauauaaguca

SEQ ID NO: 5332 - RNA, 21 nt, Artificial Sequence
  Ebola virus siRNA sense strand
gcccuggauaauauaagucaa

SEQ ID NO: 5333 - RNA, 21 nt, Artificial Sequence
  Ebola virus siRNA sense strand
cccuggauaauauaagucaau

SEQ ID NO: 5334 - RNA, 21 nt, Artificial Sequence
  Ebola virus siRNA sense strand
ccuggauaauauaagucaauu

SEQ ID NO: 5335 - RNA, 21 nt, Artificial Sequence
  Ebola virus siRNA sense strand
cuggauaauauaagucaauua

SEQ ID NO: 5336 - RNA, 21 nt, Artificial Sequence
  Ebola virus siRNA sense strand
uggauaauauaagucaauuaa

SEQ ID NO: 5337 - RNA, 21 nt, Artificial Sequence
  Ebola virus siRNA sense strand
ggauaauauaagucaauuaaa

SEQ ID NO: 5338 - RNA, 21 nt, Artificial Sequence
  Ebola virus siRNA sense strand
gauaauauaagucaauuaaac

SEQ ID NO: 5339 - RNA, 21 nt, Artificial Sequence
  Ebola virus siRNA sense strand
auaauauaagucaauuaaacg

SEQ ID NO: 5340 - RNA, 21 nt, Artificial Sequence
  Ebola virus siRNA sense strand
uaauauaagucaauuaaacga

SEQ ID NO: 5341 - RNA, 21 nt, Artificial Sequence
  Ebola virus siRNA sense strand
aauauaagucaauuaaacgac

SEQ ID NO: 5342 - RNA, 21 nt, Artificial Sequence
  Ebola virus siRNA sense strand
auauaagucaauuaaacgacc

SEQ ID NO: 5343 - RNA, 21 nt, Artificial Sequence
  Ebola virus siRNA sense strand
uauaagucaauuaaacgacca

SEQ ID NO: 5344 - RNA, 21 nt, Artificial Sequence
  Ebola virus siRNA sense strand
auaagucaauuaaacgaccaa

SEQ ID NO: 5345 - RNA, 21 nt, Artificial Sequence
  Ebola virus siRNA sense strand
uaagucaauuaaacgaccaag

SEQ ID NO: 5346 - RNA, 21 nt, Artificial Sequence
  Ebola virus siRNA sense strand
aagucaauuaaacgaccaaga

SEQ ID NO: 5347 - RNA, 21 nt, Artificial Sequence
  Ebola virus siRNA sense strand
agucaauuaaacgaccaagau

SEQ ID NO: 5348 - RNA, 21 nt, Artificial Sequence
  Ebola virus siRNA sense strand
gucaauuaaacgaccaagaua

SEQ ID NO: 5349 - RNA, 21 nt, Artificial Sequence
  Ebola virus siRNA sense strand
ucaauuaaacgaccaagauaa

SEQ ID NO: 5350 - RNA, 21 nt, Artificial Sequence
  Ebola virus siRNA sense strand
caauuaaacgaccaagauaaa

SEQ ID NO: 5351 - RNA, 21 nt, Artificial Sequence
  Ebola virus siRNA sense strand
aauuaaacgaccaagauaaaa

SEQ ID NO: 5352 - RNA, 21 nt, Artificial Sequence
  Ebola virus siRNA sense strand
auuaaacgaccaagauaaaau

SEQ ID NO: 5353 - RNA, 21 nt, Artificial Sequence
  Ebola virus siRNA sense strand
uuaaacgaccaagauaaaauu

SEQ ID NO: 5354 - RNA, 21 nt, Artificial Sequence
  Ebola virus siRNA sense strand
uaaacgaccaagauaaaauug

SEQ ID NO: 5355 - RNA, 21 nt, Artificial Sequence
  Ebola virus siRNA sense strand
aaacgaccaagauaaaauugu

SEQ ID NO: 5356 - RNA, 21 nt, Artificial Sequence
  Ebola virus siRNA sense strand
aacgaccaagauaaaauuguu

SEQ ID NO: 5357 - RNA, 21 nt, Artificial Sequence
  Ebola virus siRNA sense strand
acgaccaagauaaaauuguuc

SEQ ID NO: 5358 - RNA, 21 nt, Artificial Sequence
  Ebola virus siRNA sense strand
cgaccaagauaaaauuguuca

SEQ ID NO: 5359 - RNA, 21 nt, Artificial Sequence
  Ebola virus siRNA sense strand
gaccaagauaaaauuguucau

SEQ ID NO: 5360 - RNA, 21 nt, Artificial Sequence
  Ebola virus siRNA sense strand
accaagauaaaauuguucaua

SEQ ID NO: 5361 - RNA, 21 nt, Artificial Sequence
  Ebola virus siRNA sense strand
ccaagauaaaauuguucauau

SEQ ID NO: 5362 - RNA, 21 nt, Artificial Sequence
  Ebola virus siRNA sense strand
caagauaaaauuguucauauc

SEQ ID NO: 5363 - RNA, 21 nt, Artificial Sequence
  Ebola virus siRNA sense strand
aagauaaaauuguucauaucu

SEQ ID NO: 5364 - RNA, 21 nt, Artificial Sequence
  Ebola virus siRNA sense strand
agauaaaauuguucauaucuc

SEQ ID NO: 5365 - RNA, 21 nt, Artificial Sequence
  Ebola virus siRNA sense strand
gauaaaauuguucauaucucg

SEQ ID NO: 5366 - RNA, 21 nt, Artificial Sequence
  Ebola virus siRNA sense strand
auaaaauuguucauaucucgc

SEQ ID NO: 5367 - RNA, 21 nt, Artificial Sequence
  Ebola virus siRNA sense strand
uaaaauuguucauaucucgcu

SEQ ID NO: 5368 - RNA, 21 nt, Artificial Sequence
  Ebola virus siRNA sense strand
aaaauuguucauaucucgcua

SEQ ID NO: 5369 - RNA, 21 nt, Artificial Sequence
  Ebola virus siRNA sense strand
aaauuguucauaucucgcuag

SEQ ID NO: 5370 - RNA, 21 nt, Artificial Sequence
  Ebola virus siRNA sense strand
aauuguucauaucucgcuagc

SEQ ID NO: 5371 - RNA, 21 nt, Artificial Sequence
  Ebola virus siRNA sense strand
auuguucauaucucgcuagca

SEQ ID NO: 5372 - RNA, 21 nt, Artificial Sequence
  Ebola virus siRNA sense strand
uuguucauaucucgcuagcag

SEQ ID NO: 5373 - RNA, 21 nt, Artificial Sequence
  Ebola virus siRNA sense strand
uguucauaucucgcuagcagc

SEQ ID NO: 5374 - RNA, 21 nt, Artificial Sequence
  Ebola virus siRNA sense strand
guucauaucucgcuagcagcu

SEQ ID NO: 5375 - RNA, 21 nt, Artificial Sequence
  Ebola virus siRNA sense strand
uucauaucucgcuagcagcuu

SEQ ID NO: 5376 - RNA, 21 nt, Artificial Sequence
  Ebola virus siRNA sense strand
ucauaucucgcuagcagcuua

SEQ ID NO: 5377 - RNA, 21 nt, Artificial Sequence
  Ebola virus siRNA sense strand
cauaucucgcuagcagcuuaa

SEQ ID NO: 5378 - RNA, 21 nt, Artificial Sequence
  Ebola virus siRNA sense strand
auaucucgcuagcagcuuaaa

SEQ ID NO: 5379 - RNA, 21 nt, Artificial Sequence
  Ebola virus siRNA sense strand
uaucucgcuagcagcuuaaaa

SEQ ID NO: 5380 - RNA, 21 nt, Artificial Sequence
  Ebola virus siRNA sense strand
aucucgcuagcagcuuaaaau

SEQ ID NO: 5381 - RNA, 21 nt, Artificial Sequence
  Ebola virus siRNA sense strand
ucucgcuagcagcuuaaaaua

SEQ ID NO: 5382 - RNA, 21 nt, Artificial Sequence
  Ebola virus siRNA sense strand
cucgcuagcagcuuaaaauau

SEQ ID NO: 5383 - RNA, 21 nt, Artificial Sequence
  Ebola virus siRNA sense strand
ucgcuagcagcuuaaaauaua

SEQ ID NO: 5384 - RNA, 21 nt, Artificial Sequence
  Ebola virus siRNA sense strand
cgcuagcagcuuaaaauauaa

SEQ ID NO: 5385 - RNA, 21 nt, Artificial Sequence
  Ebola virus siRNA sense strand
gcuagcagcuuaaaauauaaa

SEQ ID NO: 5386 - RNA, 21 nt, Artificial Sequence
  Ebola virus siRNA sense strand
cuagcagcuuaaaauauaaau

SEQ ID NO: 5387 - RNA, 21 nt, Artificial Sequence
  Ebola virus siRNA sense strand
uagcagcuuaaaauauaaaug

SEQ ID NO: 5388 - RNA, 21 nt, Artificial Sequence
  Ebola virus siRNA sense strand
agcagcuuaaaauauaaaugu

SEQ ID NO: 5389 - RNA, 21 nt, Artificial Sequence
  Ebola virus siRNA sense strand
gcagcuuaaaauauaaaugua

SEQ ID NO: 5390 - RNA, 21 nt, Artificial Sequence
  Ebola virus siRNA sense strand
cagcuuaaaauauaaauguaa

SEQ ID NO: 5391 - RNA, 21 nt, Artificial Sequence
  Ebola virus siRNA sense strand
agcuuaaaauauaaauguaau

SEQ ID NO: 5392 - RNA, 21 nt, Artificial Sequence
  Ebola virus siRNA sense strand
gcuuaaaauauaaauguaaua

SEQ ID NO: 5393 - RNA, 21 nt, Artificial Sequence
  Ebola virus siRNA sense strand
cuuaaaauauaaauguaauag

SEQ ID NO: 5394 - RNA, 21 nt, Artificial Sequence
  Ebola virus siRNA sense strand
uuaaaauauaaauguaauagg

SEQ ID NO: 5395 - RNA, 21 nt, Artificial Sequence
  Ebola virus siRNA sense strand
uaaaauauaaauguaauagga

SEQ ID NO: 5396 - RNA, 21 nt, Artificial Sequence
  Ebola virus siRNA sense strand
aaaauauaaauguaauaggag

SEQ ID NO: 5397 - RNA, 21 nt, Artificial Sequence
  Ebola virus siRNA sense strand
aaauauaaauguaauaggagc

SEQ ID NO: 5398 - RNA, 21 nt, Artificial Sequence
  Ebola virus siRNA sense strand
aauauaaauguaauaggagcu

SEQ ID NO: 5399 - RNA, 21 nt, Artificial Sequence
  Ebola virus siRNA sense strand
auauaaauguaauaggagcua

SEQ ID NO: 5400 - RNA, 21 nt, Artificial Sequence
  Ebola virus siRNA sense strand
uauaaauguaauaggagcuau

SEQ ID NO: 5401 - RNA, 21 nt, Artificial Sequence
  Ebola virus siRNA sense strand
auaaauguaauaggagcuaua

SEQ ID NO: 5402 - RNA, 21 nt, Artificial Sequence
  Ebola virus siRNA sense strand
uaaauguaauaggagcuauau

SEQ ID NO: 5403 - RNA, 21 nt, Artificial Sequence
  Ebola virus siRNA sense strand
aaauguaauaggagcuauauc

SEQ ID NO: 5404 - RNA, 21 nt, Artificial Sequence
  Ebola virus siRNA sense strand
aauguaauaggagcuauaucu

SEQ ID NO: 5405 - RNA, 21 nt, Artificial Sequence
  Ebola virus siRNA sense strand
auguaauaggagcuauaucuc

SEQ ID NO: 5406 - RNA, 21 nt, Artificial Sequence
  Ebola virus siRNA sense strand
uguaauaggagcuauaucucu

SEQ ID NO: 5407 - RNA, 21 nt, Artificial Sequence
  Ebola virus siRNA sense strand
guaauaggagcuauaucucug

SEQ ID NO: 5408 - RNA, 21 nt, Artificial Sequence
  Ebola virus siRNA sense strand
uaauaggagcuauaucucuga

SEQ ID NO: 5409 - RNA, 21 nt, Artificial Sequence
  Ebola virus siRNA sense strand
aauaggagcuauaucucugac

SEQ ID NO: 5410 - RNA, 21 nt, Artificial Sequence
  Ebola virus siRNA sense strand
auaggagcuauaucucugaca

SEQ ID NO: 5411 - RNA, 21 nt, Artificial Sequence
  Ebola virus siRNA sense strand
uaggagcuauaucucugacag

SEQ ID NO: 5412 - RNA, 21 nt, Artificial Sequence
  Ebola virus siRNA sense strand
aggagcuauaucucugacagu

SEQ ID NO: 5413 - RNA, 21 nt, Artificial Sequence
  Ebola virus siRNA sense strand
ggagcuauaucucugacagua

SEQ ID NO: 5414 - RNA, 21 nt, Artificial Sequence
  Ebola virus siRNA sense strand
gagcuauaucucugacaguau

SEQ ID NO: 5415 - RNA, 21 nt, Artificial Sequence
  Ebola virus siRNA sense strand
agcuauaucucugacaguauu

SEQ ID NO: 5416 - RNA, 21 nt, Artificial Sequence
  Ebola virus siRNA sense strand
gcuauaucucugacaguauua

SEQ ID NO: 5417 - RNA, 21 nt, Artificial Sequence
  Ebola virus siRNA sense strand
cuauaucucugacaguauuau

SEQ ID NO: 5418 - RNA, 21 nt, Artificial Sequence
  Ebola virus siRNA sense strand
uauaucucugacaguauuaua

SEQ ID NO: 5419 - RNA, 21 nt, Artificial Sequence
  Ebola virus siRNA sense strand
auaucucugacaguauuauaa

SEQ ID NO: 5420 - RNA, 21 nt, Artificial Sequence
  Ebola virus siRNA sense strand
uaucucugacaguauuauaau

SEQ ID NO: 5421 - RNA, 21 nt, Artificial Sequence
  Ebola virus siRNA sense strand
aucucugacaguauuauaauc

SEQ ID NO: 5422 - RNA, 21 nt, Artificial Sequence
  Ebola virus siRNA sense strand
ucucugacaguauuauaauca

SEQ ID NO: 5423 - RNA, 21 nt, Artificial Sequence
  Ebola virus siRNA sense strand
cucugacaguauuauaaucaa

SEQ ID NO: 5424 - RNA, 21 nt, Artificial Sequence
  Ebola virus siRNA sense strand
ucugacaguauuauaaucaau

SEQ ID NO: 5425 - RNA, 21 nt, Artificial Sequence
  Ebola virus siRNA sense strand
cugacaguauuauaaucaauu

SEQ ID NO: 5426 - RNA, 21 nt, Artificial Sequence
  Ebola virus siRNA sense strand
ugacaguauuauaaucaauug

SEQ ID NO: 5427 - RNA, 21 nt, Artificial Sequence
  Ebola virus siRNA sense strand
gacaguauuauaaucaauugu

SEQ ID NO: 5428 - RNA, 21 nt, Artificial Sequence
  Ebola virus siRNA sense strand
acaguauuauaaucaauuguu

SEQ ID NO: 5429 - RNA, 21 nt, Artificial Sequence
  Ebola virus siRNA sense strand
caguauuauaaucaauuguua

SEQ ID NO: 5430 - RNA, 21 nt, Artificial Sequence
  Ebola virus siRNA sense strand
aguauuauaaucaauuguuau

SEQ ID NO: 5431 - RNA, 21 nt, Artificial Sequence
  Ebola virus siRNA sense strand
guauuauaaucaauuguuauu

SEQ ID NO: 5432 - RNA, 21 nt, Artificial Sequence
  Ebola virus siRNA sense strand
uauuauaaucaauuguuauua

SEQ ID NO: 5433 - RNA, 21 nt, Artificial Sequence
  Ebola virus siRNA sense strand
auuauaaucaauuguuauuaa

SEQ ID NO: 5434 - RNA, 21 nt, Artificial Sequence
  Ebola virus siRNA sense strand
uuauaaucaauuguuauuaag

SEQ ID NO: 5435 - RNA, 21 nt, Artificial Sequence
  Ebola virus siRNA sense strand
uauaaucaauuguuauuaagu

SEQ ID NO: 5436 - RNA, 21 nt, Artificial Sequence
  Ebola virus siRNA sense strand
auaaucaauuguuauuaagua

SEQ ID NO: 5437 - RNA, 21 nt, Artificial Sequence
  Ebola virus siRNA sense strand
uaaucaauuguuauuaaguaa

SEQ ID NO: 5438 - RNA, 21 nt, Artificial Sequence
  Ebola virus siRNA sense strand
aaucaauuguuauuaaguaac

SEQ ID NO: 5439 - RNA, 21 nt, Artificial Sequence
  Ebola virus siRNA sense strand
aucaauuguuauuaaguaacc

SEQ ID NO: 5440 - RNA, 21 nt, Artificial Sequence
  Ebola virus siRNA sense strand
ucaauuguuauuaaguaaccc

SEQ ID NO: 5441 - RNA, 21 nt, Artificial Sequence
  Ebola virus siRNA sense strand
caauuguuauuaaguaaccca

SEQ ID NO: 5442 - RNA, 21 nt, Artificial Sequence
  Ebola virus siRNA sense strand
aauuguuauuaaguaacccaa

SEQ ID NO: 5443 - RNA, 21 nt, Artificial Sequence
  Ebola virus siRNA sense strand
auuguuauuaaguaacccaaa

SEQ ID NO: 5444 - RNA, 21 nt, Artificial Sequence
  Ebola virus siRNA sense strand
uuguuauuaaguaacccaaac

SEQ ID NO: 5445 - RNA, 21 nt, Artificial Sequence
  Ebola virus siRNA sense strand
uguuauuaaguaacccaaacc

SEQ ID NO: 5446 - RNA, 21 nt, Artificial Sequence
  Ebola virus siRNA sense strand
guuauuaaguaacccaaacca

SEQ ID NO: 5447 - RNA, 21 nt, Artificial Sequence
  Ebola virus siRNA sense strand
uuauuaaguaacccaaaccaa

SEQ ID NO: 5448 - RNA, 21 nt, Artificial Sequence
  Ebola virus siRNA sense strand
uauuaaguaacccaaaccaaa

SEQ ID NO: 5449 - RNA, 21 nt, Artificial Sequence
  Ebola virus siRNA sense strand
auuaaguaacccaaaccaaaa

SEQ ID NO: 5450 - RNA, 21 nt, Artificial Sequence
  Ebola virus siRNA sense strand
uuaaguaacccaaaccaaaag

SEQ ID NO: 5451 - RNA, 21 nt, Artificial Sequence
  Ebola virus siRNA sense strand
uaaguaacccaaaccaaaagu

SEQ ID NO: 5452 - RNA, 21 nt, Artificial Sequence
  Ebola virus siRNA sense strand
aaguaacccaaaccaaaagug

SEQ ID NO: 5453 - RNA, 21 nt, Artificial Sequence
  Ebola virus siRNA sense strand
aguaacccaaaccaaaaguga

SEQ ID NO: 5454 - RNA, 21 nt, Artificial Sequence
  Ebola virus siRNA sense strand
guaacccaaaccaaaagugau

SEQ ID NO: 5455 - RNA, 21 nt, Artificial Sequence
  Ebola virus siRNA sense strand
uaacccaaaccaaaagugaug

SEQ ID NO: 5456 - RNA, 21 nt, Artificial Sequence
  Ebola virus siRNA sense strand
aacccaaaccaaaagugauga

SEQ ID NO: 5457 - RNA, 21 nt, Artificial Sequence
  Ebola virus siRNA sense strand
acccaaaccaaaagugaugaa

SEQ ID NO: 5458 - RNA, 21 nt, Artificial Sequence
  Ebola virus siRNA sense strand
cccaaaccaaaagugaugaag

SEQ ID NO: 5459 - RNA, 21 nt, Artificial Sequence
  Ebola virus siRNA sense strand
ccaaaccaaaagugaugaaga

SEQ ID NO: 5460 - RNA, 21 nt, Artificial Sequence
  Ebola virus siRNA sense strand
caaaccaaaagugaugaagau

SEQ ID NO: 5461 - RNA, 21 nt, Artificial Sequence
  Ebola virus siRNA sense strand
aaaccaaaagugaugaagauu

SEQ ID NO: 5462 - RNA, 21 nt, Artificial Sequence
  Ebola virus siRNA sense strand
aaccaaaagugaugaagauua

SEQ ID NO: 5463 - RNA, 21 nt, Artificial Sequence
  Ebola virus siRNA sense strand
accaaaagugaugaagauuaa

SEQ ID NO: 5464 - RNA, 21 nt, Artificial Sequence
  Ebola virus siRNA sense strand
ccaaaagugaugaagauuaag

SEQ ID NO: 5465 - RNA, 21 nt, Artificial Sequence
  Ebola virus siRNA sense strand
caaaagugaugaagauuaaga

SEQ ID NO: 5466 - RNA, 21 nt, Artificial Sequence
  Ebola virus siRNA sense strand
aaaagugaugaagauuaagaa

SEQ ID NO: 5467 - RNA, 21 nt, Artificial Sequence
  Ebola virus siRNA sense strand
aaagugaugaagauuaagaaa

SEQ ID NO: 5468 - RNA, 21 nt, Artificial Sequence
  Ebola virus siRNA sense strand
aagugaugaagauuaagaaaa

SEQ ID NO: 5469 - RNA, 21 nt, Artificial Sequence
  Ebola virus siRNA sense strand
agugaugaagauuaagaaaaa

SEQ ID NO: 5470 - RNA, 21 nt, Artificial Sequence
  Ebola virus siRNA sense strand
gugaugaagauuaagaaaaac

SEQ ID NO: 5471 - RNA, 21 nt, Artificial Sequence
  Ebola virus siRNA sense strand
ugaugaagauuaagaaaaacc

SEQ ID NO: 5472 - RNA, 21 nt, Artificial Sequence
  Ebola virus siRNA sense strand
gaugaagauuaagaaaaaccu

SEQ ID NO: 5473 - RNA, 21 nt, Artificial Sequence
  Ebola virus siRNA sense strand
augaagauuaagaaaaaccua

SEQ ID NO: 5474 - RNA, 21 nt, Artificial Sequence
  Ebola virus siRNA sense strand
ugaagauuaagaaaaaccuac

SEQ ID NO: 5475 - RNA, 21 nt, Artificial Sequence
  Ebola virus siRNA sense strand
gaagauuaagaaaaaccuacc

SEQ ID NO: 5476 - RNA, 21 nt, Artificial Sequence
  Ebola virus siRNA sense strand
aagauuaagaaaaaccuaccu

SEQ ID NO: 5477 - RNA, 21 nt, Artificial Sequence
  Ebola virus siRNA sense strand
agauuaagaaaaaccuaccuc

SEQ ID NO: 5478 - RNA, 21 nt, Artificial Sequence
  Ebola virus siRNA sense strand
gauuaagaaaaaccuaccucg

SEQ ID NO: 5479 - RNA, 21 nt, Artificial Sequence
  Ebola virus siRNA sense strand
auuaagaaaaaccuaccucgg

SEQ ID NO: 5480 - RNA, 21 nt, Artificial Sequence
  Ebola virus siRNA sense strand
uuaagaaaaaccuaccucggc

SEQ ID NO: 5481 - RNA, 21 nt, Artificial Sequence
  Ebola virus siRNA sense strand
uaagaaaaaccuaccucggcu

SEQ ID NO: 5482 - RNA, 21 nt, Artificial Sequence
  Ebola virus siRNA sense strand
aagaaaaaccuaccucggcug

SEQ ID NO: 5483 - RNA, 21 nt, Artificial Sequence
  Ebola virus siRNA sense strand
agaaaaaccuaccucggcuga

SEQ ID NO: 5484 - RNA, 21 nt, Artificial Sequence
  Ebola virus siRNA sense strand
gaaaaaccuaccucggcugag

SEQ ID NO: 5485 - RNA, 21 nt, Artificial Sequence
  Ebola virus siRNA sense strand
aaaaaccuaccucggcugaga

SEQ ID NO: 5486 - RNA, 21 nt, Artificial Sequence
  Ebola virus siRNA sense strand
aaaaccuaccucggcugagag

SEQ ID NO: 5487 - RNA, 21 nt, Artificial Sequence
  Ebola virus siRNA sense strand
aaaccuaccucggcugagaga

SEQ ID NO: 5488 - RNA, 21 nt, Artificial Sequence
  Ebola virus siRNA sense strand
aaccuaccucggcugagagag

SEQ ID NO: 5489 - RNA, 21 nt, Artificial Sequence
  Ebola virus siRNA sense strand
accuaccucggcugagagagu

SEQ ID NO: 5490 - RNA, 21 nt, Artificial Sequence
  Ebola virus siRNA sense strand
ccuaccucggcugagagagug

SEQ ID NO: 5491 - RNA, 21 nt, Artificial Sequence
  Ebola virus siRNA sense strand
cuaccucggcugagagagugu

SEQ ID NO: 5492 - RNA, 21 nt, Artificial Sequence
  Ebola virus siRNA sense strand
uaccucggcugagagaguguu

SEQ ID NO: 5493 - RNA, 21 nt, Artificial Sequence
  Ebola virus siRNA sense strand
accucggcugagagaguguuu

SEQ ID NO: 5494 - RNA, 21 nt, Artificial Sequence
  Ebola virus siRNA sense strand
ccucggcugagagaguguuuu

SEQ ID NO: 5495 - RNA, 21 nt, Artificial Sequence
  Ebola virus siRNA sense strand
cucggcugagagaguguuuuu

SEQ ID NO: 5496 - RNA, 21 nt, Artificial Sequence
  Ebola virus siRNA sense strand
ucggcugagagaguguuuuuu

SEQ ID NO: 5497 - RNA, 21 nt, Artificial Sequence
  Ebola virus siRNA sense strand
cggcugagagaguguuuuuuc

SEQ ID NO: 5498 - RNA, 21 nt, Artificial Sequence
  Ebola virus siRNA sense strand
ggcugagagaguguuuuuuca

SEQ ID NO: 5499 - RNA, 21 nt, Artificial Sequence
  Ebola virus siRNA sense strand
gcugagagaguguuuuuucau

SEQ ID NO: 5500 - RNA, 21 nt, Artificial Sequence
  Ebola virus siRNA sense strand
cugagagaguguuuuuucauu

SEQ ID NO: 5501 - RNA, 21 nt, Artificial Sequence
  Ebola virus siRNA sense strand
ugagagaguguuuuuucauua

SEQ ID NO: 5502 - RNA, 21 nt, Artificial Sequence
  Ebola virus siRNA sense strand
gagagaguguuuuuucauuaa

SEQ ID NO: 5503 - RNA, 21 nt, Artificial Sequence
  Ebola virus siRNA sense strand
agagaguguuuuuucauuaac

SEQ ID NO: 5504 - RNA, 21 nt, Artificial Sequence
  Ebola virus siRNA sense strand
gagaguguuuuuucauuaacc

SEQ ID NO: 5505 - RNA, 21 nt, Artificial Sequence
  Ebola virus siRNA sense strand
agaguguuuuuucauuaaccu

SEQ ID NO: 5506 - RNA, 21 nt, Artificial Sequence
  Ebola virus siRNA sense strand
gaguguuuuuucauuaaccuu

SEQ ID NO: 5507 - RNA, 21 nt, Artificial Sequence
  Ebola virus siRNA sense strand
aguguuuuuucauuaaccuuc

SEQ ID NO: 5508 - RNA, 21 nt, Artificial Sequence
  Ebola virus siRNA sense strand
guguuuuuucauuaaccuuca

SEQ ID NO: 5509 - RNA, 21 nt, Artificial Sequence
  Ebola virus siRNA sense strand
uguuuuuucauuaaccuucau

SEQ ID NO: 5510 - RNA, 21 nt, Artificial Sequence
  Ebola virus siRNA sense strand
guuuuuucauuaaccuucauc

SEQ ID NO: 5511 - RNA, 21 nt, Artificial Sequence
  Ebola virus siRNA sense strand
uuuuuucauuaaccuucaucu

SEQ ID NO: 5512 - RNA, 21 nt, Artificial Sequence
  Ebola virus siRNA sense strand
uuuuucauuaaccuucaucuu

SEQ ID NO: 5513 - RNA, 21 nt, Artificial Sequence
  Ebola virus siRNA sense strand
uuuucauuaaccuucaucuug

SEQ ID NO: 5514 - RNA, 21 nt, Artificial Sequence
  Ebola virus siRNA sense strand
uuucauuaaccuucaucuugu

SEQ ID NO: 5515 - RNA, 21 nt, Artificial Sequence
  Ebola virus siRNA sense strand
uucauuaaccuucaucuugua

SEQ ID NO: 5516 - RNA, 21 nt, Artificial Sequence
  Ebola virus siRNA sense strand
ucauuaaccuucaucuuguaa

SEQ ID NO: 5517 - RNA, 21 nt, Artificial Sequence
  Ebola virus siRNA sense strand
cauuaaccuucaucuuguaaa

SEQ ID NO: 5518 - RNA, 21 nt, Artificial Sequence
  Ebola virus siRNA sense strand
auuaaccuucaucuuguaaac

SEQ ID NO: 5519 - RNA, 21 nt, Artificial Sequence
  Ebola virus siRNA sense strand
uuaaccuucaucuuguaaacg

SEQ ID NO: 5520 - RNA, 21 nt, Artificial Sequence
  Ebola virus siRNA sense strand
uaaccuucaucuuguaaacgu

SEQ ID NO: 5521 - RNA, 21 nt, Artificial Sequence
  Ebola virus siRNA sense strand
aaccuucaucuuguaaacguu

SEQ ID NO: 5522 - RNA, 21 nt, Artificial Sequence
  Ebola virus siRNA sense strand
accuucaucuuguaaacguug

SEQ ID NO: 5523 - RNA, 21 nt, Artificial Sequence
  Ebola virus siRNA sense strand
ccuucaucuuguaaacguuga

SEQ ID NO: 5524 - RNA, 21 nt, Artificial Sequence
  Ebola virus siRNA sense strand
cuucaucuuguaaacguugag

SEQ ID NO: 5525 - RNA, 21 nt, Artificial Sequence
  Ebola virus siRNA sense strand
uucaucuuguaaacguugagc

SEQ ID NO: 5526 - RNA, 21 nt, Artificial Sequence
  Ebola virus siRNA sense strand
ucaucuuguaaacguugagca

SEQ ID NO: 5527 - RNA, 21 nt, Artificial Sequence
  Ebola virus siRNA sense strand
caucuuguaaacguugagcaa

SEQ ID NO: 5528 - RNA, 21 nt, Artificial Sequence
  Ebola virus siRNA sense strand
aucuuguaaacguugagcaaa

SEQ ID NO: 5529 - RNA, 21 nt, Artificial Sequence
  Ebola virus siRNA sense strand
ucuuguaaacguugagcaaaa

SEQ ID NO: 5530 - RNA, 21 nt, Artificial Sequence
  Ebola virus siRNA sense strand
cuuguaaacguugagcaaaau

SEQ ID NO: 5531 - RNA, 21 nt, Artificial Sequence
  Ebola virus siRNA sense strand
uuguaaacguugagcaaaauu

SEQ ID NO: 5532 - RNA, 21 nt, Artificial Sequence
  Ebola virus siRNA sense strand
uguaaacguugagcaaaauug

SEQ ID NO: 5533 - RNA, 21 nt, Artificial Sequence
  Ebola virus siRNA sense strand
guaaacguugagcaaaauugu

SEQ ID NO: 5534 - RNA, 21 nt, Artificial Sequence
  Ebola virus siRNA sense strand
uaaacguugagcaaaauuguu

SEQ ID NO: 5535 - RNA, 21 nt, Artificial Sequence
  Ebola virus siRNA sense strand
aaacguugagcaaaauuguua

SEQ ID NO: 5536 - RNA, 21 nt, Artificial Sequence
  Ebola virus siRNA sense strand
aacguugagcaaaauuguuaa

SEQ ID NO: 5537 - RNA, 21 nt, Artificial Sequence
  Ebola virus siRNA sense strand
acguugagcaaaauuguuaaa

SEQ ID NO: 5538 - RNA, 21 nt, Artificial Sequence
  Ebola virus siRNA sense strand
cguugagcaaaauuguuaaaa

SEQ ID NO: 5539 - RNA, 21 nt, Artificial Sequence
  Ebola virus siRNA sense strand
guugagcaaaauuguuaaaaa

SEQ ID NO: 5540 - RNA, 21 nt, Artificial Sequence
  Ebola virus siRNA sense strand
uugagcaaaauuguuaaaaau

SEQ ID NO: 5541 - RNA, 21 nt, Artificial Sequence
  Ebola virus siRNA sense strand
ugagcaaaauuguuaaaaaua

SEQ ID NO: 5542 - RNA, 21 nt, Artificial Sequence
  Ebola virus siRNA sense strand
gagcaaaauuguuaaaaauau

SEQ ID NO: 5543 - RNA, 21 nt, Artificial Sequence
  Ebola virus siRNA sense strand
agcaaaauuguuaaaaauaug

SEQ ID NO: 5544 - RNA, 21 nt, Artificial Sequence
  Ebola virus siRNA sense strand
gcaaaauuguuaaaaauauga

SEQ ID NO: 5545 - RNA, 21 nt, Artificial Sequence
  Ebola virus siRNA sense strand
caaaauuguuaaaaauaugag

SEQ ID NO: 5546 - RNA, 21 nt, Artificial Sequence
  Ebola virus siRNA sense strand
aaaauuguuaaaaauaugagg

SEQ ID NO: 5547 - RNA, 21 nt, Artificial Sequence
  Ebola virus siRNA sense strand
aaauuguuaaaaauaugaggc

SEQ ID NO: 5548 - RNA, 21 nt, Artificial Sequence
  Ebola virus siRNA sense strand
aauuguuaaaaauaugaggcg

SEQ ID NO: 5549 - RNA, 21 nt, Artificial Sequence
  Ebola virus siRNA sense strand
auuguuaaaaauaugaggcgg

SEQ ID NO: 5550 - RNA, 21 nt, Artificial Sequence
  Ebola virus siRNA sense strand
uuguuaaaaauaugaggcggg

SEQ ID NO: 5551 - RNA, 21 nt, Artificial Sequence
  Ebola virus siRNA sense strand
uguuaaaaauaugaggcgggu

SEQ ID NO: 5552 - RNA, 21 nt, Artificial Sequence
  Ebola virus siRNA sense strand
guuaaaaauaugaggcggguu

SEQ ID NO: 5553 - RNA, 21 nt, Artificial Sequence
  Ebola virus siRNA sense strand
uuaaaaauaugaggcggguua

SEQ ID NO: 5554 - RNA, 21 nt, Artificial Sequence
  Ebola virus siRNA sense strand
uaaaaauaugaggcggguuau

SEQ ID NO: 5555 - RNA, 21 nt, Artificial Sequence
  Ebola virus siRNA sense strand
aaaaauaugaggcggguuaua

SEQ ID NO: 5556 - RNA, 21 nt, Artificial Sequence
  Ebola virus siRNA sense strand
aaaauaugaggcggguuauau

SEQ ID NO: 5557 - RNA, 21 nt, Artificial Sequence
  Ebola virus siRNA sense strand
aaauaugaggcggguuauauu

SEQ ID NO: 5558 - RNA, 21 nt, Artificial Sequence
  Ebola virus siRNA sense strand
aauaugaggcggguuauauug

SEQ ID NO: 5559 - RNA, 21 nt, Artificial Sequence
  Ebola virus siRNA sense strand
auaugaggcggguuauauugc

SEQ ID NO: 5560 - RNA, 21 nt, Artificial Sequence
  Ebola virus siRNA sense strand
uaugaggcggguuauauugcc

SEQ ID NO: 5561 - RNA, 21 nt, Artificial Sequence
  Ebola virus siRNA sense strand
augaggcggguuauauugccu

SEQ ID NO: 5562 - RNA, 21 nt, Artificial Sequence
  Ebola virus siRNA sense strand
ugaggcggguuauauugccua

SEQ ID NO: 5563 - RNA, 21 nt, Artificial Sequence
  Ebola virus siRNA sense strand
gaggcggguuauauugccuac

SEQ ID NO: 5564 - RNA, 21 nt, Artificial Sequence
  Ebola virus siRNA sense strand
aggcggguuauauugccuacu

SEQ ID NO: 5565 - RNA, 21 nt, Artificial Sequence
  Ebola virus siRNA sense strand
ggcggguuauauugccuacug

SEQ ID NO: 5566 - RNA, 21 nt, Artificial Sequence
  Ebola virus siRNA sense strand
gcggguuauauugccuacugc

SEQ ID NO: 5567 - RNA, 21 nt, Artificial Sequence
  Ebola virus siRNA sense strand
cggguuauauugccuacugcu

SEQ ID NO: 5568 - RNA, 21 nt, Artificial Sequence
  Ebola virus siRNA sense strand
ggguuauauugccuacugcuc

SEQ ID NO: 5569 - RNA, 21 nt, Artificial Sequence
  Ebola virus siRNA sense strand
gguuauauugccuacugcucc

SEQ ID NO: 5570 - RNA, 21 nt, Artificial Sequence
  Ebola virus siRNA sense strand
guuauauugccuacugcuccu

SEQ ID NO: 5571 - RNA, 21 nt, Artificial Sequence
  Ebola virus siRNA sense strand
uuauauugccuacugcuccuc

SEQ ID NO: 5572 - RNA, 21 nt, Artificial Sequence
  Ebola virus siRNA sense strand
uauauugccuacugcuccucc

SEQ ID NO: 5573 - RNA, 21 nt, Artificial Sequence
  Ebola virus siRNA sense strand
auauugccuacugcuccuccu

SEQ ID NO: 5574 - RNA, 21 nt, Artificial Sequence
  Ebola virus siRNA sense strand
uauugccuacugcuccuccug

SEQ ID NO: 5575 - RNA, 21 nt, Artificial Sequence
  Ebola virus siRNA sense strand
auugccuacugcuccuccuga

SEQ ID NO: 5576 - RNA, 21 nt, Artificial Sequence
  Ebola virus siRNA sense strand
uugccuacugcuccuccugaa

SEQ ID NO: 5577 - RNA, 21 nt, Artificial Sequence
  Ebola virus siRNA sense strand
ugccuacugcuccuccugaau

SEQ ID NO: 5578 - RNA, 21 nt, Artificial Sequence
  Ebola virus siRNA sense strand
gccuacugcuccuccugaaua

SEQ ID NO: 5579 - RNA, 21 nt, Artificial Sequence
  Ebola virus siRNA sense strand
ccuacugcuccuccugaauau

SEQ ID NO: 5580 - RNA, 21 nt, Artificial Sequence
  Ebola virus siRNA sense strand
cuacugcuccuccugaauaua

SEQ ID NO: 5581 - RNA, 21 nt, Artificial Sequence
  Ebola virus siRNA sense strand
uacugcuccuccugaauauau

SEQ ID NO: 5582 - RNA, 21 nt, Artificial Sequence
  Ebola virus siRNA sense strand
acugcuccuccugaauauaug

SEQ ID NO: 5583 - RNA, 21 nt, Artificial Sequence
  Ebola virus siRNA sense strand
cugcuccuccugaauauaugg

SEQ ID NO: 5584 - RNA, 21 nt, Artificial Sequence
  Ebola virus siRNA sense strand
ugcuccuccugaauauaugga

SEQ ID NO: 5585 - RNA, 21 nt, Artificial Sequence
  Ebola virus siRNA sense strand
gcuccuccugaauauauggag

SEQ ID NO: 5586 - RNA, 21 nt, Artificial Sequence
  Ebola virus siRNA sense strand
cuccuccugaauauauggagg

SEQ ID NO: 5587 - RNA, 21 nt, Artificial Sequence
  Ebola virus siRNA sense strand
uccuccugaauauauggaggc

SEQ ID NO: 5588 - RNA, 21 nt, Artificial Sequence
  Ebola virus siRNA sense strand
ccuccugaauauauggaggcc

SEQ ID NO: 5589 - RNA, 21 nt, Artificial Sequence
  Ebola virus siRNA sense strand
cuccugaauauauggaggcca

SEQ ID NO: 5590 - RNA, 21 nt, Artificial Sequence
  Ebola virus siRNA sense strand
uccugaauauauggaggccau

SEQ ID NO: 5591 - RNA, 21 nt, Artificial Sequence
  Ebola virus siRNA sense strand
ccugaauauauggaggccaua

SEQ ID NO: 5592 - RNA, 21 nt, Artificial Sequence
  Ebola virus siRNA sense strand
cugaauauauggaggccauau

SEQ ID NO: 5593 - RNA, 21 nt, Artificial Sequence
  Ebola virus siRNA sense strand
ugaauauauggaggccauaua

SEQ ID NO: 5594 - RNA, 21 nt, Artificial Sequence
  Ebola virus siRNA sense strand
gaauauauggaggccauauac

SEQ ID NO: 5595 - RNA, 21 nt, Artificial Sequence
  Ebola virus siRNA sense strand
aauauauggaggccauauacc

SEQ ID NO: 5596 - RNA, 21 nt, Artificial Sequence
  Ebola virus siRNA sense strand
auauauggaggccauauaccc

SEQ ID NO: 5597 - RNA, 21 nt, Artificial Sequence
  Ebola virus siRNA sense strand
uauauggaggccauauacccu

SEQ ID NO: 5598 - RNA, 21 nt, Artificial Sequence
  Ebola virus siRNA sense strand
auauggaggccauauacccug

SEQ ID NO: 5599 - RNA, 21 nt, Artificial Sequence
  Ebola virus siRNA sense strand
uauggaggccauauacccugu

SEQ ID NO: 5600 - RNA, 21 nt, Artificial Sequence
  Ebola virus siRNA sense strand
auggaggccauauacccuguc

SEQ ID NO: 5601 - RNA, 21 nt, Artificial Sequence
  Ebola virus siRNA sense strand
uggaggccauauacccuguca

SEQ ID NO: 5602 - RNA, 21 nt, Artificial Sequence
  Ebola virus siRNA sense strand
ggaggccauauacccugucag

SEQ ID NO: 5603 - RNA, 21 nt, Artificial Sequence
  Ebola virus siRNA sense strand
gaggccauauacccugucagg

SEQ ID NO: 5604 - RNA, 21 nt, Artificial Sequence
  Ebola virus siRNA sense strand
aggccauauacccugucaggu

SEQ ID NO: 5605 - RNA, 21 nt, Artificial Sequence
  Ebola virus siRNA sense strand
ggccauauacccugucagguc

SEQ ID NO: 5606 - RNA, 21 nt, Artificial Sequence
  Ebola virus siRNA sense strand
gccauauacccugucagguca

SEQ ID NO: 5607 - RNA, 21 nt, Artificial Sequence
  Ebola virus siRNA sense strand
ccauauacccugucaggucaa

SEQ ID NO: 5608 - RNA, 21 nt, Artificial Sequence
  Ebola virus siRNA sense strand
cauauacccugucaggucaaa

SEQ ID NO: 5609 - RNA, 21 nt, Artificial Sequence
  Ebola virus siRNA sense strand
auauacccugucaggucaaau

SEQ ID NO: 5610 - RNA, 21 nt, Artificial Sequence
  Ebola virus siRNA sense strand
uauacccugucaggucaaauu

SEQ ID NO: 5611 - RNA, 21 nt, Artificial Sequence
  Ebola virus siRNA sense strand
auacccugucaggucaaauuc

SEQ ID NO: 5612 - RNA, 21 nt, Artificial Sequence
  Ebola virus siRNA sense strand
uacccugucaggucaaauuca

SEQ ID NO: 5613 - RNA, 21 nt, Artificial Sequence
  Ebola virus siRNA sense strand
acccugucaggucaaauucaa

SEQ ID NO: 5614 - RNA, 21 nt, Artificial Sequence
  Ebola virus siRNA sense strand
cccugucaggucaaauucaac

SEQ ID NO: 5615 - RNA, 21 nt, Artificial Sequence
  Ebola virus siRNA sense strand
ccugucaggucaaauucaaca

SEQ ID NO: 5616 - RNA, 21 nt, Artificial Sequence
  Ebola virus siRNA sense strand
cugucaggucaaauucaacaa

SEQ ID NO: 5617 - RNA, 21 nt, Artificial Sequence
  Ebola virus siRNA sense strand
ugucaggucaaauucaacaau

SEQ ID NO: 5618 - RNA, 21 nt, Artificial Sequence
  Ebola virus siRNA sense strand
gucaggucaaauucaacaauu

SEQ ID NO: 5619 - RNA, 21 nt, Artificial Sequence
  Ebola virus siRNA sense strand
ucaggucaaauucaacaauug

SEQ ID NO: 5620 - RNA, 21 nt, Artificial Sequence
  Ebola virus siRNA sense strand
caggucaaauucaacaauugc

SEQ ID NO: 5621 - RNA, 21 nt, Artificial Sequence
  Ebola virus siRNA sense strand
aggucaaauucaacaauugcu

SEQ ID NO: 5622 - RNA, 21 nt, Artificial Sequence
  Ebola virus siRNA sense strand
ggucaaauucaacaauugcua

SEQ ID NO: 5623 - RNA, 21 nt, Artificial Sequence
  Ebola virus siRNA sense strand
gucaaauucaacaauugcuag

SEQ ID NO: 5624 - RNA, 21 nt, Artificial Sequence
  Ebola virus siRNA sense strand
ucaaauucaacaauugcuaga

SEQ ID NO: 5625 - RNA, 21 nt, Artificial Sequence
  Ebola virus siRNA sense strand
caaauucaacaauugcuagag

SEQ ID NO: 5626 - RNA, 21 nt, Artificial Sequence
  Ebola virus siRNA sense strand
aaauucaacaauugcuagagg

SEQ ID NO: 5627 - RNA, 21 nt, Artificial Sequence
  Ebola virus siRNA sense strand
aauucaacaauugcuagaggu

SEQ ID NO: 5628 - RNA, 21 nt, Artificial Sequence
  Ebola virus siRNA sense strand
auucaacaauugcuagaggug

SEQ ID NO: 5629 - RNA, 21 nt, Artificial Sequence
  Ebola virus siRNA sense strand
uucaacaauugcuagaggugg

SEQ ID NO: 5630 - RNA, 21 nt, Artificial Sequence
  Ebola virus siRNA sense strand
ucaacaauugcuagagguggc

SEQ ID NO: 5631 - RNA, 21 nt, Artificial Sequence
  Ebola virus siRNA sense strand
caacaauugcuagagguggca

SEQ ID NO: 5632 - RNA, 21 nt, Artificial Sequence
  Ebola virus siRNA sense strand
aacaauugcuagagguggcaa

SEQ ID NO: 5633 - RNA, 21 nt, Artificial Sequence
  Ebola virus siRNA sense strand
acaauugcuagagguggcaac

SEQ ID NO: 5634 - RNA, 21 nt, Artificial Sequence
  Ebola virus siRNA sense strand
caauugcuagagguggcaaca

SEQ ID NO: 5635 - RNA, 21 nt, Artificial Sequence
  Ebola virus siRNA sense strand
aauugcuagagguggcaacag

SEQ ID NO: 5636 - RNA, 21 nt, Artificial Sequence
  Ebola virus siRNA sense strand
auugcuagagguggcaacagc

SEQ ID NO: 5637 - RNA, 21 nt, Artificial Sequence
  Ebola virus siRNA sense strand
uugcuagagguggcaacagca

SEQ ID NO: 5638 - RNA, 21 nt, Artificial Sequence
  Ebola virus siRNA sense strand
ugcuagagguggcaacagcaa

SEQ ID NO: 5639 - RNA, 21 nt, Artificial Sequence
  Ebola virus siRNA sense strand
gcuagagguggcaacagcaau

SEQ ID NO: 5640 - RNA, 21 nt, Artificial Sequence
  Ebola virus siRNA sense strand
cuagagguggcaacagcaaua

SEQ ID NO: 5641 - RNA, 21 nt, Artificial Sequence
  Ebola virus siRNA sense strand
uagagguggcaacagcaauac

SEQ ID NO: 5642 - RNA, 21 nt, Artificial Sequence
  Ebola virus siRNA sense strand
agagguggcaacagcaauaca

SEQ ID NO: 5643 - RNA, 21 nt, Artificial Sequence
  Ebola virus siRNA sense strand
gagguggcaacagcaauacag

SEQ ID NO: 5644 - RNA, 21 nt, Artificial Sequence
  Ebola virus siRNA sense strand
agguggcaacagcaauacagg

SEQ ID NO: 5645 - RNA, 21 nt, Artificial Sequence
  Ebola virus siRNA sense strand
gguggcaacagcaauacaggc

SEQ ID NO: 5646 - RNA, 21 nt, Artificial Sequence
  Ebola virus siRNA sense strand
guggcaacagcaauacaggcu

SEQ ID NO: 5647 - RNA, 21 nt, Artificial Sequence
  Ebola virus siRNA sense strand
uggcaacagcaauacaggcuu

SEQ ID NO: 5648 - RNA, 21 nt, Artificial Sequence
  Ebola virus siRNA sense strand
ggcaacagcaauacaggcuuc

SEQ ID NO: 5649 - RNA, 21 nt, Artificial Sequence
  Ebola virus siRNA sense strand
gcaacagcaauacaggcuucc

SEQ ID NO: 5650 - RNA, 21 nt, Artificial Sequence
  Ebola virus siRNA sense strand
caacagcaauacaggcuuccu

SEQ ID NO: 5651 - RNA, 21 nt, Artificial Sequence
  Ebola virus siRNA sense strand
aacagcaauacaggcuuccug

SEQ ID NO: 5652 - RNA, 21 nt, Artificial Sequence
  Ebola virus siRNA sense strand
acagcaauacaggcuuccuga

SEQ ID NO: 5653 - RNA, 21 nt, Artificial Sequence
  Ebola virus siRNA sense strand
cagcaauacaggcuuccugac

SEQ ID NO: 5654 - RNA, 21 nt, Artificial Sequence
  Ebola virus siRNA sense strand
agcaauacaggcuuccugaca

SEQ ID NO: 5655 - RNA, 21 nt, Artificial Sequence
  Ebola virus siRNA sense strand
gcaauacaggcuuccugacac

SEQ ID NO: 5656 - RNA, 21 nt, Artificial Sequence
  Ebola virus siRNA sense strand
caauacaggcuuccugacacc

SEQ ID NO: 5657 - RNA, 21 nt, Artificial Sequence
  Ebola virus siRNA sense strand
aauacaggcuuccugacaccg

SEQ ID NO: 5658 - RNA, 21 nt, Artificial Sequence
  Ebola virus siRNA sense strand
auacaggcuuccugacaccgg

SEQ ID NO: 5659 - RNA, 21 nt, Artificial Sequence
  Ebola virus siRNA sense strand
uacaggcuuccugacaccgga

SEQ ID NO: 5660 - RNA, 21 nt, Artificial Sequence
  Ebola virus siRNA sense strand
acaggcuuccugacaccggag

SEQ ID NO: 5661 - RNA, 21 nt, Artificial Sequence
  Ebola virus siRNA sense strand
caggcuuccugacaccggagu

SEQ ID NO: 5662 - RNA, 21 nt, Artificial Sequence
  Ebola virus siRNA sense strand
aggcuuccugacaccggaguc

SEQ ID NO: 5663 - RNA, 21 nt, Artificial Sequence
  Ebola virus siRNA sense strand
ggcuuccugacaccggaguca

SEQ ID NO: 5664 - RNA, 21 nt, Artificial Sequence
  Ebola virus siRNA sense strand
gcuuccugacaccggagucag

SEQ ID NO: 5665 - RNA, 21 nt, Artificial Sequence
  Ebola virus siRNA sense strand
cuuccugacaccggagucagu

SEQ ID NO: 5666 - RNA, 21 nt, Artificial Sequence
  Ebola virus siRNA sense strand
uuccugacaccggagucaguc

SEQ ID NO: 5667 - RNA, 21 nt, Artificial Sequence
  Ebola virus siRNA sense strand
uccugacaccggagucaguca

SEQ ID NO: 5668 - RNA, 21 nt, Artificial Sequence
  Ebola virus siRNA sense strand
ccugacaccggagucagucaa

SEQ ID NO: 5669 - RNA, 21 nt, Artificial Sequence
  Ebola virus siRNA sense strand
cugacaccggagucagucaau

SEQ ID NO: 5670 - RNA, 21 nt, Artificial Sequence
  Ebola virus siRNA sense strand
ugacaccggagucagucaaug

SEQ ID NO: 5671 - RNA, 21 nt, Artificial Sequence
  Ebola virus siRNA sense strand
gacaccggagucagucaaugg

SEQ ID NO: 5672 - RNA, 21 nt, Artificial Sequence
  Ebola virus siRNA sense strand
acaccggagucagucaauggg

SEQ ID NO: 5673 - RNA, 21 nt, Artificial Sequence
  Ebola virus siRNA sense strand
caccggagucagucaaugggg

SEQ ID NO: 5674 - RNA, 21 nt, Artificial Sequence
  Ebola virus siRNA sense strand
accggagucagucaaugggga

SEQ ID NO: 5675 - RNA, 21 nt, Artificial Sequence
  Ebola virus siRNA sense strand
ccggagucagucaauggggac

SEQ ID NO: 5676 - RNA, 21 nt, Artificial Sequence
  Ebola virus siRNA sense strand
cggagucagucaauggggaca

SEQ ID NO: 5677 - RNA, 21 nt, Artificial Sequence
  Ebola virus siRNA sense strand
ggagucagucaauggggacac

SEQ ID NO: 5678 - RNA, 21 nt, Artificial Sequence
  Ebola virus siRNA sense strand
gagucagucaauggggacacu

SEQ ID NO: 5679 - RNA, 21 nt, Artificial Sequence
  Ebola virus siRNA sense strand
agucagucaauggggacacuc

SEQ ID NO: 5680 - RNA, 21 nt, Artificial Sequence
  Ebola virus siRNA sense strand
gucagucaauggggacacucc

SEQ ID NO: 5681 - RNA, 21 nt, Artificial Sequence
  Ebola virus siRNA sense strand
ucagucaauggggacacucca

SEQ ID NO: 5682 - RNA, 21 nt, Artificial Sequence
  Ebola virus siRNA sense strand
cagucaauggggacacuccau

SEQ ID NO: 5683 - RNA, 21 nt, Artificial Sequence
  Ebola virus siRNA sense strand
agucaauggggacacuccauc

SEQ ID NO: 5684 - RNA, 21 nt, Artificial Sequence
  Ebola virus siRNA sense strand
gucaauggggacacuccaucg

SEQ ID NO: 5685 - RNA, 21 nt, Artificial Sequence
  Ebola virus siRNA sense strand
ucaauggggacacuccaucga

SEQ ID NO: 5686 - RNA, 21 nt, Artificial Sequence
  Ebola virus siRNA sense strand
caauggggacacuccaucgaa

SEQ ID NO: 5687 - RNA, 21 nt, Artificial Sequence
  Ebola virus siRNA sense strand
aauggggacacuccaucgaau

SEQ ID NO: 5688 - RNA, 21 nt, Artificial Sequence
  Ebola virus siRNA sense strand
auggggacacuccaucgaauc

SEQ ID NO: 5689 - RNA, 21 nt, Artificial Sequence
  Ebola virus siRNA sense strand
uggggacacuccaucgaaucc

SEQ ID NO: 5690 - RNA, 21 nt, Artificial Sequence
  Ebola virus siRNA sense strand
ggggacacuccaucgaaucca

SEQ ID NO: 5691 - RNA, 21 nt, Artificial Sequence
  Ebola virus siRNA sense strand
gggacacuccaucgaauccac

SEQ ID NO: 5692 - RNA, 21 nt, Artificial Sequence
  Ebola virus siRNA sense strand
ggacacuccaucgaauccacu

SEQ ID NO: 5693 - RNA, 21 nt, Artificial Sequence
  Ebola virus siRNA sense strand
gacacuccaucgaauccacuc

SEQ ID NO: 5694 - RNA, 21 nt, Artificial Sequence
  Ebola virus siRNA sense strand
acacuccaucgaauccacuca

SEQ ID NO: 5695 - RNA, 21 nt, Artificial Sequence
  Ebola virus siRNA sense strand
cacuccaucgaauccacucag

SEQ ID NO: 5696 - RNA, 21 nt, Artificial Sequence
  Ebola virus siRNA sense strand
acuccaucgaauccacucagg

SEQ ID NO: 5697 - RNA, 21 nt, Artificial Sequence
  Ebola virus siRNA sense strand
cuccaucgaauccacucaggc

SEQ ID NO: 5698 - RNA, 21 nt, Artificial Sequence
  Ebola virus siRNA sense strand
uccaucgaauccacucaggcc

SEQ ID NO: 5699 - RNA, 21 nt, Artificial Sequence
  Ebola virus siRNA sense strand
ccaucgaauccacucaggcca

SEQ ID NO: 5700 - RNA, 21 nt, Artificial Sequence
  Ebola virus siRNA sense strand
caucgaauccacucaggccaa

SEQ ID NO: 5701 - RNA, 21 nt, Artificial Sequence
  Ebola virus siRNA sense strand
aucgaauccacucaggccaau

SEQ ID NO: 5702 - RNA, 21 nt, Artificial Sequence
  Ebola virus siRNA sense strand
ucgaauccacucaggccaauu

SEQ ID NO: 5703 - RNA, 21 nt, Artificial Sequence
  Ebola virus siRNA sense strand
cgaauccacucaggccaauug

SEQ ID NO: 5704 - RNA, 21 nt, Artificial Sequence
  Ebola virus siRNA sense strand
gaauccacucaggccaauugc

SEQ ID NO: 5705 - RNA, 21 nt, Artificial Sequence
  Ebola virus siRNA sense strand
aauccacucaggccaauugcc

SEQ ID NO: 5706 - RNA, 21 nt, Artificial Sequence
  Ebola virus siRNA sense strand
auccacucaggccaauugccg

SEQ ID NO: 5707 - RNA, 21 nt, Artificial Sequence
  Ebola virus siRNA sense strand
uccacucaggccaauugccga

SEQ ID NO: 5708 - RNA, 21 nt, Artificial Sequence
  Ebola virus siRNA sense strand
ccacucaggccaauugccgau

SEQ ID NO: 5709 - RNA, 21 nt, Artificial Sequence
  Ebola virus siRNA sense strand
cacucaggccaauugccgaug

SEQ ID NO: 5710 - RNA, 21 nt, Artificial Sequence
  Ebola virus siRNA sense strand
acucaggccaauugccgauga

SEQ ID NO: 5711 - RNA, 21 nt, Artificial Sequence
  Ebola virus siRNA sense strand
cucaggccaauugccgaugac

SEQ ID NO: 5712 - RNA, 21 nt, Artificial Sequence
  Ebola virus siRNA sense strand
ucaggccaauugccgaugaca

SEQ ID NO: 5713 - RNA, 21 nt, Artificial Sequence
  Ebola virus siRNA sense strand
caggccaauugccgaugacac

SEQ ID NO: 5714 - RNA, 21 nt, Artificial Sequence
  Ebola virus siRNA sense strand
aggccaauugccgaugacacc

SEQ ID NO: 5715 - RNA, 21 nt, Artificial Sequence
  Ebola virus siRNA sense strand
ggccaauugccgaugacacca

SEQ ID NO: 5716 - RNA, 21 nt, Artificial Sequence
  Ebola virus siRNA sense strand
gccaauugccgaugacaccau

SEQ ID NO: 5717 - RNA, 21 nt, Artificial Sequence
  Ebola virus siRNA sense strand
ccaauugccgaugacaccauc

SEQ ID NO: 5718 - RNA, 21 nt, Artificial Sequence
  Ebola virus siRNA sense strand
caauugccgaugacaccaucg

SEQ ID NO: 5719 - RNA, 21 nt, Artificial Sequence
  Ebola virus siRNA sense strand
aauugccgaugacaccaucga

SEQ ID NO: 5720 - RNA, 21 nt, Artificial Sequence
  Ebola virus siRNA sense strand
auugccgaugacaccaucgac

SEQ ID NO: 5721 - RNA, 21 nt, Artificial Sequence
  Ebola virus siRNA sense strand
uugccgaugacaccaucgacc

SEQ ID NO: 5722 - RNA, 21 nt, Artificial Sequence
  Ebola virus siRNA sense strand
ugccgaugacaccaucgacca

SEQ ID NO: 5723 - RNA, 21 nt, Artificial Sequence
  Ebola virus siRNA sense strand
gccgaugacaccaucgaccau

SEQ ID NO: 5724 - RNA, 21 nt, Artificial Sequence
  Ebola virus siRNA sense strand
ccgaugacaccaucgaccaug

SEQ ID NO: 5725 - RNA, 21 nt, Artificial Sequence
  Ebola virus siRNA sense strand
cgaugacaccaucgaccaugc

SEQ ID NO: 5726 - RNA, 21 nt, Artificial Sequence
  Ebola virus siRNA sense strand
gaugacaccaucgaccaugcc

SEQ ID NO: 5727 - RNA, 21 nt, Artificial Sequence
  Ebola virus siRNA sense strand
augacaccaucgaccaugcca

SEQ ID NO: 5728 - RNA, 21 nt, Artificial Sequence
  Ebola virus siRNA sense strand
ugacaccaucgaccaugccag

SEQ ID NO: 5729 - RNA, 21 nt, Artificial Sequence
  Ebola virus siRNA sense strand
gacaccaucgaccaugccagc

SEQ ID NO: 5730 - RNA, 21 nt, Artificial Sequence
  Ebola virus siRNA sense strand
acaccaucgaccaugccagcc

SEQ ID NO: 5731 - RNA, 21 nt, Artificial Sequence
  Ebola virus siRNA sense strand
caccaucgaccaugccagcca

SEQ ID NO: 5732 - RNA, 21 nt, Artificial Sequence
  Ebola virus siRNA sense strand
accaucgaccaugccagccac

SEQ ID NO: 5733 - RNA, 21 nt, Artificial Sequence
  Ebola virus siRNA sense strand
ccaucgaccaugccagccaca

SEQ ID NO: 5734 - RNA, 21 nt, Artificial Sequence
  Ebola virus siRNA sense strand
caucgaccaugccagccacac

SEQ ID NO: 5735 - RNA, 21 nt, Artificial Sequence
  Ebola virus siRNA sense strand
aucgaccaugccagccacaca

SEQ ID NO: 5736 - RNA, 21 nt, Artificial Sequence
  Ebola virus siRNA sense strand
ucgaccaugccagccacacac

SEQ ID NO: 5737 - RNA, 21 nt, Artificial Sequence
  Ebola virus siRNA sense strand
cgaccaugccagccacacacc

SEQ ID NO: 5738 - RNA, 21 nt, Artificial Sequence
  Ebola virus siRNA sense strand
gaccaugccagccacacacca

SEQ ID NO: 5739 - RNA, 21 nt, Artificial Sequence
  Ebola virus siRNA sense strand
accaugccagccacacaccag

SEQ ID NO: 5740 - RNA, 21 nt, Artificial Sequence
  Ebola virus siRNA sense strand
ccaugccagccacacaccagg

SEQ ID NO: 5741 - RNA, 21 nt, Artificial Sequence
  Ebola virus siRNA sense strand
caugccagccacacaccaggc

SEQ ID NO: 5742 - RNA, 21 nt, Artificial Sequence
  Ebola virus siRNA sense strand
augccagccacacaccaggca

SEQ ID NO: 5743 - RNA, 21 nt, Artificial Sequence
  Ebola virus siRNA sense strand
ugccagccacacaccaggcag

SEQ ID NO: 5744 - RNA, 21 nt, Artificial Sequence
  Ebola virus siRNA sense strand
gccagccacacaccaggcagu

SEQ ID NO: 5745 - RNA, 21 nt, Artificial Sequence
  Ebola virus siRNA sense strand
ccagccacacaccaggcagug

SEQ ID NO: 5746 - RNA, 21 nt, Artificial Sequence
  Ebola virus siRNA sense strand
cagccacacaccaggcagugu

SEQ ID NO: 5747 - RNA, 21 nt, Artificial Sequence
  Ebola virus siRNA sense strand
agccacacaccaggcagugug

SEQ ID NO: 5748 - RNA, 21 nt, Artificial Sequence
  Ebola virus siRNA sense strand
gccacacaccaggcagugugu

SEQ ID NO: 5749 - RNA, 21 nt, Artificial Sequence
  Ebola virus siRNA sense strand
ccacacaccaggcaguguguc

SEQ ID NO: 5750 - RNA, 21 nt, Artificial Sequence
  Ebola virus siRNA sense strand
cacacaccaggcaguguguca

SEQ ID NO: 5751 - RNA, 21 nt, Artificial Sequence
  Ebola virus siRNA sense strand
acacaccaggcagugugucau

SEQ ID NO: 5752 - RNA, 21 nt, Artificial Sequence
  Ebola virus siRNA sense strand
cacaccaggcagugugucauc

SEQ ID NO: 5753 - RNA, 21 nt, Artificial Sequence
  Ebola virus siRNA sense strand
acaccaggcagugugucauca

SEQ ID NO: 5754 - RNA, 21 nt, Artificial Sequence
  Ebola virus siRNA sense strand
caccaggcagugugucaucag

SEQ ID NO: 5755 - RNA, 21 nt, Artificial Sequence
  Ebola virus siRNA sense strand
accaggcagugugucaucagc

SEQ ID NO: 5756 - RNA, 21 nt, Artificial Sequence
  Ebola virus siRNA sense strand
ccaggcagugugucaucagca

SEQ ID NO: 5757 - RNA, 21 nt, Artificial Sequence
  Ebola virus siRNA sense strand
caggcagugugucaucagcau

SEQ ID NO: 5758 - RNA, 21 nt, Artificial Sequence
  Ebola virus siRNA sense strand
aggcagugugucaucagcauu

SEQ ID NO: 5759 - RNA, 21 nt, Artificial Sequence
  Ebola virus siRNA sense strand
ggcagugugucaucagcauuc

SEQ ID NO: 5760 - RNA, 21 nt, Artificial Sequence
  Ebola virus siRNA sense strand
gcagugugucaucagcauuca

SEQ ID NO: 5761 - RNA, 21 nt, Artificial Sequence
  Ebola virus siRNA sense strand
cagugugucaucagcauucau

SEQ ID NO: 5762 - RNA, 21 nt, Artificial Sequence
  Ebola virus siRNA sense strand
agugugucaucagcauucauc

SEQ ID NO: 5763 - RNA, 21 nt, Artificial Sequence
  Ebola virus siRNA sense strand
gugugucaucagcauucaucc

SEQ ID NO: 5764 - RNA, 21 nt, Artificial Sequence
  Ebola virus siRNA sense strand
ugugucaucagcauucauccu

SEQ ID NO: 5765 - RNA, 21 nt, Artificial Sequence
  Ebola virus siRNA sense strand
gugucaucagcauucauccuu

SEQ ID NO: 5766 - RNA, 21 nt, Artificial Sequence
  Ebola virus siRNA sense strand
ugucaucagcauucauccuug

SEQ ID NO: 5767 - RNA, 21 nt, Artificial Sequence
  Ebola virus siRNA sense strand
gucaucagcauucauccuuga

SEQ ID NO: 5768 - RNA, 21 nt, Artificial Sequence
  Ebola virus siRNA sense strand
ucaucagcauucauccuugaa

SEQ ID NO: 5769 - RNA, 21 nt, Artificial Sequence
  Ebola virus siRNA sense strand
caucagcauucauccuugaag

SEQ ID NO: 5770 - RNA, 21 nt, Artificial Sequence
  Ebola virus siRNA sense strand
aucagcauucauccuugaagc

SEQ ID NO: 5771 - RNA, 21 nt, Artificial Sequence
  Ebola virus siRNA sense strand
ucagcauucauccuugaagcu

SEQ ID NO: 5772 - RNA, 21 nt, Artificial Sequence
  Ebola virus siRNA sense strand
cagcauucauccuugaagcua

SEQ ID NO: 5773 - RNA, 21 nt, Artificial Sequence
  Ebola virus siRNA sense strand
agcauucauccuugaagcuau

SEQ ID NO: 5774 - RNA, 21 nt, Artificial Sequence
  Ebola virus siRNA sense strand
gcauucauccuugaagcuaug

SEQ ID NO: 5775 - RNA, 21 nt, Artificial Sequence
  Ebola virus siRNA sense strand
cauucauccuugaagcuaugg

SEQ ID NO: 5776 - RNA, 21 nt, Artificial Sequence
  Ebola virus siRNA sense strand
auucauccuugaagcuauggu

SEQ ID NO: 5777 - RNA, 21 nt, Artificial Sequence
  Ebola virus siRNA sense strand
uucauccuugaagcuauggug

SEQ ID NO: 5778 - RNA, 21 nt, Artificial Sequence
  Ebola virus siRNA sense strand
ucauccuugaagcuaugguga

SEQ ID NO: 5779 - RNA, 21 nt, Artificial Sequence
  Ebola virus siRNA sense strand
cauccuugaagcuauggugaa

SEQ ID NO: 5780 - RNA, 21 nt, Artificial Sequence
  Ebola virus siRNA sense strand
auccuugaagcuauggugaau

SEQ ID NO: 5781 - RNA, 21 nt, Artificial Sequence
  Ebola virus siRNA sense strand
uccuugaagcuauggugaaug

SEQ ID NO: 5782 - RNA, 21 nt, Artificial Sequence
  Ebola virus siRNA sense strand
ccuugaagcuauggugaaugu

SEQ ID NO: 5783 - RNA, 21 nt, Artificial Sequence
  Ebola virus siRNA sense strand
cuugaagcuauggugaauguc

SEQ ID NO: 5784 - RNA, 21 nt, Artificial Sequence
  Ebola virus siRNA sense strand
uugaagcuauggugaauguca

SEQ ID NO: 5785 - RNA, 21 nt, Artificial Sequence
  Ebola virus siRNA sense strand
ugaagcuauggugaaugucau

SEQ ID NO: 5786 - RNA, 21 nt, Artificial Sequence
  Ebola virus siRNA sense strand
gaagcuauggugaaugucaua

SEQ ID NO: 5787 - RNA, 21 nt, Artificial Sequence
  Ebola virus siRNA sense strand
aagcuauggugaaugucauau

SEQ ID NO: 5788 - RNA, 21 nt, Artificial Sequence
  Ebola virus siRNA sense strand
agcuauggugaaugucauauc

SEQ ID NO: 5789 - RNA, 21 nt, Artificial Sequence
  Ebola virus siRNA sense strand
gcuauggugaaugucauaucg

SEQ ID NO: 5790 - RNA, 21 nt, Artificial Sequence
  Ebola virus siRNA sense strand
cuauggugaaugucauaucgg

SEQ ID NO: 5791 - RNA, 21 nt, Artificial Sequence
  Ebola virus siRNA sense strand
uauggugaaugucauaucggg

SEQ ID NO: 5792 - RNA, 21 nt, Artificial Sequence
  Ebola virus siRNA sense strand
auggugaaugucauaucgggc

SEQ ID NO: 5793 - RNA, 21 nt, Artificial Sequence
  Ebola virus siRNA sense strand
uggugaaugucauaucgggcc

SEQ ID NO: 5794 - RNA, 21 nt, Artificial Sequence
  Ebola virus siRNA sense strand
ggugaaugucauaucgggccc

SEQ ID NO: 5795 - RNA, 21 nt, Artificial Sequence
  Ebola virus siRNA sense strand
gugaaugucauaucgggcccc

SEQ ID NO: 5796 - RNA, 21 nt, Artificial Sequence
  Ebola virus siRNA sense strand
ugaaugucauaucgggcccca

SEQ ID NO: 5797 - RNA, 21 nt, Artificial Sequence
  Ebola virus siRNA sense strand
gaaugucauaucgggccccaa

SEQ ID NO: 5798 - RNA, 21 nt, Artificial Sequence
  Ebola virus siRNA sense strand
aaugucauaucgggccccaaa

SEQ ID NO: 5799 - RNA, 21 nt, Artificial Sequence
  Ebola virus siRNA sense strand
augucauaucgggccccaaag

SEQ ID NO: 5800 - RNA, 21 nt, Artificial Sequence
  Ebola virus siRNA sense strand
ugucauaucgggccccaaagu

SEQ ID NO: 5801 - RNA, 21 nt, Artificial Sequence
  Ebola virus siRNA sense strand
gucauaucgggccccaaagug

SEQ ID NO: 5802 - RNA, 21 nt, Artificial Sequence
  Ebola virus siRNA sense strand
ucauaucgggccccaaagugc

SEQ ID NO: 5803 - RNA, 21 nt, Artificial Sequence
  Ebola virus siRNA sense strand
cauaucgggccccaaagugcu

SEQ ID NO: 5804 - RNA, 21 nt, Artificial Sequence
  Ebola virus siRNA sense strand
auaucgggccccaaagugcua

SEQ ID NO: 5805 - RNA, 21 nt, Artificial Sequence
  Ebola virus siRNA sense strand
uaucgggccccaaagugcuaa

SEQ ID NO: 5806 - RNA, 21 nt, Artificial Sequence
  Ebola virus siRNA sense strand
aucgggccccaaagugcuaau

SEQ ID NO: 5807 - RNA, 21 nt, Artificial Sequence
  Ebola virus siRNA sense strand
ucgggccccaaagugcuaaug

SEQ ID NO: 5808 - RNA, 21 nt, Artificial Sequence
  Ebola virus siRNA sense strand
cgggccccaaagugcuaauga

SEQ ID NO: 5809 - RNA, 21 nt, Artificial Sequence
  Ebola virus siRNA sense strand
gggccccaaagugcuaaugaa

SEQ ID NO: 5810 - RNA, 21 nt, Artificial Sequence
  Ebola virus siRNA sense strand
ggccccaaagugcuaaugaag

SEQ ID NO: 5811 - RNA, 21 nt, Artificial Sequence
  Ebola virus siRNA sense strand
gccccaaagugcuaaugaagc

SEQ ID NO: 5812 - RNA, 21 nt, Artificial Sequence
  Ebola virus siRNA sense strand
ccccaaagugcuaaugaagca

SEQ ID NO: 5813 - RNA, 21 nt, Artificial Sequence
  Ebola virus siRNA sense strand
cccaaagugcuaaugaagcaa

SEQ ID NO: 5814 - RNA, 21 nt, Artificial Sequence
  Ebola virus siRNA sense strand
ccaaagugcuaaugaagcaaa

SEQ ID NO: 5815 - RNA, 21 nt, Artificial Sequence
  Ebola virus siRNA sense strand
caaagugcuaaugaagcaaau

SEQ ID NO: 5816 - RNA, 21 nt, Artificial Sequence
  Ebola virus siRNA sense strand
aaagugcuaaugaagcaaauu

SEQ ID NO: 5817 - RNA, 21 nt, Artificial Sequence
  Ebola virus siRNA sense strand
aagugcuaaugaagcaaauuc

SEQ ID NO: 5818 - RNA, 21 nt, Artificial Sequence
  Ebola virus siRNA sense strand
agugcuaaugaagcaaauucc

SEQ ID NO: 5819 - RNA, 21 nt, Artificial Sequence
  Ebola virus siRNA sense strand
gugcuaaugaagcaaauucca

SEQ ID NO: 5820 - RNA, 21 nt, Artificial Sequence
  Ebola virus siRNA sense strand
ugcuaaugaagcaaauuccaa

SEQ ID NO: 5821 - RNA, 21 nt, Artificial Sequence
  Ebola virus siRNA sense strand
gcuaaugaagcaaauuccaau

SEQ ID NO: 5822 - RNA, 21 nt, Artificial Sequence
  Ebola virus siRNA sense strand
cuaaugaagcaaauuccaauu

SEQ ID NO: 5823 - RNA, 21 nt, Artificial Sequence
  Ebola virus siRNA sense strand
uaaugaagcaaauuccaauuu

SEQ ID NO: 5824 - RNA, 21 nt, Artificial Sequence
  Ebola virus siRNA sense strand
aaugaagcaaauuccaauuug

SEQ ID NO: 5825 - RNA, 21 nt, Artificial Sequence
  Ebola virus siRNA sense strand
augaagcaaauuccaauuugg

SEQ ID NO: 5826 - RNA, 21 nt, Artificial Sequence
  Ebola virus siRNA sense strand
ugaagcaaauuccaauuuggc

SEQ ID NO: 5827 - RNA, 21 nt, Artificial Sequence
  Ebola virus siRNA sense strand
gaagcaaauuccaauuuggcu

SEQ ID NO: 5828 - RNA, 21 nt, Artificial Sequence
  Ebola virus siRNA sense strand
aagcaaauuccaauuuggcuu

SEQ ID NO: 5829 - RNA, 21 nt, Artificial Sequence
  Ebola virus siRNA sense strand
agcaaauuccaauuuggcuuc

SEQ ID NO: 5830 - RNA, 21 nt, Artificial Sequence
  Ebola virus siRNA sense strand
gcaaauuccaauuuggcuucc

SEQ ID NO: 5831 - RNA, 21 nt, Artificial Sequence
  Ebola virus siRNA sense strand
caaauuccaauuuggcuuccu

SEQ ID NO: 5832 - RNA, 21 nt, Artificial Sequence
  Ebola virus siRNA sense strand
aaauuccaauuuggcuuccuc

SEQ ID NO: 5833 - RNA, 21 nt, Artificial Sequence
  Ebola virus siRNA sense strand
aauuccaauuuggcuuccucu

SEQ ID NO: 5834 - RNA, 21 nt, Artificial Sequence
  Ebola virus siRNA sense strand
auuccaauuuggcuuccucua

SEQ ID NO: 5835 - RNA, 21 nt, Artificial Sequence
  Ebola virus siRNA sense strand
uuccaauuuggcuuccucuag

SEQ ID NO: 5836 - RNA, 21 nt, Artificial Sequence
  Ebola virus siRNA sense strand
uccaauuuggcuuccucuagg

SEQ ID NO: 5837 - RNA, 21 nt, Artificial Sequence
  Ebola virus siRNA sense strand
ccaauuuggcuuccucuaggu

SEQ ID NO: 5838 - RNA, 21 nt, Artificial Sequence
  Ebola virus siRNA sense strand
caauuuggcuuccucuaggug

SEQ ID NO: 5839 - RNA, 21 nt, Artificial Sequence
  Ebola virus siRNA sense strand
aauuuggcuuccucuaggugu

SEQ ID NO: 5840 - RNA, 21 nt, Artificial Sequence
  Ebola virus siRNA sense strand
auuuggcuuccucuagguguc

SEQ ID NO: 5841 - RNA, 21 nt, Artificial Sequence
  Ebola virus siRNA sense strand
uuuggcuuccucuaggugucg

SEQ ID NO: 5842 - RNA, 21 nt, Artificial Sequence
  Ebola virus siRNA sense strand
uuggcuuccucuaggugucgc

SEQ ID NO: 5843 - RNA, 21 nt, Artificial Sequence
  Ebola virus siRNA sense strand
uggcuuccucuaggugucgcu

SEQ ID NO: 5844 - RNA, 21 nt, Artificial Sequence
  Ebola virus siRNA sense strand
ggcuuccucuaggugucgcug

SEQ ID NO: 5845 - RNA, 21 nt, Artificial Sequence
  Ebola virus siRNA sense strand
gcuuccucuaggugucgcuga

SEQ ID NO: 5846 - RNA, 21 nt, Artificial Sequence
  Ebola virus siRNA sense strand
cuuccucuaggugucgcugau

SEQ ID NO: 5847 - RNA, 21 nt, Artificial Sequence
  Ebola virus siRNA sense strand
uuccucuaggugucgcugauc

SEQ ID NO: 5848 - RNA, 21 nt, Artificial Sequence
  Ebola virus siRNA sense strand
uccucuaggugucgcugauca

SEQ ID NO: 5849 - RNA, 21 nt, Artificial Sequence
  Ebola virus siRNA sense strand
ccucuaggugucgcugaucaa

SEQ ID NO: 5850 - RNA, 21 nt, Artificial Sequence
  Ebola virus siRNA sense strand
cucuaggugucgcugaucaaa

SEQ ID NO: 5851 - RNA, 21 nt, Artificial Sequence
  Ebola virus siRNA sense strand
ucuaggugucgcugaucaaaa

SEQ ID NO: 5852 - RNA, 21 nt, Artificial Sequence
  Ebola virus siRNA sense strand
cuaggugucgcugaucaaaag

SEQ ID NO: 5853 - RNA, 21 nt, Artificial Sequence
  Ebola virus siRNA sense strand
uaggugucgcugaucaaaaga

SEQ ID NO: 5854 - RNA, 21 nt, Artificial Sequence
  Ebola virus siRNA sense strand
aggugucgcugaucaaaagac

SEQ ID NO: 5855 - RNA, 21 nt, Artificial Sequence
  Ebola virus siRNA sense strand
ggugucgcugaucaaaagacc

SEQ ID NO: 5856 - RNA, 21 nt, Artificial Sequence
  Ebola virus siRNA sense strand
gugucgcugaucaaaagaccu

SEQ ID NO: 5857 - RNA, 21 nt, Artificial Sequence
  Ebola virus siRNA sense strand
ugucgcugaucaaaagaccua

SEQ ID NO: 5858 - RNA, 21 nt, Artificial Sequence
  Ebola virus siRNA sense strand
gucgcugaucaaaagaccuac

SEQ ID NO: 5859 - RNA, 21 nt, Artificial Sequence
  Ebola virus siRNA sense strand
ucgcugaucaaaagaccuaca

SEQ ID NO: 5860 - RNA, 21 nt, Artificial Sequence
  Ebola virus siRNA sense strand
cgcugaucaaaagaccuacag

SEQ ID NO: 5861 - RNA, 21 nt, Artificial Sequence
  Ebola virus siRNA sense strand
gcugaucaaaagaccuacagc

SEQ ID NO: 5862 - RNA, 21 nt, Artificial Sequence
  Ebola virus siRNA sense strand
cugaucaaaagaccuacagcu

SEQ ID NO: 5863 - RNA, 21 nt, Artificial Sequence
  Ebola virus siRNA sense strand
ugaucaaaagaccuacagcuu

SEQ ID NO: 5864 - RNA, 21 nt, Artificial Sequence
  Ebola virus siRNA sense strand
gaucaaaagaccuacagcuuu

SEQ ID NO: 5865 - RNA, 21 nt, Artificial Sequence
  Ebola virus siRNA sense strand
aucaaaagaccuacagcuuug

SEQ ID NO: 5866 - RNA, 21 nt, Artificial Sequence
  Ebola virus siRNA sense strand
ucaaaagaccuacagcuuuga

SEQ ID NO: 5867 - RNA, 21 nt, Artificial Sequence
  Ebola virus siRNA sense strand
caaaagaccuacagcuuugac

SEQ ID NO: 5868 - RNA, 21 nt, Artificial Sequence
  Ebola virus siRNA sense strand
aaaagaccuacagcuuugacu

SEQ ID NO: 5869 - RNA, 21 nt, Artificial Sequence
  Ebola virus siRNA sense strand
aaagaccuacagcuuugacuc

SEQ ID NO: 5870 - RNA, 21 nt, Artificial Sequence
  Ebola virus siRNA sense strand
aagaccuacagcuuugacuca

SEQ ID NO: 5871 - RNA, 21 nt, Artificial Sequence
  Ebola virus siRNA sense strand
agaccuacagcuuugacucaa

SEQ ID NO: 5872 - RNA, 21 nt, Artificial Sequence
  Ebola virus siRNA sense strand
gaccuacagcuuugacucaac

SEQ ID NO: 5873 - RNA, 21 nt, Artificial Sequence
  Ebola virus siRNA sense strand
accuacagcuuugacucaacu

SEQ ID NO: 5874 - RNA, 21 nt, Artificial Sequence
  Ebola virus siRNA sense strand
ccuacagcuuugacucaacua

SEQ ID NO: 5875 - RNA, 21 nt, Artificial Sequence
  Ebola virus siRNA sense strand
cuacagcuuugacucaacuac

SEQ ID NO: 5876 - RNA, 21 nt, Artificial Sequence
  Ebola virus siRNA sense strand
uacagcuuugacucaacuacg

SEQ ID NO: 5877 - RNA, 21 nt, Artificial Sequence
  Ebola virus siRNA sense strand
acagcuuugacucaacuacgg

SEQ ID NO: 5878 - RNA, 21 nt, Artificial Sequence
  Ebola virus siRNA sense strand
cagcuuugacucaacuacggc

SEQ ID NO: 5879 - RNA, 21 nt, Artificial Sequence
  Ebola virus siRNA sense strand
agcuuugacucaacuacggcc

SEQ ID NO: 5880 - RNA, 21 nt, Artificial Sequence
  Ebola virus siRNA sense strand
gcuuugacucaacuacggccg

SEQ ID NO: 5881 - RNA, 21 nt, Artificial Sequence
  Ebola virus siRNA sense strand
cuuugacucaacuacggccgc

SEQ ID NO: 5882 - RNA, 21 nt, Artificial Sequence
  Ebola virus siRNA sense strand
uuugacucaacuacggccgcc

SEQ ID NO: 5883 - RNA, 21 nt, Artificial Sequence
  Ebola virus siRNA sense strand
uugacucaacuacggccgcca

SEQ ID NO: 5884 - RNA, 21 nt, Artificial Sequence
  Ebola virus siRNA sense strand
ugacucaacuacggccgccau

SEQ ID NO: 5885 - RNA, 21 nt, Artificial Sequence
  Ebola virus siRNA sense strand
gacucaacuacggccgccauc

SEQ ID NO: 5886 - RNA, 21 nt, Artificial Sequence
  Ebola virus siRNA sense strand
acucaacuacggccgccauca

SEQ ID NO: 5887 - RNA, 21 nt, Artificial Sequence
  Ebola virus siRNA sense strand
cucaacuacggccgccaucau

SEQ ID NO: 5888 - RNA, 21 nt, Artificial Sequence
  Ebola virus siRNA sense strand
ucaacuacggccgccaucaug

SEQ ID NO: 5889 - RNA, 21 nt, Artificial Sequence
  Ebola virus siRNA sense strand
caacuacggccgccaucaugc

SEQ ID NO: 5890 - RNA, 21 nt, Artificial Sequence
  Ebola virus siRNA sense strand
aacuacggccgccaucaugcu

SEQ ID NO: 5891 - RNA, 21 nt, Artificial Sequence
  Ebola virus siRNA sense strand
acuacggccgccaucaugcuu

SEQ ID NO: 5892 - RNA, 21 nt, Artificial Sequence
  Ebola virus siRNA sense strand
cuacggccgccaucaugcuug

SEQ ID NO: 5893 - RNA, 21 nt, Artificial Sequence
  Ebola virus siRNA sense strand
uacggccgccaucaugcuugc

SEQ ID NO: 5894 - RNA, 21 nt, Artificial Sequence
  Ebola virus siRNA sense strand
acggccgccaucaugcuugcu

SEQ ID NO: 5895 - RNA, 21 nt, Artificial Sequence
  Ebola virus siRNA sense strand
cggccgccaucaugcuugcuu

SEQ ID NO: 5896 - RNA, 21 nt, Artificial Sequence
  Ebola virus siRNA sense strand
ggccgccaucaugcuugcuuc

SEQ ID NO: 5897 - RNA, 21 nt, Artificial Sequence
  Ebola virus siRNA sense strand
gccgccaucaugcuugcuuca

SEQ ID NO: 5898 - RNA, 21 nt, Artificial Sequence
  Ebola virus siRNA sense strand
ccgccaucaugcuugcuucau

SEQ ID NO: 5899 - RNA, 21 nt, Artificial Sequence
  Ebola virus siRNA sense strand
cgccaucaugcuugcuucaua

SEQ ID NO: 5900 - RNA, 21 nt, Artificial Sequence
  Ebola virus siRNA sense strand
gccaucaugcuugcuucauac

SEQ ID NO: 5901 - RNA, 21 nt, Artificial Sequence
  Ebola virus siRNA sense strand
ccaucaugcuugcuucauaca

SEQ ID NO: 5902 - RNA, 21 nt, Artificial Sequence
  Ebola virus siRNA sense strand
caucaugcuugcuucauacac

SEQ ID NO: 5903 - RNA, 21 nt, Artificial Sequence
  Ebola virus siRNA sense strand
aucaugcuugcuucauacacu

SEQ ID NO: 5904 - RNA, 21 nt, Artificial Sequence
  Ebola virus siRNA sense strand
ucaugcuugcuucauacacua

SEQ ID NO: 5905 - RNA, 21 nt, Artificial Sequence
  Ebola virus siRNA sense strand
caugcuugcuucauacacuau

SEQ ID NO: 5906 - RNA, 21 nt, Artificial Sequence
  Ebola virus siRNA sense strand
augcuugcuucauacacuauc

SEQ ID NO: 5907 - RNA, 21 nt, Artificial Sequence
  Ebola virus siRNA sense strand
ugcuugcuucauacacuauca

SEQ ID NO: 5908 - RNA, 21 nt, Artificial Sequence
  Ebola virus siRNA sense strand
gcuugcuucauacacuaucac

SEQ ID NO: 5909 - RNA, 21 nt, Artificial Sequence
  Ebola virus siRNA sense strand
cuugcuucauacacuaucacc

SEQ ID NO: 5910 - RNA, 21 nt, Artificial Sequence
  Ebola virus siRNA sense strand
uugcuucauacacuaucaccc

SEQ ID NO: 5911 - RNA, 21 nt, Artificial Sequence
  Ebola virus siRNA sense strand
ugcuucauacacuaucaccca

SEQ ID NO: 5912 - RNA, 21 nt, Artificial Sequence
  Ebola virus siRNA sense strand
gcuucauacacuaucacccau

SEQ ID NO: 5913 - RNA, 21 nt, Artificial Sequence
  Ebola virus siRNA sense strand
cuucauacacuaucacccauu

SEQ ID NO: 5914 - RNA, 21 nt, Artificial Sequence
  Ebola virus siRNA sense strand
uucauacacuaucacccauuu

SEQ ID NO: 5915 - RNA, 21 nt, Artificial Sequence
  Ebola virus siRNA sense strand
ucauacacuaucacccauuuc

SEQ ID NO: 5916 - RNA, 21 nt, Artificial Sequence
  Ebola virus siRNA sense strand
cauacacuaucacccauuucg

SEQ ID NO: 5917 - RNA, 21 nt, Artificial Sequence
  Ebola virus siRNA sense strand
auacacuaucacccauuucgg

SEQ ID NO: 5918 - RNA, 21 nt, Artificial Sequence
  Ebola virus siRNA sense strand
uacacuaucacccauuucggc

SEQ ID NO: 5919 - RNA, 21 nt, Artificial Sequence
  Ebola virus siRNA sense strand
acacuaucacccauuucggca

SEQ ID NO: 5920 - RNA, 21 nt, Artificial Sequence
  Ebola virus siRNA sense strand
cacuaucacccauuucggcaa

SEQ ID NO: 5921 - RNA, 21 nt, Artificial Sequence
  Ebola virus siRNA sense strand
acuaucacccauuucggcaag

SEQ ID NO: 5922 - RNA, 21 nt, Artificial Sequence
  Ebola virus siRNA sense strand
cuaucacccauuucggcaagg

SEQ ID NO: 5923 - RNA, 21 nt, Artificial Sequence
  Ebola virus siRNA sense strand
uaucacccauuucggcaaggc

SEQ ID NO: 5924 - RNA, 21 nt, Artificial Sequence
  Ebola virus siRNA sense strand
aucacccauuucggcaaggca

SEQ ID NO: 5925 - RNA, 21 nt, Artificial Sequence
  Ebola virus siRNA sense strand
ucacccauuucggcaaggcaa

SEQ ID NO: 5926 - RNA, 21 nt, Artificial Sequence
  Ebola virus siRNA sense strand
cacccauuucggcaaggcaac

SEQ ID NO: 5927 - RNA, 21 nt, Artificial Sequence
  Ebola virus siRNA sense strand
acccauuucggcaaggcaacc

SEQ ID NO: 5928 - RNA, 21 nt, Artificial Sequence
  Ebola virus siRNA sense strand
cccauuucggcaaggcaacca

SEQ ID NO: 5929 - RNA, 21 nt, Artificial Sequence
  Ebola virus siRNA sense strand
ccauuucggcaaggcaaccaa

SEQ ID NO: 5930 - RNA, 21 nt, Artificial Sequence
  Ebola virus siRNA sense strand
cauuucggcaaggcaaccaau

SEQ ID NO: 5931 - RNA, 21 nt, Artificial Sequence
  Ebola virus siRNA sense strand
auuucggcaaggcaaccaauc

SEQ ID NO: 5932 - RNA, 21 nt, Artificial Sequence
  Ebola virus siRNA sense strand
uuucggcaaggcaaccaaucc

SEQ ID NO: 5933 - RNA, 21 nt, Artificial Sequence
  Ebola virus siRNA sense strand
uucggcaaggcaaccaaucca

SEQ ID NO: 5934 - RNA, 21 nt, Artificial Sequence
  Ebola virus siRNA sense strand
ucggcaaggcaaccaauccac

SEQ ID NO: 5935 - RNA, 21 nt, Artificial Sequence
  Ebola virus siRNA sense strand
cggcaaggcaaccaauccacu

SEQ ID NO: 5936 - RNA, 21 nt, Artificial Sequence
  Ebola virus siRNA sense strand
ggcaaggcaaccaauccacuu

SEQ ID NO: 5937 - RNA, 21 nt, Artificial Sequence
  Ebola virus siRNA sense strand
gcaaggcaaccaauccacuug

SEQ ID NO: 5938 - RNA, 21 nt, Artificial Sequence
  Ebola virus siRNA sense strand
caaggcaaccaauccacuugu

SEQ ID NO: 5939 - RNA, 21 nt, Artificial Sequence
  Ebola virus siRNA sense strand
aaggcaaccaauccacuuguc

SEQ ID NO: 5940 - RNA, 21 nt, Artificial Sequence
  Ebola virus siRNA sense strand
aggcaaccaauccacuuguca

SEQ ID NO: 5941 - RNA, 21 nt, Artificial Sequence
  Ebola virus siRNA sense strand
ggcaaccaauccacuugucag

SEQ ID NO: 5942 - RNA, 21 nt, Artificial Sequence
  Ebola virus siRNA sense strand
gcaaccaauccacuugucaga

SEQ ID NO: 5943 - RNA, 21 nt, Artificial Sequence
  Ebola virus siRNA sense strand
caaccaauccacuugucagag

SEQ ID NO: 5944 - RNA, 21 nt, Artificial Sequence
  Ebola virus siRNA sense strand
aaccaauccacuugucagagu

SEQ ID NO: 5945 - RNA, 21 nt, Artificial Sequence
  Ebola virus siRNA sense strand
accaauccacuugucagaguc

SEQ ID NO: 5946 - RNA, 21 nt, Artificial Sequence
  Ebola virus siRNA sense strand
ccaauccacuugucagaguca

SEQ ID NO: 5947 - RNA, 21 nt, Artificial Sequence
  Ebola virus siRNA sense strand
caauccacuugucagagucaa

SEQ ID NO: 5948 - RNA, 21 nt, Artificial Sequence
  Ebola virus siRNA sense strand
aauccacuugucagagucaau

SEQ ID NO: 5949 - RNA, 21 nt, Artificial Sequence
  Ebola virus siRNA sense strand
auccacuugucagagucaauc

SEQ ID NO: 5950 - RNA, 21 nt, Artificial Sequence
  Ebola virus siRNA sense strand
uccacuugucagagucaaucg

SEQ ID NO: 5951 - RNA, 21 nt, Artificial Sequence
  Ebola virus siRNA sense strand
ccacuugucagagucaaucgg

SEQ ID NO: 5952 - RNA, 21 nt, Artificial Sequence
  Ebola virus siRNA sense strand
cacuugucagagucaaucggc

SEQ ID NO: 5953 - RNA, 21 nt, Artificial Sequence
  Ebola virus siRNA sense strand
acuugucagagucaaucggcu

SEQ ID NO: 5954 - RNA, 21 nt, Artificial Sequence
  Ebola virus siRNA sense strand
cuugucagagucaaucggcug

SEQ ID NO: 5955 - RNA, 21 nt, Artificial Sequence
  Ebola virus siRNA sense strand
uugucagagucaaucggcugg

SEQ ID NO: 5956 - RNA, 21 nt, Artificial Sequence
  Ebola virus siRNA sense strand
ugucagagucaaucggcuggg

SEQ ID NO: 5957 - RNA, 21 nt, Artificial Sequence
  Ebola virus siRNA sense strand
gucagagucaaucggcugggu

SEQ ID NO: 5958 - RNA, 21 nt, Artificial Sequence
  Ebola virus siRNA sense strand
ucagagucaaucggcuggguc

SEQ ID NO: 5959 - RNA, 21 nt, Artificial Sequence
  Ebola virus siRNA sense strand
cagagucaaucggcugggucc

SEQ ID NO: 5960 - RNA, 21 nt, Artificial Sequence
  Ebola virus siRNA sense strand
agagucaaucggcuggguccu

SEQ ID NO: 5961 - RNA, 21 nt, Artificial Sequence
  Ebola virus siRNA sense strand
gagucaaucggcuggguccug

SEQ ID NO: 5962 - RNA, 21 nt, Artificial Sequence
  Ebola virus siRNA sense strand
agucaaucggcuggguccugg

SEQ ID NO: 5963 - RNA, 21 nt, Artificial Sequence
  Ebola virus siRNA sense strand
gucaaucggcuggguccugga

SEQ ID NO: 5964 - RNA, 21 nt, Artificial Sequence
  Ebola virus siRNA sense strand
ucaaucggcuggguccuggaa

SEQ ID NO: 5965 - RNA, 21 nt, Artificial Sequence
  Ebola virus siRNA sense strand
caaucggcuggguccuggaau

SEQ ID NO: 5966 - RNA, 21 nt, Artificial Sequence
  Ebola virus siRNA sense strand
aaucggcuggguccuggaauc

SEQ ID NO: 5967 - RNA, 21 nt, Artificial Sequence
  Ebola virus siRNA sense strand
aucggcuggguccuggaaucc

SEQ ID NO: 5968 - RNA, 21 nt, Artificial Sequence
  Ebola virus siRNA sense strand
ucggcuggguccuggaauccc

SEQ ID NO: 5969 - RNA, 21 nt, Artificial Sequence
  Ebola virus siRNA sense strand
cggcuggguccuggaaucccg

SEQ ID NO: 5970 - RNA, 21 nt, Artificial Sequence
  Ebola virus siRNA sense strand
ggcuggguccuggaaucccgg

SEQ ID NO: 5971 - RNA, 21 nt, Artificial Sequence
  Ebola virus siRNA sense strand
gcuggguccuggaaucccgga

SEQ ID NO: 5972 - RNA, 21 nt, Artificial Sequence
  Ebola virus siRNA sense strand
cuggguccuggaaucccggau

SEQ ID NO: 5973 - RNA, 21 nt, Artificial Sequence
  Ebola virus siRNA sense strand
uggguccuggaaucccggauc

SEQ ID NO: 5974 - RNA, 21 nt, Artificial Sequence
  Ebola virus siRNA sense strand
ggguccuggaaucccggauca

SEQ ID NO: 5975 - RNA, 21 nt, Artificial Sequence
  Ebola virus siRNA sense strand
gguccuggaaucccggaucau

SEQ ID NO: 5976 - RNA, 21 nt, Artificial Sequence
  Ebola virus siRNA sense strand
guccuggaaucccggaucauc

SEQ ID NO: 5977 - RNA, 21 nt, Artificial Sequence
  Ebola virus siRNA sense strand
uccuggaaucccggaucaucc

SEQ ID NO: 5978 - RNA, 21 nt, Artificial Sequence
  Ebola virus siRNA sense strand
ccuggaaucccggaucauccc

SEQ ID NO: 5979 - RNA, 21 nt, Artificial Sequence
  Ebola virus siRNA sense strand
cuggaaucccggaucaucccc

SEQ ID NO: 5980 - RNA, 21 nt, Artificial Sequence
  Ebola virus siRNA sense strand
uggaaucccggaucauccccu

SEQ ID NO: 5981 - RNA, 21 nt, Artificial Sequence
  Ebola virus siRNA sense strand
ggaaucccggaucauccccuc

SEQ ID NO: 5982 - RNA, 21 nt, Artificial Sequence
  Ebola virus siRNA sense strand
gaaucccggaucauccccuca

SEQ ID NO: 5983 - RNA, 21 nt, Artificial Sequence
  Ebola virus siRNA sense strand
aaucccggaucauccccucag

SEQ ID NO: 5984 - RNA, 21 nt, Artificial Sequence
  Ebola virus siRNA sense strand
aucccggaucauccccucagg

SEQ ID NO: 5985 - RNA, 21 nt, Artificial Sequence
  Ebola virus siRNA sense strand
ucccggaucauccccucaggc

SEQ ID NO: 5986 - RNA, 21 nt, Artificial Sequence
  Ebola virus siRNA sense strand
cccggaucauccccucaggcu

SEQ ID NO: 5987 - RNA, 21 nt, Artificial Sequence
  Ebola virus siRNA sense strand
ccggaucauccccucaggcuc

SEQ ID NO: 5988 - RNA, 21 nt, Artificial Sequence
  Ebola virus siRNA sense strand
cggaucauccccucaggcucc

SEQ ID NO: 5989 - RNA, 21 nt, Artificial Sequence
  Ebola virus siRNA sense strand
ggaucauccccucaggcuccu

SEQ ID NO: 5990 - RNA, 21 nt, Artificial Sequence
  Ebola virus siRNA sense strand
gaucauccccucaggcuccug

SEQ ID NO: 5991 - RNA, 21 nt, Artificial Sequence
  Ebola virus siRNA sense strand
aucauccccucaggcuccugc

SEQ ID NO: 5992 - RNA, 21 nt, Artificial Sequence
  Ebola virus siRNA sense strand
ucauccccucaggcuccugcg

SEQ ID NO: 5993 - RNA, 21 nt, Artificial Sequence
  Ebola virus siRNA sense strand
cauccccucaggcuccugcga

SEQ ID NO: 5994 - RNA, 21 nt, Artificial Sequence
  Ebola virus siRNA sense strand
auccccucaggcuccugcgaa

SEQ ID NO: 5995 - RNA, 21 nt, Artificial Sequence
  Ebola virus siRNA sense strand
uccccucaggcuccugcgaau

SEQ ID NO: 5996 - RNA, 21 nt, Artificial Sequence
  Ebola virus siRNA sense strand
ccccucaggcuccugcgaauu

SEQ ID NO: 5997 - RNA, 21 nt, Artificial Sequence
  Ebola virus siRNA sense strand
cccucaggcuccugcgaauug

SEQ ID NO: 5998 - RNA, 21 nt, Artificial Sequence
  Ebola virus siRNA sense strand
ccucaggcuccugcgaauugg

SEQ ID NO: 5999 - RNA, 21 nt, Artificial Sequence
  Ebola virus siRNA sense strand
cucaggcuccugcgaauugga

SEQ ID NO: 6000 - RNA, 21 nt, Artificial Sequence
  Ebola virus siRNA sense strand
ucaggcuccugcgaauuggaa

SEQ ID NO: 6001 - RNA, 21 nt, Artificial Sequence
  Ebola virus siRNA sense strand
caggcuccugcgaauuggaaa

SEQ ID NO: 6002 - RNA, 21 nt, Artificial Sequence
  Ebola virus siRNA sense strand
aggcuccugcgaauuggaaac

SEQ ID NO: 6003 - RNA, 21 nt, Artificial Sequence
  Ebola virus siRNA sense strand
ggcuccugcgaauuggaaacc

SEQ ID NO: 6004 - RNA, 21 nt, Artificial Sequence
  Ebola virus siRNA sense strand
gcuccugcgaauuggaaacca

SEQ ID NO: 6005 - RNA, 21 nt, Artificial Sequence
  Ebola virus siRNA sense strand
cuccugcgaauuggaaaccag

SEQ ID NO: 6006 - RNA, 21 nt, Artificial Sequence
  Ebola virus siRNA sense strand
uccugcgaauuggaaaccagg

SEQ ID NO: 6007 - RNA, 21 nt, Artificial Sequence
  Ebola virus siRNA sense strand
ccugcgaauuggaaaccaggc

SEQ ID NO: 6008 - RNA, 21 nt, Artificial Sequence
  Ebola virus siRNA sense strand
cugcgaauuggaaaccaggcu

SEQ ID NO: 6009 - RNA, 21 nt, Artificial Sequence
  Ebola virus siRNA sense strand
ugcgaauuggaaaccaggcuu

SEQ ID NO: 6010 - RNA, 21 nt, Artificial Sequence
  Ebola virus siRNA sense strand
gcgaauuggaaaccaggcuuu

SEQ ID NO: 6011 - RNA, 21 nt, Artificial Sequence
  Ebola virus siRNA sense strand
cgaauuggaaaccaggcuuuc

SEQ ID NO: 6012 - RNA, 21 nt, Artificial Sequence
  Ebola virus siRNA sense strand
gaauuggaaaccaggcuuucc

SEQ ID NO: 6013 - RNA, 21 nt, Artificial Sequence
  Ebola virus siRNA sense strand
aauuggaaaccaggcuuuccu

SEQ ID NO: 6014 - RNA, 21 nt, Artificial Sequence
  Ebola virus siRNA sense strand
auuggaaaccaggcuuuccuc

SEQ ID NO: 6015 - RNA, 21 nt, Artificial Sequence
  Ebola virus siRNA sense strand
uuggaaaccaggcuuuccucc

SEQ ID NO: 6016 - RNA, 21 nt, Artificial Sequence
  Ebola virus siRNA sense strand
uggaaaccaggcuuuccucca

SEQ ID NO: 6017 - RNA, 21 nt, Artificial Sequence
  Ebola virus siRNA sense strand
ggaaaccaggcuuuccuccag

SEQ ID NO: 6018 - RNA, 21 nt, Artificial Sequence
  Ebola virus siRNA sense strand
gaaaccaggcuuuccuccagg

SEQ ID NO: 6019 - RNA, 21 nt, Artificial Sequence
  Ebola virus siRNA sense strand
aaaccaggcuuuccuccagga

SEQ ID NO: 6020 - RNA, 21 nt, Artificial Sequence
  Ebola virus siRNA sense strand
aaccaggcuuuccuccaggag

SEQ ID NO: 6021 - RNA, 21 nt, Artificial Sequence
  Ebola virus siRNA sense strand
accaggcuuuccuccaggagu

SEQ ID NO: 6022 - RNA, 21 nt, Artificial Sequence
  Ebola virus siRNA sense strand
ccaggcuuuccuccaggaguu

SEQ ID NO: 6023 - RNA, 21 nt, Artificial Sequence
  Ebola virus siRNA sense strand
caggcuuuccuccaggaguuc

SEQ ID NO: 6024 - RNA, 21 nt, Artificial Sequence
  Ebola virus siRNA sense strand
aggcuuuccuccaggaguucg

SEQ ID NO: 6025 - RNA, 21 nt, Artificial Sequence
  Ebola virus siRNA sense strand
ggcuuuccuccaggaguucgu

SEQ ID NO: 6026 - RNA, 21 nt, Artificial Sequence
  Ebola virus siRNA sense strand
gcuuuccuccaggaguucguu

SEQ ID NO: 6027 - RNA, 21 nt, Artificial Sequence
  Ebola virus siRNA sense strand
cuuuccuccaggaguucguuc

SEQ ID NO: 6028 - RNA, 21 nt, Artificial Sequence
  Ebola virus siRNA sense strand
uuuccuccaggaguucguucu

SEQ ID NO: 6029 - RNA, 21 nt, Artificial Sequence
  Ebola virus siRNA sense strand
uuccuccaggaguucguucuu

SEQ ID NO: 6030 - RNA, 21 nt, Artificial Sequence
  Ebola virus siRNA sense strand
uccuccaggaguucguucuuc

SEQ ID NO: 6031 - RNA, 21 nt, Artificial Sequence
  Ebola virus siRNA sense strand
ccuccaggaguucguucuucc

SEQ ID NO: 6032 - RNA, 21 nt, Artificial Sequence
  Ebola virus siRNA sense strand
cuccaggaguucguucuuccg

SEQ ID NO: 6033 - RNA, 21 nt, Artificial Sequence
  Ebola virus siRNA sense strand
uccaggaguucguucuuccgc

SEQ ID NO: 6034 - RNA, 21 nt, Artificial Sequence
  Ebola virus siRNA sense strand
ccaggaguucguucuuccgcc

SEQ ID NO: 6035 - RNA, 21 nt, Artificial Sequence
  Ebola virus siRNA sense strand
caggaguucguucuuccgcca

SEQ ID NO: 6036 - RNA, 21 nt, Artificial Sequence
  Ebola virus siRNA sense strand
aggaguucguucuuccgccag

SEQ ID NO: 6037 - RNA, 21 nt, Artificial Sequence
  Ebola virus siRNA sense strand
ggaguucguucuuccgccagu

SEQ ID NO: 6038 - RNA, 21 nt, Artificial Sequence
  Ebola virus siRNA sense strand
gaguucguucuuccgccaguc

SEQ ID NO: 6039 - RNA, 21 nt, Artificial Sequence
  Ebola virus siRNA sense strand
aguucguucuuccgccagucc

SEQ ID NO: 6040 - RNA, 21 nt, Artificial Sequence
  Ebola virus siRNA sense strand
guucguucuuccgccagucca

SEQ ID NO: 6041 - RNA, 21 nt, Artificial Sequence
  Ebola virus siRNA sense strand
uucguucuuccgccaguccaa

SEQ ID NO: 6042 - RNA, 21 nt, Artificial Sequence
  Ebola virus siRNA sense strand
ucguucuuccgccaguccaac

SEQ ID NO: 6043 - RNA, 21 nt, Artificial Sequence
  Ebola virus siRNA sense strand
cguucuuccgccaguccaacu

SEQ ID NO: 6044 - RNA, 21 nt, Artificial Sequence
  Ebola virus siRNA sense strand
guucuuccgccaguccaacua

SEQ ID NO: 6045 - RNA, 21 nt, Artificial Sequence
  Ebola virus siRNA sense strand
uucuuccgccaguccaacuac

SEQ ID NO: 6046 - RNA, 21 nt, Artificial Sequence
  Ebola virus siRNA sense strand
ucuuccgccaguccaacuacc

SEQ ID NO: 6047 - RNA, 21 nt, Artificial Sequence
  Ebola virus siRNA sense strand
cuuccgccaguccaacuaccc

SEQ ID NO: 6048 - RNA, 21 nt, Artificial Sequence
  Ebola virus siRNA sense strand
uuccgccaguccaacuacccc

SEQ ID NO: 6049 - RNA, 21 nt, Artificial Sequence
  Ebola virus siRNA sense strand
uccgccaguccaacuacccca

SEQ ID NO: 6050 - RNA, 21 nt, Artificial Sequence
  Ebola virus siRNA sense strand
ccgccaguccaacuaccccag

SEQ ID NO: 6051 - RNA, 21 nt, Artificial Sequence
  Ebola virus siRNA sense strand
cgccaguccaacuaccccagu

SEQ ID NO: 6052 - RNA, 21 nt, Artificial Sequence
  Ebola virus siRNA sense strand
gccaguccaacuaccccagua

SEQ ID NO: 6053 - RNA, 21 nt, Artificial Sequence
  Ebola virus siRNA sense strand
ccaguccaacuaccccaguau

SEQ ID NO: 6054 - RNA, 21 nt, Artificial Sequence
  Ebola virus siRNA sense strand
caguccaacuaccccaguauu

SEQ ID NO: 6055 - RNA, 21 nt, Artificial Sequence
  Ebola virus siRNA sense strand
aguccaacuaccccaguauuu

SEQ ID NO: 6056 - RNA, 21 nt, Artificial Sequence
  Ebola virus siRNA sense strand
guccaacuaccccaguauuuc

SEQ ID NO: 6057 - RNA, 21 nt, Artificial Sequence
  Ebola virus siRNA sense strand
uccaacuaccccaguauuuca

SEQ ID NO: 6058 - RNA, 21 nt, Artificial Sequence
  Ebola virus siRNA sense strand
ccaacuaccccaguauuucac

SEQ ID NO: 6059 - RNA, 21 nt, Artificial Sequence
  Ebola virus siRNA sense strand
caacuaccccaguauuucacc

SEQ ID NO: 6060 - RNA, 21 nt, Artificial Sequence
  Ebola virus siRNA sense strand
aacuaccccaguauuucaccu

SEQ ID NO: 6061 - RNA, 21 nt, Artificial Sequence
  Ebola virus siRNA sense strand
acuaccccaguauuucaccuu

SEQ ID NO: 6062 - RNA, 21 nt, Artificial Sequence
  Ebola virus siRNA sense strand
cuaccccaguauuucaccuuu

SEQ ID NO: 6063 - RNA, 21 nt, Artificial Sequence
  Ebola virus siRNA sense strand
uaccccaguauuucaccuuug

SEQ ID NO: 6064 - RNA, 21 nt, Artificial Sequence
  Ebola virus siRNA sense strand
accccaguauuucaccuuuga

SEQ ID NO: 6065 - RNA, 21 nt, Artificial Sequence
  Ebola virus siRNA sense strand
ccccaguauuucaccuuugau

SEQ ID NO: 6066 - RNA, 21 nt, Artificial Sequence
  Ebola virus siRNA sense strand
cccaguauuucaccuuugauu

SEQ ID NO: 6067 - RNA, 21 nt, Artificial Sequence
  Ebola virus siRNA sense strand
ccaguauuucaccuuugauuu

SEQ ID NO: 6068 - RNA, 21 nt, Artificial Sequence
  Ebola virus siRNA sense strand
caguauuucaccuuugauuug

SEQ ID NO: 6069 - RNA, 21 nt, Artificial Sequence
  Ebola virus siRNA sense strand
aguauuucaccuuugauuuga

SEQ ID NO: 6070 - RNA, 21 nt, Artificial Sequence
  Ebola virus siRNA sense strand
guauuucaccuuugauuugac

SEQ ID NO: 6071 - RNA, 21 nt, Artificial Sequence
  Ebola virus siRNA sense strand
uauuucaccuuugauuugaca

SEQ ID NO: 6072 - RNA, 21 nt, Artificial Sequence
  Ebola virus siRNA sense strand
auuucaccuuugauuugacag

SEQ ID NO: 6073 - RNA, 21 nt, Artificial Sequence
  Ebola virus siRNA sense strand
uuucaccuuugauuugacagc

SEQ ID NO: 6074 - RNA, 21 nt, Artificial Sequence
  Ebola virus siRNA sense strand
uucaccuuugauuugacagca

SEQ ID NO: 6075 - RNA, 21 nt, Artificial Sequence
  Ebola virus siRNA sense strand
ucaccuuugauuugacagcac

SEQ ID NO: 6076 - RNA, 21 nt, Artificial Sequence
  Ebola virus siRNA sense strand
caccuuugauuugacagcacu

SEQ ID NO: 6077 - RNA, 21 nt, Artificial Sequence
  Ebola virus siRNA sense strand
accuuugauuugacagcacuc

SEQ ID NO: 6078 - RNA, 21 nt, Artificial Sequence
  Ebola virus siRNA sense strand
ccuuugauuugacagcacuca

SEQ ID NO: 6079 - RNA, 21 nt, Artificial Sequence
  Ebola virus siRNA sense strand
cuuugauuugacagcacucaa

SEQ ID NO: 6080 - RNA, 21 nt, Artificial Sequence
  Ebola virus siRNA sense strand
uuugauuugacagcacucaaa

SEQ ID NO: 6081 - RNA, 21 nt, Artificial Sequence
  Ebola virus siRNA sense strand
uugauuugacagcacucaaac

SEQ ID NO: 6082 - RNA, 21 nt, Artificial Sequence
  Ebola virus siRNA sense strand
ugauuugacagcacucaaacu

SEQ ID NO: 6083 - RNA, 21 nt, Artificial Sequence
  Ebola virus siRNA sense strand
gauuugacagcacucaaacug

SEQ ID NO: 6084 - RNA, 21 nt, Artificial Sequence
  Ebola virus siRNA sense strand
auuugacagcacucaaacuga

SEQ ID NO: 6085 - RNA, 21 nt, Artificial Sequence
  Ebola virus siRNA sense strand
uuugacagcacucaaacugau

SEQ ID NO: 6086 - RNA, 21 nt, Artificial Sequence
  Ebola virus siRNA sense strand
uugacagcacucaaacugauc

SEQ ID NO: 6087 - RNA, 21 nt, Artificial Sequence
  Ebola virus siRNA sense strand
ugacagcacucaaacugauca

SEQ ID NO: 6088 - RNA, 21 nt, Artificial Sequence
  Ebola virus siRNA sense strand
gacagcacucaaacugaucac

SEQ ID NO: 6089 - RNA, 21 nt, Artificial Sequence
  Ebola virus siRNA sense strand
acagcacucaaacugaucacc

SEQ ID NO: 6090 - RNA, 21 nt, Artificial Sequence
  Ebola virus siRNA sense strand
cagcacucaaacugaucaccc

SEQ ID NO: 6091 - RNA, 21 nt, Artificial Sequence
  Ebola virus siRNA sense strand
agcacucaaacugaucaccca

SEQ ID NO: 6092 - RNA, 21 nt, Artificial Sequence
  Ebola virus siRNA sense strand
gcacucaaacugaucacccaa

SEQ ID NO: 6093 - RNA, 21 nt, Artificial Sequence
  Ebola virus siRNA sense strand
cacucaaacugaucacccaac

SEQ ID NO: 6094 - RNA, 21 nt, Artificial Sequence
  Ebola virus siRNA sense strand
acucaaacugaucacccaacc

SEQ ID NO: 6095 - RNA, 21 nt, Artificial Sequence
  Ebola virus siRNA sense strand
cucaaacugaucacccaacca

SEQ ID NO: 6096 - RNA, 21 nt, Artificial Sequence
  Ebola virus siRNA sense strand
ucaaacugaucacccaaccac

SEQ ID NO: 6097 - RNA, 21 nt, Artificial Sequence
  Ebola virus siRNA sense strand
caaacugaucacccaaccacu

SEQ ID NO: 6098 - RNA, 21 nt, Artificial Sequence
  Ebola virus siRNA sense strand
aaacugaucacccaaccacug

SEQ ID NO: 6099 - RNA, 21 nt, Artificial Sequence
  Ebola virus siRNA sense strand
aacugaucacccaaccacugc

SEQ ID NO: 6100 - RNA, 21 nt, Artificial Sequence
  Ebola virus siRNA sense strand
acugaucacccaaccacugcc

SEQ ID NO: 6101 - RNA, 21 nt, Artificial Sequence
  Ebola virus siRNA sense strand
cugaucacccaaccacugccu

SEQ ID NO: 6102 - RNA, 21 nt, Artificial Sequence
  Ebola virus siRNA sense strand
ugaucacccaaccacugccug

SEQ ID NO: 6103 - RNA, 21 nt, Artificial Sequence
  Ebola virus siRNA sense strand
gaucacccaaccacugccugc

SEQ ID NO: 6104 - RNA, 21 nt, Artificial Sequence
  Ebola virus siRNA sense strand
aucacccaaccacugccugcu

SEQ ID NO: 6105 - RNA, 21 nt, Artificial Sequence
  Ebola virus siRNA sense strand
ucacccaaccacugccugcug

SEQ ID NO: 6106 - RNA, 21 nt, Artificial Sequence
  Ebola virus siRNA sense strand
cacccaaccacugccugcugc

SEQ ID NO: 6107 - RNA, 21 nt, Artificial Sequence
  Ebola virus siRNA sense strand
acccaaccacugccugcugca

SEQ ID NO: 6108 - RNA, 21 nt, Artificial Sequence
  Ebola virus siRNA sense strand
cccaaccacugccugcugcaa

SEQ ID NO: 6109 - RNA, 21 nt, Artificial Sequence
  Ebola virus siRNA sense strand
ccaaccacugccugcugcaac

SEQ ID NO: 6110 - RNA, 21 nt, Artificial Sequence
  Ebola virus siRNA sense strand
caaccacugccugcugcaaca

SEQ ID NO: 6111 - RNA, 21 nt, Artificial Sequence
  Ebola virus siRNA sense strand
aaccacugccugcugcaacau

SEQ ID NO: 6112 - RNA, 21 nt, Artificial Sequence
  Ebola virus siRNA sense strand
accacugccugcugcaacaug

SEQ ID NO: 6113 - RNA, 21 nt, Artificial Sequence
  Ebola virus siRNA sense strand
ccacugccugcugcaacaugg

SEQ ID NO: 6114 - RNA, 21 nt, Artificial Sequence
  Ebola virus siRNA sense strand
cacugccugcugcaacaugga

SEQ ID NO: 6115 - RNA, 21 nt, Artificial Sequence
  Ebola virus siRNA sense strand
acugccugcugcaacauggac

SEQ ID NO: 6116 - RNA, 21 nt, Artificial Sequence
  Ebola virus siRNA sense strand
cugccugcugcaacauggacc

SEQ ID NO: 6117 - RNA, 21 nt, Artificial Sequence
  Ebola virus siRNA sense strand
ugccugcugcaacauggaccg

SEQ ID NO: 6118 - RNA, 21 nt, Artificial Sequence
  Ebola virus siRNA sense strand
gccugcugcaacauggaccga

SEQ ID NO: 6119 - RNA, 21 nt, Artificial Sequence
  Ebola virus siRNA sense strand
ccugcugcaacauggaccgau

SEQ ID NO: 6120 - RNA, 21 nt, Artificial Sequence
  Ebola virus siRNA sense strand
cugcugcaacauggaccgaug

SEQ ID NO: 6121 - RNA, 21 nt, Artificial Sequence
  Ebola virus siRNA sense strand
ugcugcaacauggaccgauga

SEQ ID NO: 6122 - RNA, 21 nt, Artificial Sequence
  Ebola virus siRNA sense strand
gcugcaacauggaccgaugac

SEQ ID NO: 6123 - RNA, 21 nt, Artificial Sequence
  Ebola virus siRNA sense strand
cugcaacauggaccgaugaca

SEQ ID NO: 6124 - RNA, 21 nt, Artificial Sequence
  Ebola virus siRNA sense strand
ugcaacauggaccgaugacac

SEQ ID NO: 6125 - RNA, 21 nt, Artificial Sequence
  Ebola virus siRNA sense strand
gcaacauggaccgaugacacu

SEQ ID NO: 6126 - RNA, 21 nt, Artificial Sequence
  Ebola virus siRNA sense strand
caacauggaccgaugacacuc

SEQ ID NO: 6127 - RNA, 21 nt, Artificial Sequence
  Ebola virus siRNA sense strand
aacauggaccgaugacacucc

SEQ ID NO: 6128 - RNA, 21 nt, Artificial Sequence
  Ebola virus siRNA sense strand
acauggaccgaugacacucca

SEQ ID NO: 6129 - RNA, 21 nt, Artificial Sequence
  Ebola virus siRNA sense strand
cauggaccgaugacacuccaa

SEQ ID NO: 6130 - RNA, 21 nt, Artificial Sequence
  Ebola virus siRNA sense strand
auggaccgaugacacuccaac

SEQ ID NO: 6131 - RNA, 21 nt, Artificial Sequence
  Ebola virus siRNA sense strand
uggaccgaugacacuccaaca

SEQ ID NO: 6132 - RNA, 21 nt, Artificial Sequence
  Ebola virus siRNA sense strand
ggaccgaugacacuccaacag

SEQ ID NO: 6133 - RNA, 21 nt, Artificial Sequence
  Ebola virus siRNA sense strand
gaccgaugacacuccaacagg

SEQ ID NO: 6134 - RNA, 21 nt, Artificial Sequence
  Ebola virus siRNA sense strand
accgaugacacuccaacagga

SEQ ID NO: 6135 - RNA, 21 nt, Artificial Sequence
  Ebola virus siRNA sense strand
ccgaugacacuccaacaggau

SEQ ID NO: 6136 - RNA, 21 nt, Artificial Sequence
  Ebola virus siRNA sense strand
cgaugacacuccaacaggauc

SEQ ID NO: 6137 - RNA, 21 nt, Artificial Sequence
  Ebola virus siRNA sense strand
gaugacacuccaacaggauca

SEQ ID NO: 6138 - RNA, 21 nt, Artificial Sequence
  Ebola virus siRNA sense strand
augacacuccaacaggaucaa

SEQ ID NO: 6139 - RNA, 21 nt, Artificial Sequence
  Ebola virus siRNA sense strand
ugacacuccaacaggaucaaa

SEQ ID NO: 6140 - RNA, 21 nt, Artificial Sequence
  Ebola virus siRNA sense strand
gacacuccaacaggaucaaau

SEQ ID NO: 6141 - RNA, 21 nt, Artificial Sequence
  Ebola virus siRNA sense strand
acacuccaacaggaucaaaug

SEQ ID NO: 6142 - RNA, 21 nt, Artificial Sequence
  Ebola virus siRNA sense strand
cacuccaacaggaucaaaugg

SEQ ID NO: 6143 - RNA, 21 nt, Artificial Sequence
  Ebola virus siRNA sense strand
acuccaacaggaucaaaugga

SEQ ID NO: 6144 - RNA, 21 nt, Artificial Sequence
  Ebola virus siRNA sense strand
cuccaacaggaucaaauggag

SEQ ID NO: 6145 - RNA, 21 nt, Artificial Sequence
  Ebola virus siRNA sense strand
uccaacaggaucaaauggagc

SEQ ID NO: 6146 - RNA, 21 nt, Artificial Sequence
  Ebola virus siRNA sense strand
ccaacaggaucaaauggagcg

SEQ ID NO: 6147 - RNA, 21 nt, Artificial Sequence
  Ebola virus siRNA sense strand
caacaggaucaaauggagcgu

SEQ ID NO: 6148 - RNA, 21 nt, Artificial Sequence
  Ebola virus siRNA sense strand
aacaggaucaaauggagcguu

SEQ ID NO: 6149 - RNA, 21 nt, Artificial Sequence
  Ebola virus siRNA sense strand
acaggaucaaauggagcguug

SEQ ID NO: 6150 - RNA, 21 nt, Artificial Sequence
  Ebola virus siRNA sense strand
caggaucaaauggagcguugc

SEQ ID NO: 6151 - RNA, 21 nt, Artificial Sequence
  Ebola virus siRNA sense strand
aggaucaaauggagcguugcg

SEQ ID NO: 6152 - RNA, 21 nt, Artificial Sequence
  Ebola virus siRNA sense strand
ggaucaaauggagcguugcgu

SEQ ID NO: 6153 - RNA, 21 nt, Artificial Sequence
  Ebola virus siRNA sense strand
gaucaaauggagcguugcguc

SEQ ID NO: 6154 - RNA, 21 nt, Artificial Sequence
  Ebola virus siRNA sense strand
aucaaauggagcguugcgucc

SEQ ID NO: 6155 - RNA, 21 nt, Artificial Sequence
  Ebola virus siRNA sense strand
ucaaauggagcguugcgucca

SEQ ID NO: 6156 - RNA, 21 nt, Artificial Sequence
  Ebola virus siRNA sense strand
caaauggagcguugcguccag

SEQ ID NO: 6157 - RNA, 21 nt, Artificial Sequence
  Ebola virus siRNA sense strand
aaauggagcguugcguccagg

SEQ ID NO: 6158 - RNA, 21 nt, Artificial Sequence
  Ebola virus siRNA sense strand
aauggagcguugcguccagga

SEQ ID NO: 6159 - RNA, 21 nt, Artificial Sequence
  Ebola virus siRNA sense strand
auggagcguugcguccaggaa

SEQ ID NO: 6160 - RNA, 21 nt, Artificial Sequence
  Ebola virus siRNA sense strand
uggagcguugcguccaggaau

SEQ ID NO: 6161 - RNA, 21 nt, Artificial Sequence
  Ebola virus siRNA sense strand
ggagcguugcguccaggaauu

SEQ ID NO: 6162 - RNA, 21 nt, Artificial Sequence
  Ebola virus siRNA sense strand
gagcguugcguccaggaauuu

SEQ ID NO: 6163 - RNA, 21 nt, Artificial Sequence
  Ebola virus siRNA sense strand
agcguugcguccaggaauuuc

SEQ ID NO: 6164 - RNA, 21 nt, Artificial Sequence
  Ebola virus siRNA sense strand
gcguugcguccaggaauuuca

SEQ ID NO: 6165 - RNA, 21 nt, Artificial Sequence
  Ebola virus siRNA sense strand
cguugcguccaggaauuucau

SEQ ID NO: 6166 - RNA, 21 nt, Artificial Sequence
  Ebola virus siRNA sense strand
guugcguccaggaauuucauu

SEQ ID NO: 6167 - RNA, 21 nt, Artificial Sequence
  Ebola virus siRNA sense strand
uugcguccaggaauuucauuu

SEQ ID NO: 6168 - RNA, 21 nt, Artificial Sequence
  Ebola virus siRNA sense strand
ugcguccaggaauuucauuuc

SEQ ID NO: 6169 - RNA, 21 nt, Artificial Sequence
  Ebola virus siRNA sense strand
gcguccaggaauuucauuuca

SEQ ID NO: 6170 - RNA, 21 nt, Artificial Sequence
  Ebola virus siRNA sense strand
cguccaggaauuucauuucau

SEQ ID NO: 6171 - RNA, 21 nt, Artificial Sequence
  Ebola virus siRNA sense strand
guccaggaauuucauuucauc

SEQ ID NO: 6172 - RNA, 21 nt, Artificial Sequence
  Ebola virus siRNA sense strand
uccaggaauuucauuucaucc

SEQ ID NO: 6173 - RNA, 21 nt, Artificial Sequence
  Ebola virus siRNA sense strand
ccaggaauuucauuucaucca

SEQ ID NO: 6174 - RNA, 21 nt, Artificial Sequence
  Ebola virus siRNA sense strand
caggaauuucauuucauccaa

SEQ ID NO: 6175 - RNA, 21 nt, Artificial Sequence
  Ebola virus siRNA sense strand
aggaauuucauuucauccaaa

SEQ ID NO: 6176 - RNA, 21 nt, Artificial Sequence
  Ebola virus siRNA sense strand
ggaauuucauuucauccaaaa

SEQ ID NO: 6177 - RNA, 21 nt, Artificial Sequence
  Ebola virus siRNA sense strand
gaauuucauuucauccaaaac

SEQ ID NO: 6178 - RNA, 21 nt, Artificial Sequence
  Ebola virus siRNA sense strand
aauuucauuucauccaaaacu

SEQ ID NO: 6179 - RNA, 21 nt, Artificial Sequence
  Ebola virus siRNA sense strand
auuucauuucauccaaaacuu

SEQ ID NO: 6180 - RNA, 21 nt, Artificial Sequence
  Ebola virus siRNA sense strand
uuucauuucauccaaaacuuc

SEQ ID NO: 6181 - RNA, 21 nt, Artificial Sequence
  Ebola virus siRNA sense strand
uucauuucauccaaaacuucg

SEQ ID NO: 6182 - RNA, 21 nt, Artificial Sequence
  Ebola virus siRNA sense strand
ucauuucauccaaaacuucgc

SEQ ID NO: 6183 - RNA, 21 nt, Artificial Sequence
  Ebola virus siRNA sense strand
cauuucauccaaaacuucgcc

SEQ ID NO: 6184 - RNA, 21 nt, Artificial Sequence
  Ebola virus siRNA sense strand
auuucauccaaaacuucgccc

SEQ ID NO: 6185 - RNA, 21 nt, Artificial Sequence
  Ebola virus siRNA sense strand
uuucauccaaaacuucgcccc

SEQ ID NO: 6186 - RNA, 21 nt, Artificial Sequence
  Ebola virus siRNA sense strand
uucauccaaaacuucgcccca

SEQ ID NO: 6187 - RNA, 21 nt, Artificial Sequence
  Ebola virus siRNA sense strand
ucauccaaaacuucgccccau

SEQ ID NO: 6188 - RNA, 21 nt, Artificial Sequence
  Ebola virus siRNA sense strand
cauccaaaacuucgccccauu

SEQ ID NO: 6189 - RNA, 21 nt, Artificial Sequence
  Ebola virus siRNA sense strand
auccaaaacuucgccccauuc

SEQ ID NO: 6190 - RNA, 21 nt, Artificial Sequence
  Ebola virus siRNA sense strand
uccaaaacuucgccccauucu

SEQ ID NO: 6191 - RNA, 21 nt, Artificial Sequence
  Ebola virus siRNA sense strand
ccaaaacuucgccccauucuu

SEQ ID NO: 6192 - RNA, 21 nt, Artificial Sequence
  Ebola virus siRNA sense strand
caaaacuucgccccauucuuu

SEQ ID NO: 6193 - RNA, 21 nt, Artificial Sequence
  Ebola virus siRNA sense strand
aaaacuucgccccauucuuuu

SEQ ID NO: 6194 - RNA, 21 nt, Artificial Sequence
  Ebola virus siRNA sense strand
aaacuucgccccauucuuuua

SEQ ID NO: 6195 - RNA, 21 nt, Artificial Sequence
  Ebola virus siRNA sense strand
aacuucgccccauucuuuuac

SEQ ID NO: 6196 - RNA, 21 nt, Artificial Sequence
  Ebola virus siRNA sense strand
acuucgccccauucuuuuacc

SEQ ID NO: 6197 - RNA, 21 nt, Artificial Sequence
  Ebola virus siRNA sense strand
cuucgccccauucuuuuaccc

SEQ ID NO: 6198 - RNA, 21 nt, Artificial Sequence
  Ebola virus siRNA sense strand
uucgccccauucuuuuaccca

SEQ ID NO: 6199 - RNA, 21 nt, Artificial Sequence
  Ebola virus siRNA sense strand
ucgccccauucuuuuacccaa

SEQ ID NO: 6200 - RNA, 21 nt, Artificial Sequence
  Ebola virus siRNA sense strand
cgccccauucuuuuacccaac

SEQ ID NO: 6201 - RNA, 21 nt, Artificial Sequence
  Ebola virus siRNA sense strand
gccccauucuuuuacccaaca

SEQ ID NO: 6202 - RNA, 21 nt, Artificial Sequence
  Ebola virus siRNA sense strand
ccccauucuuuuacccaacaa

SEQ ID NO: 6203 - RNA, 21 nt, Artificial Sequence
  Ebola virus siRNA sense strand
cccauucuuuuacccaacaaa

SEQ ID NO: 6204 - RNA, 21 nt, Artificial Sequence
  Ebola virus siRNA sense strand
ccauucuuuuacccaacaaaa

SEQ ID NO: 6205 - RNA, 21 nt, Artificial Sequence
  Ebola virus siRNA sense strand
cauucuuuuacccaacaaaag

SEQ ID NO: 6206 - RNA, 21 nt, Artificial Sequence
  Ebola virus siRNA sense strand
auucuuuuacccaacaaaagu

SEQ ID NO: 6207 - RNA, 21 nt, Artificial Sequence
  Ebola virus siRNA sense strand
uucuuuuacccaacaaaagug

SEQ ID NO: 6208 - RNA, 21 nt, Artificial Sequence
  Ebola virus siRNA sense strand
ucuuuuacccaacaaaagugg

SEQ ID NO: 6209 - RNA, 21 nt, Artificial Sequence
  Ebola virus siRNA sense strand
cuuuuacccaacaaaaguggg

SEQ ID NO: 6210 - RNA, 21 nt, Artificial Sequence
  Ebola virus siRNA sense strand
uuuuacccaacaaaaguggga

SEQ ID NO: 6211 - RNA, 21 nt, Artificial Sequence
  Ebola virus siRNA sense strand
uuuacccaacaaaagugggaa

SEQ ID NO: 6212 - RNA, 21 nt, Artificial Sequence
  Ebola virus siRNA sense strand
uuacccaacaaaagugggaag

SEQ ID NO: 6213 - RNA, 21 nt, Artificial Sequence
  Ebola virus siRNA sense strand
uacccaacaaaagugggaaga

SEQ ID NO: 6214 - RNA, 21 nt, Artificial Sequence
  Ebola virus siRNA sense strand
acccaacaaaagugggaagaa

SEQ ID NO: 6215 - RNA, 21 nt, Artificial Sequence
  Ebola virus siRNA sense strand
cccaacaaaagugggaagaag

SEQ ID NO: 6216 - RNA, 21 nt, Artificial Sequence
  Ebola virus siRNA sense strand
ccaacaaaagugggaagaagg

SEQ ID NO: 6217 - RNA, 21 nt, Artificial Sequence
  Ebola virus siRNA sense strand
caacaaaagugggaagaaggg

SEQ ID NO: 6218 - RNA, 21 nt, Artificial Sequence
  Ebola virus siRNA sense strand
aacaaaagugggaagaagggg

SEQ ID NO: 6219 - RNA, 21 nt, Artificial Sequence
  Ebola virus siRNA sense strand
acaaaagugggaagaagggga

SEQ ID NO: 6220 - RNA, 21 nt, Artificial Sequence
  Ebola virus siRNA sense strand
caaaagugggaagaaggggaa

SEQ ID NO: 6221 - RNA, 21 nt, Artificial Sequence
  Ebola virus siRNA sense strand
aaaagugggaagaaggggaac

SEQ ID NO: 6222 - RNA, 21 nt, Artificial Sequence
  Ebola virus siRNA sense strand
aaagugggaagaaggggaaca

SEQ ID NO: 6223 - RNA, 21 nt, Artificial Sequence
  Ebola virus siRNA sense strand
aagugggaagaaggggaacag

SEQ ID NO: 6224 - RNA, 21 nt, Artificial Sequence
  Ebola virus siRNA sense strand
agugggaagaaggggaacagu

SEQ ID NO: 6225 - RNA, 21 nt, Artificial Sequence
  Ebola virus siRNA sense strand
gugggaagaaggggaacagug

SEQ ID NO: 6226 - RNA, 21 nt, Artificial Sequence
  Ebola virus siRNA sense strand
ugggaagaaggggaacagugc

SEQ ID NO: 6227 - RNA, 21 nt, Artificial Sequence
  Ebola virus siRNA sense strand
gggaagaaggggaacagugcc

SEQ ID NO: 6228 - RNA, 21 nt, Artificial Sequence
  Ebola virus siRNA sense strand
ggaagaaggggaacagugccg

SEQ ID NO: 6229 - RNA, 21 nt, Artificial Sequence
  Ebola virus siRNA sense strand
gaagaaggggaacagugccga

SEQ ID NO: 6230 - RNA, 21 nt, Artificial Sequence
  Ebola virus siRNA sense strand
aagaaggggaacagugccgau

SEQ ID NO: 6231 - RNA, 21 nt, Artificial Sequence
  Ebola virus siRNA sense strand
agaaggggaacagugccgauc

SEQ ID NO: 6232 - RNA, 21 nt, Artificial Sequence
  Ebola virus siRNA sense strand
gaaggggaacagugccgaucu

SEQ ID NO: 6233 - RNA, 21 nt, Artificial Sequence
  Ebola virus siRNA sense strand
aaggggaacagugccgaucua

SEQ ID NO: 6234 - RNA, 21 nt, Artificial Sequence
  Ebola virus siRNA sense strand
aggggaacagugccgaucuaa

SEQ ID NO: 6235 - RNA, 21 nt, Artificial Sequence
  Ebola virus siRNA sense strand
ggggaacagugccgaucuaac

SEQ ID NO: 6236 - RNA, 21 nt, Artificial Sequence
  Ebola virus siRNA sense strand
gggaacagugccgaucuaaca

SEQ ID NO: 6237 - RNA, 21 nt, Artificial Sequence
  Ebola virus siRNA sense strand
ggaacagugccgaucuaacau

SEQ ID NO: 6238 - RNA, 21 nt, Artificial Sequence
  Ebola virus siRNA sense strand
gaacagugccgaucuaacauc

SEQ ID NO: 6239 - RNA, 21 nt, Artificial Sequence
  Ebola virus siRNA sense strand
aacagugccgaucuaacaucu

SEQ ID NO: 6240 - RNA, 21 nt, Artificial Sequence
  Ebola virus siRNA sense strand
acagugccgaucuaacaucuc

SEQ ID NO: 6241 - RNA, 21 nt, Artificial Sequence
  Ebola virus siRNA sense strand
cagugccgaucuaacaucucc

SEQ ID NO: 6242 - RNA, 21 nt, Artificial Sequence
  Ebola virus siRNA sense strand
agugccgaucuaacaucuccg

SEQ ID NO: 6243 - RNA, 21 nt, Artificial Sequence
  Ebola virus siRNA sense strand
gugccgaucuaacaucuccgg

SEQ ID NO: 6244 - RNA, 21 nt, Artificial Sequence
  Ebola virus siRNA sense strand
ugccgaucuaacaucuccgga

SEQ ID NO: 6245 - RNA, 21 nt, Artificial Sequence
  Ebola virus siRNA sense strand
gccgaucuaacaucuccggag

SEQ ID NO: 6246 - RNA, 21 nt, Artificial Sequence
  Ebola virus siRNA sense strand
ccgaucuaacaucuccggaga

SEQ ID NO: 6247 - RNA, 21 nt, Artificial Sequence
  Ebola virus siRNA sense strand
cgaucuaacaucuccggagaa

SEQ ID NO: 6248 - RNA, 21 nt, Artificial Sequence
  Ebola virus siRNA sense strand
gaucuaacaucuccggagaaa

SEQ ID NO: 6249 - RNA, 21 nt, Artificial Sequence
  Ebola virus siRNA sense strand
aucuaacaucuccggagaaaa

SEQ ID NO: 6250 - RNA, 21 nt, Artificial Sequence
  Ebola virus siRNA sense strand
ucuaacaucuccggagaaaau

SEQ ID NO: 6251 - RNA, 21 nt, Artificial Sequence
  Ebola virus siRNA sense strand
cuaacaucuccggagaaaauc

SEQ ID NO: 6252 - RNA, 21 nt, Artificial Sequence
  Ebola virus siRNA sense strand
uaacaucuccggagaaaaucc

SEQ ID NO: 6253 - RNA, 21 nt, Artificial Sequence
  Ebola virus siRNA sense strand
aacaucuccggagaaaaucca

SEQ ID NO: 6254 - RNA, 21 nt, Artificial Sequence
  Ebola virus siRNA sense strand
acaucuccggagaaaauccaa

SEQ ID NO: 6255 - RNA, 21 nt, Artificial Sequence
  Ebola virus siRNA sense strand
caucuccggagaaaauccaag

SEQ ID NO: 6256 - RNA, 21 nt, Artificial Sequence
  Ebola virus siRNA sense strand
aucuccggagaaaauccaagc

SEQ ID NO: 6257 - RNA, 21 nt, Artificial Sequence
  Ebola virus siRNA sense strand
ucuccggagaaaauccaagca

SEQ ID NO: 6258 - RNA, 21 nt, Artificial Sequence
  Ebola virus siRNA sense strand
cuccggagaaaauccaagcaa

SEQ ID NO: 6259 - RNA, 21 nt, Artificial Sequence
  Ebola virus siRNA sense strand
uccggagaaaauccaagcaau

SEQ ID NO: 6260 - RNA, 21 nt, Artificial Sequence
  Ebola virus siRNA sense strand
ccggagaaaauccaagcaaua

SEQ ID NO: 6261 - RNA, 21 nt, Artificial Sequence
  Ebola virus siRNA sense strand
cggagaaaauccaagcaauaa

SEQ ID NO: 6262 - RNA, 21 nt, Artificial Sequence
  Ebola virus siRNA sense strand
ggagaaaauccaagcaauaau

SEQ ID NO: 6263 - RNA, 21 nt, Artificial Sequence
  Ebola virus siRNA sense strand
gagaaaauccaagcaauaaug

SEQ ID NO: 6264 - RNA, 21 nt, Artificial Sequence
  Ebola virus siRNA sense strand
agaaaauccaagcaauaauga

SEQ ID NO: 6265 - RNA, 21 nt, Artificial Sequence
  Ebola virus siRNA sense strand
gaaaauccaagcaauaaugac

SEQ ID NO: 6266 - RNA, 21 nt, Artificial Sequence
  Ebola virus siRNA sense strand
aaaauccaagcaauaaugacu

SEQ ID NO: 6267 - RNA, 21 nt, Artificial Sequence
  Ebola virus siRNA sense strand
aaauccaagcaauaaugacuu

SEQ ID NO: 6268 - RNA, 21 nt, Artificial Sequence
  Ebola virus siRNA sense strand
aauccaagcaauaaugacuuc

SEQ ID NO: 6269 - RNA, 21 nt, Artificial Sequence
  Ebola virus siRNA sense strand
auccaagcaauaaugacuuca

SEQ ID NO: 6270 - RNA, 21 nt, Artificial Sequence
  Ebola virus siRNA sense strand
uccaagcaauaaugacuucac

SEQ ID NO: 6271 - RNA, 21 nt, Artificial Sequence
  Ebola virus siRNA sense strand
ccaagcaauaaugacuucacu

SEQ ID NO: 6272 - RNA, 21 nt, Artificial Sequence
  Ebola virus siRNA sense strand
caagcaauaaugacuucacuc

SEQ ID NO: 6273 - RNA, 21 nt, Artificial Sequence
  Ebola virus siRNA sense strand
aagcaauaaugacuucacucc

SEQ ID NO: 6274 - RNA, 21 nt, Artificial Sequence
  Ebola virus siRNA sense strand
agcaauaaugacuucacucca

SEQ ID NO: 6275 - RNA, 21 nt, Artificial Sequence
  Ebola virus siRNA sense strand
gcaauaaugacuucacuccag

SEQ ID NO: 6276 - RNA, 21 nt, Artificial Sequence
  Ebola virus siRNA sense strand
caauaaugacuucacuccagg

SEQ ID NO: 6277 - RNA, 21 nt, Artificial Sequence
  Ebola virus siRNA sense strand
aauaaugacuucacuccagga

SEQ ID NO: 6278 - RNA, 21 nt, Artificial Sequence
  Ebola virus siRNA sense strand
auaaugacuucacuccaggac

SEQ ID NO: 6279 - RNA, 21 nt, Artificial Sequence
  Ebola virus siRNA sense strand
uaaugacuucacuccaggacu

SEQ ID NO: 6280 - RNA, 21 nt, Artificial Sequence
  Ebola virus siRNA sense strand
aaugacuucacuccaggacuu

SEQ ID NO: 6281 - RNA, 21 nt, Artificial Sequence
  Ebola virus siRNA sense strand
augacuucacuccaggacuuu

SEQ ID NO: 6282 - RNA, 21 nt, Artificial Sequence
  Ebola virus siRNA sense strand
ugacuucacuccaggacuuua

SEQ ID NO: 6283 - RNA, 21 nt, Artificial Sequence
  Ebola virus siRNA sense strand
gacuucacuccaggacuuuaa

SEQ ID NO: 6284 - RNA, 21 nt, Artificial Sequence
  Ebola virus siRNA sense strand
acuucacuccaggacuuuaag

SEQ ID NO: 6285 - RNA, 21 nt, Artificial Sequence
  Ebola virus siRNA sense strand
cuucacuccaggacuuuaaga

SEQ ID NO: 6286 - RNA, 21 nt, Artificial Sequence
  Ebola virus siRNA sense strand
uucacuccaggacuuuaagau

SEQ ID NO: 6287 - RNA, 21 nt, Artificial Sequence
  Ebola virus siRNA sense strand
ucacuccaggacuuuaagauc

SEQ ID NO: 6288 - RNA, 21 nt, Artificial Sequence
  Ebola virus siRNA sense strand
cacuccaggacuuuaagaucg

SEQ ID NO: 6289 - RNA, 21 nt, Artificial Sequence
  Ebola virus siRNA sense strand
acuccaggacuuuaagaucgu

SEQ ID NO: 6290 - RNA, 21 nt, Artificial Sequence
  Ebola virus siRNA sense strand
cuccaggacuuuaagaucguu

SEQ ID NO: 6291 - RNA, 21 nt, Artificial Sequence
  Ebola virus siRNA sense strand
uccaggacuuuaagaucguuc

SEQ ID NO: 6292 - RNA, 21 nt, Artificial Sequence
  Ebola virus siRNA sense strand
ccaggacuuuaagaucguucc

SEQ ID NO: 6293 - RNA, 21 nt, Artificial Sequence
  Ebola virus siRNA sense strand
caggacuuuaagaucguucca

SEQ ID NO: 6294 - RNA, 21 nt, Artificial Sequence
  Ebola virus siRNA sense strand
aggacuuuaagaucguuccaa

SEQ ID NO: 6295 - RNA, 21 nt, Artificial Sequence
  Ebola virus siRNA sense strand
ggacuuuaagaucguuccaau

SEQ ID NO: 6296 - RNA, 21 nt, Artificial Sequence
  Ebola virus siRNA sense strand
gacuuuaagaucguuccaauu

SEQ ID NO: 6297 - RNA, 21 nt, Artificial Sequence
  Ebola virus siRNA sense strand
acuuuaagaucguuccaauug

SEQ ID NO: 6298 - RNA, 21 nt, Artificial Sequence
  Ebola virus siRNA sense strand
cuuuaagaucguuccaauuga

SEQ ID NO: 6299 - RNA, 21 nt, Artificial Sequence
  Ebola virus siRNA sense strand
uuuaagaucguuccaauugau

SEQ ID NO: 6300 - RNA, 21 nt, Artificial Sequence
  Ebola virus siRNA sense strand
uuaagaucguuccaauugauc

SEQ ID NO: 6301 - RNA, 21 nt, Artificial Sequence
  Ebola virus siRNA sense strand
uaagaucguuccaauugaucc

SEQ ID NO: 6302 - RNA, 21 nt, Artificial Sequence
  Ebola virus siRNA sense strand
aagaucguuccaauugaucca

SEQ ID NO: 6303 - RNA, 21 nt, Artificial Sequence
  Ebola virus siRNA sense strand
agaucguuccaauugauccaa

SEQ ID NO: 6304 - RNA, 21 nt, Artificial Sequence
  Ebola virus siRNA sense strand
gaucguuccaauugauccaac

SEQ ID NO: 6305 - RNA, 21 nt, Artificial Sequence
  Ebola virus siRNA sense strand
aucguuccaauugauccaacc

SEQ ID NO: 6306 - RNA, 21 nt, Artificial Sequence
  Ebola virus siRNA sense strand
ucguuccaauugauccaacca

SEQ ID NO: 6307 - RNA, 21 nt, Artificial Sequence
  Ebola virus siRNA sense strand
cguuccaauugauccaaccaa

SEQ ID NO: 6308 - RNA, 21 nt, Artificial Sequence
  Ebola virus siRNA sense strand
guuccaauugauccaaccaaa

SEQ ID NO: 6309 - RNA, 21 nt, Artificial Sequence
  Ebola virus siRNA sense strand
uuccaauugauccaaccaaaa

SEQ ID NO: 6310 - RNA, 21 nt, Artificial Sequence
  Ebola virus siRNA sense strand
uccaauugauccaaccaaaaa

SEQ ID NO: 6311 - RNA, 21 nt, Artificial Sequence
  Ebola virus siRNA sense strand
ccaauugauccaaccaaaaau

SEQ ID NO: 6312 - RNA, 21 nt, Artificial Sequence
  Ebola virus siRNA sense strand
caauugauccaaccaaaaaua

SEQ ID NO: 6313 - RNA, 21 nt, Artificial Sequence
  Ebola virus siRNA sense strand
aauugauccaaccaaaaauau

SEQ ID NO: 6314 - RNA, 21 nt, Artificial Sequence
  Ebola virus siRNA sense strand
auugauccaaccaaaaauauc

SEQ ID NO: 6315 - RNA, 21 nt, Artificial Sequence
  Ebola virus siRNA sense strand
uugauccaaccaaaaauauca

SEQ ID NO: 6316 - RNA, 21 nt, Artificial Sequence
  Ebola virus siRNA sense strand
ugauccaaccaaaaauaucau

SEQ ID NO: 6317 - RNA, 21 nt, Artificial Sequence
  Ebola virus siRNA sense strand
gauccaaccaaaaauaucaug

SEQ ID NO: 6318 - RNA, 21 nt, Artificial Sequence
  Ebola virus siRNA sense strand
auccaaccaaaaauaucaugg

SEQ ID NO: 6319 - RNA, 21 nt, Artificial Sequence
  Ebola virus siRNA sense strand
uccaaccaaaaauaucauggg

SEQ ID NO: 6320 - RNA, 21 nt, Artificial Sequence
  Ebola virus siRNA sense strand
ccaaccaaaaauaucauggga

SEQ ID NO: 6321 - RNA, 21 nt, Artificial Sequence
  Ebola virus siRNA sense strand
caaccaaaaauaucaugggaa

SEQ ID NO: 6322 - RNA, 21 nt, Artificial Sequence
  Ebola virus siRNA sense strand
aaccaaaaauaucaugggaau

SEQ ID NO: 6323 - RNA, 21 nt, Artificial Sequence
  Ebola virus siRNA sense strand
accaaaaauaucaugggaauc

SEQ ID NO: 6324 - RNA, 21 nt, Artificial Sequence
  Ebola virus siRNA sense strand
ccaaaaauaucaugggaaucg

SEQ ID NO: 6325 - RNA, 21 nt, Artificial Sequence
  Ebola virus siRNA sense strand
caaaaauaucaugggaaucga

SEQ ID NO: 6326 - RNA, 21 nt, Artificial Sequence
  Ebola virus siRNA sense strand
aaaaauaucaugggaaucgaa

SEQ ID NO: 6327 - RNA, 21 nt, Artificial Sequence
  Ebola virus siRNA sense strand
aaaauaucaugggaaucgaag

SEQ ID NO: 6328 - RNA, 21 nt, Artificial Sequence
  Ebola virus siRNA sense strand
aaauaucaugggaaucgaagu

SEQ ID NO: 6329 - RNA, 21 nt, Artificial Sequence
  Ebola virus siRNA sense strand
aauaucaugggaaucgaagug

SEQ ID NO: 6330 - RNA, 21 nt, Artificial Sequence
  Ebola virus siRNA sense strand
auaucaugggaaucgaagugc

SEQ ID NO: 6331 - RNA, 21 nt, Artificial Sequence
  Ebola virus siRNA sense strand
uaucaugggaaucgaagugcc

SEQ ID NO: 6332 - RNA, 21 nt, Artificial Sequence
  Ebola virus siRNA sense strand
aucaugggaaucgaagugcca

SEQ ID NO: 6333 - RNA, 21 nt, Artificial Sequence
  Ebola virus siRNA sense strand
ucaugggaaucgaagugccag

SEQ ID NO: 6334 - RNA, 21 nt, Artificial Sequence
  Ebola virus siRNA sense strand
caugggaaucgaagugccaga

SEQ ID NO: 6335 - RNA, 21 nt, Artificial Sequence
  Ebola virus siRNA sense strand
augggaaucgaagugccagaa

SEQ ID NO: 6336 - RNA, 21 nt, Artificial Sequence
  Ebola virus siRNA sense strand
ugggaaucgaagugccagaaa

SEQ ID NO: 6337 - RNA, 21 nt, Artificial Sequence
  Ebola virus siRNA sense strand
gggaaucgaagugccagaaac

SEQ ID NO: 6338 - RNA, 21 nt, Artificial Sequence
  Ebola virus siRNA sense strand
ggaaucgaagugccagaaacu

SEQ ID NO: 6339 - RNA, 21 nt, Artificial Sequence
  Ebola virus siRNA sense strand
gaaucgaagugccagaaacuc

SEQ ID NO: 6340 - RNA, 21 nt, Artificial Sequence
  Ebola virus siRNA sense strand
aaucgaagugccagaaacucu

SEQ ID NO: 6341 - RNA, 21 nt, Artificial Sequence
  Ebola virus siRNA sense strand
aucgaagugccagaaacucug

SEQ ID NO: 6342 - RNA, 21 nt, Artificial Sequence
  Ebola virus siRNA sense strand
ucgaagugccagaaacucugg

SEQ ID NO: 6343 - RNA, 21 nt, Artificial Sequence
  Ebola virus siRNA sense strand
cgaagugccagaaacucuggu

SEQ ID NO: 6344 - RNA, 21 nt, Artificial Sequence
  Ebola virus siRNA sense strand
gaagugccagaaacucugguc

SEQ ID NO: 6345 - RNA, 21 nt, Artificial Sequence
  Ebola virus siRNA sense strand
aagugccagaaacucuggucc

SEQ ID NO: 6346 - RNA, 21 nt, Artificial Sequence
  Ebola virus siRNA sense strand
agugccagaaacucuggucca

SEQ ID NO: 6347 - RNA, 21 nt, Artificial Sequence
  Ebola virus siRNA sense strand
gugccagaaacucugguccac

SEQ ID NO: 6348 - RNA, 21 nt, Artificial Sequence
  Ebola virus siRNA sense strand
ugccagaaacucugguccaca

SEQ ID NO: 6349 - RNA, 21 nt, Artificial Sequence
  Ebola virus siRNA sense strand
gccagaaacucugguccacaa

SEQ ID NO: 6350 - RNA, 21 nt, Artificial Sequence
  Ebola virus siRNA sense strand
ccagaaacucugguccacaag

SEQ ID NO: 6351 - RNA, 21 nt, Artificial Sequence
  Ebola virus siRNA sense strand
cagaaacucugguccacaagc

SEQ ID NO: 6352 - RNA, 21 nt, Artificial Sequence
  Ebola virus siRNA sense strand
agaaacucugguccacaagcu

SEQ ID NO: 6353 - RNA, 21 nt, Artificial Sequence
  Ebola virus siRNA sense strand
gaaacucugguccacaagcug

SEQ ID NO: 6354 - RNA, 21 nt, Artificial Sequence
  Ebola virus siRNA sense strand
aaacucugguccacaagcuga

SEQ ID NO: 6355 - RNA, 21 nt, Artificial Sequence
  Ebola virus siRNA sense strand
aacucugguccacaagcugac

SEQ ID NO: 6356 - RNA, 21 nt, Artificial Sequence
  Ebola virus siRNA sense strand
acucugguccacaagcugacc

SEQ ID NO: 6357 - RNA, 21 nt, Artificial Sequence
  Ebola virus siRNA sense strand
cucugguccacaagcugaccg

SEQ ID NO: 6358 - RNA, 21 nt, Artificial Sequence
  Ebola virus siRNA sense strand
ucugguccacaagcugaccgg

SEQ ID NO: 6359 - RNA, 21 nt, Artificial Sequence
  Ebola virus siRNA sense strand
cugguccacaagcugaccggu

SEQ ID NO: 6360 - RNA, 21 nt, Artificial Sequence
  Ebola virus siRNA sense strand
ugguccacaagcugaccggua

SEQ ID NO: 6361 - RNA, 21 nt, Artificial Sequence
  Ebola virus siRNA sense strand
gguccacaagcugaccgguaa

SEQ ID NO: 6362 - RNA, 21 nt, Artificial Sequence
  Ebola virus siRNA sense strand
guccacaagcugaccgguaag

SEQ ID NO: 6363 - RNA, 21 nt, Artificial Sequence
  Ebola virus siRNA sense strand
uccacaagcugaccgguaaga

SEQ ID NO: 6364 - RNA, 21 nt, Artificial Sequence
  Ebola virus siRNA sense strand
ccacaagcugaccgguaagaa

SEQ ID NO: 6365 - RNA, 21 nt, Artificial Sequence
  Ebola virus siRNA sense strand
cacaagcugaccgguaagaag

SEQ ID NO: 6366 - RNA, 21 nt, Artificial Sequence
  Ebola virus siRNA sense strand
acaagcugaccgguaagaagg

SEQ ID NO: 6367 - RNA, 21 nt, Artificial Sequence
  Ebola virus siRNA sense strand
caagcugaccgguaagaaggu

SEQ ID NO: 6368 - RNA, 21 nt, Artificial Sequence
  Ebola virus siRNA sense strand
aagcugaccgguaagaaggug

SEQ ID NO: 6369 - RNA, 21 nt, Artificial Sequence
  Ebola virus siRNA sense strand
agcugaccgguaagaagguga

SEQ ID NO: 6370 - RNA, 21 nt, Artificial Sequence
  Ebola virus siRNA sense strand
gcugaccgguaagaaggugac

SEQ ID NO: 6371 - RNA, 21 nt, Artificial Sequence
  Ebola virus siRNA sense strand
cugaccgguaagaaggugacu

SEQ ID NO: 6372 - RNA, 21 nt, Artificial Sequence
  Ebola virus siRNA sense strand
ugaccgguaagaaggugacuu

SEQ ID NO: 6373 - RNA, 21 nt, Artificial Sequence
  Ebola virus siRNA sense strand
gaccgguaagaaggugacuuc

SEQ ID NO: 6374 - RNA, 21 nt, Artificial Sequence
  Ebola virus siRNA sense strand
accgguaagaaggugacuucu

SEQ ID NO: 6375 - RNA, 21 nt, Artificial Sequence
  Ebola virus siRNA sense strand
ccgguaagaaggugacuucua

SEQ ID NO: 6376 - RNA, 21 nt, Artificial Sequence
  Ebola virus siRNA sense strand
cgguaagaaggugacuucuaa

SEQ ID NO: 6377 - RNA, 21 nt, Artificial Sequence
  Ebola virus siRNA sense strand
gguaagaaggugacuucuaaa

SEQ ID NO: 6378 - RNA, 21 nt, Artificial Sequence
  Ebola virus siRNA sense strand
guaagaaggugacuucuaaaa

SEQ ID NO: 6379 - RNA, 21 nt, Artificial Sequence
  Ebola virus siRNA sense strand
uaagaaggugacuucuaaaaa

SEQ ID NO: 6380 - RNA, 21 nt, Artificial Sequence
  Ebola virus siRNA sense strand
aagaaggugacuucuaaaaau

SEQ ID NO: 6381 - RNA, 21 nt, Artificial Sequence
  Ebola virus siRNA sense strand
agaaggugacuucuaaaaaug

SEQ ID NO: 6382 - RNA, 21 nt, Artificial Sequence
  Ebola virus siRNA sense strand
gaaggugacuucuaaaaaugg

SEQ ID NO: 6383 - RNA, 21 nt, Artificial Sequence
  Ebola virus siRNA sense strand
aaggugacuucuaaaaaugga

SEQ ID NO: 6384 - RNA, 21 nt, Artificial Sequence
  Ebola virus siRNA sense strand
aggugacuucuaaaaauggac

SEQ ID NO: 6385 - RNA, 21 nt, Artificial Sequence
  Ebola virus siRNA sense strand
ggugacuucuaaaaauggaca

SEQ ID NO: 6386 - RNA, 21 nt, Artificial Sequence
  Ebola virus siRNA sense strand
gugacuucuaaaaauggacaa

SEQ ID NO: 6387 - RNA, 21 nt, Artificial Sequence
  Ebola virus siRNA sense strand
ugacuucuaaaaauggacaac

SEQ ID NO: 6388 - RNA, 21 nt, Artificial Sequence
  Ebola virus siRNA sense strand
gacuucuaaaaauggacaacc

SEQ ID NO: 6389 - RNA, 21 nt, Artificial Sequence
  Ebola virus siRNA sense strand
acuucuaaaaauggacaacca

SEQ ID NO: 6390 - RNA, 21 nt, Artificial Sequence
  Ebola virus siRNA sense strand
cuucuaaaaauggacaaccaa

SEQ ID NO: 6391 - RNA, 21 nt, Artificial Sequence
  Ebola virus siRNA sense strand
uucuaaaaauggacaaccaau

SEQ ID NO: 6392 - RNA, 21 nt, Artificial Sequence
  Ebola virus siRNA sense strand
ucuaaaaauggacaaccaauc

SEQ ID NO: 6393 - RNA, 21 nt, Artificial Sequence
  Ebola virus siRNA sense strand
cuaaaaauggacaaccaauca

SEQ ID NO: 6394 - RNA, 21 nt, Artificial Sequence
  Ebola virus siRNA sense strand
uaaaaauggacaaccaaucau

SEQ ID NO: 6395 - RNA, 21 nt, Artificial Sequence
  Ebola virus siRNA sense strand
aaaaauggacaaccaaucauc

SEQ ID NO: 6396 - RNA, 21 nt, Artificial Sequence
  Ebola virus siRNA sense strand
aaaauggacaaccaaucaucc

SEQ ID NO: 6397 - RNA, 21 nt, Artificial Sequence
  Ebola virus siRNA sense strand
aaauggacaaccaaucauccc

SEQ ID NO: 6398 - RNA, 21 nt, Artificial Sequence
  Ebola virus siRNA sense strand
aauggacaaccaaucaucccu

SEQ ID NO: 6399 - RNA, 21 nt, Artificial Sequence
  Ebola virus siRNA sense strand
auggacaaccaaucaucccug

SEQ ID NO: 6400 - RNA, 21 nt, Artificial Sequence
  Ebola virus siRNA sense strand
uggacaaccaaucaucccugu

SEQ ID NO: 6401 - RNA, 21 nt, Artificial Sequence
  Ebola virus siRNA sense strand
ggacaaccaaucaucccuguu

SEQ ID NO: 6402 - RNA, 21 nt, Artificial Sequence
  Ebola virus siRNA sense strand
gacaaccaaucaucccuguuc

SEQ ID NO: 6403 - RNA, 21 nt, Artificial Sequence
  Ebola virus siRNA sense strand
acaaccaaucaucccuguucu

SEQ ID NO: 6404 - RNA, 21 nt, Artificial Sequence
  Ebola virus siRNA sense strand
caaccaaucaucccuguucuu

SEQ ID NO: 6405 - RNA, 21 nt, Artificial Sequence
  Ebola virus siRNA sense strand
aaccaaucaucccuguucuuu

SEQ ID NO: 6406 - RNA, 21 nt, Artificial Sequence
  Ebola virus siRNA sense strand
accaaucaucccuguucuuuu

SEQ ID NO: 6407 - RNA, 21 nt, Artificial Sequence
  Ebola virus siRNA sense strand
ccaaucaucccuguucuuuug

SEQ ID NO: 6408 - RNA, 21 nt, Artificial Sequence
  Ebola virus siRNA sense strand
caaucaucccuguucuuuugc

SEQ ID NO: 6409 - RNA, 21 nt, Artificial Sequence
  Ebola virus siRNA sense strand
aaucaucccuguucuuuugcc

SEQ ID NO: 6410 - RNA, 21 nt, Artificial Sequence
  Ebola virus siRNA sense strand
aucaucccuguucuuuugcca

SEQ ID NO: 6411 - RNA, 21 nt, Artificial Sequence
  Ebola virus siRNA sense strand
ucaucccuguucuuuugccaa

SEQ ID NO: 6412 - RNA, 21 nt, Artificial Sequence
  Ebola virus siRNA sense strand
caucccuguucuuuugccaaa

SEQ ID NO: 6413 - RNA, 21 nt, Artificial Sequence
  Ebola virus siRNA sense strand
aucccuguucuuuugccaaag

SEQ ID NO: 6414 - RNA, 21 nt, Artificial Sequence
  Ebola virus siRNA sense strand
ucccuguucuuuugccaaagu

SEQ ID NO: 6415 - RNA, 21 nt, Artificial Sequence
  Ebola virus siRNA sense strand
cccuguucuuuugccaaagua

SEQ ID NO: 6416 - RNA, 21 nt, Artificial Sequence
  Ebola virus siRNA sense strand
ccuguucuuuugccaaaguac

SEQ ID NO: 6417 - RNA, 21 nt, Artificial Sequence
  Ebola virus siRNA sense strand
cuguucuuuugccaaaguaca

SEQ ID NO: 6418 - RNA, 21 nt, Artificial Sequence
  Ebola virus siRNA sense strand
uguucuuuugccaaaguacau

SEQ ID NO: 6419 - RNA, 21 nt, Artificial Sequence
  Ebola virus siRNA sense strand
guucuuuugccaaaguacauu

SEQ ID NO: 6420 - RNA, 21 nt, Artificial Sequence
  Ebola virus siRNA sense strand
uucuuuugccaaaguacauug

SEQ ID NO: 6421 - RNA, 21 nt, Artificial Sequence
  Ebola virus siRNA sense strand
ucuuuugccaaaguacauugg

SEQ ID NO: 6422 - RNA, 21 nt, Artificial Sequence
  Ebola virus siRNA sense strand
cuuuugccaaaguacauuggg

SEQ ID NO: 6423 - RNA, 21 nt, Artificial Sequence
  Ebola virus siRNA sense strand
uuuugccaaaguacauugggu

SEQ ID NO: 6424 - RNA, 21 nt, Artificial Sequence
  Ebola virus siRNA sense strand
uuugccaaaguacauuggguu

SEQ ID NO: 6425 - RNA, 21 nt, Artificial Sequence
  Ebola virus siRNA sense strand
uugccaaaguacauuggguug

SEQ ID NO: 6426 - RNA, 21 nt, Artificial Sequence
  Ebola virus siRNA sense strand
ugccaaaguacauuggguugg

SEQ ID NO: 6427 - RNA, 21 nt, Artificial Sequence
  Ebola virus siRNA sense strand
gccaaaguacauuggguugga

SEQ ID NO: 6428 - RNA, 21 nt, Artificial Sequence
  Ebola virus siRNA sense strand
ccaaaguacauuggguuggac

SEQ ID NO: 6429 - RNA, 21 nt, Artificial Sequence
  Ebola virus siRNA sense strand
caaaguacauuggguuggacc

SEQ ID NO: 6430 - RNA, 21 nt, Artificial Sequence
  Ebola virus siRNA sense strand
aaaguacauuggguuggaccc

SEQ ID NO: 6431 - RNA, 21 nt, Artificial Sequence
  Ebola virus siRNA sense strand
aaguacauuggguuggacccg

SEQ ID NO: 6432 - RNA, 21 nt, Artificial Sequence
  Ebola virus siRNA sense strand
aguacauuggguuggacccgg

SEQ ID NO: 6433 - RNA, 21 nt, Artificial Sequence
  Ebola virus siRNA sense strand
guacauuggguuggacccggu

SEQ ID NO: 6434 - RNA, 21 nt, Artificial Sequence
  Ebola virus siRNA sense strand
uacauuggguuggacccggug

SEQ ID NO: 6435 - RNA, 21 nt, Artificial Sequence
  Ebola virus siRNA sense strand
acauuggguuggacccggugg

SEQ ID NO: 6436 - RNA, 21 nt, Artificial Sequence
  Ebola virus siRNA sense strand
cauuggguuggacccgguggc

SEQ ID NO: 6437 - RNA, 21 nt, Artificial Sequence
  Ebola virus siRNA sense strand
auuggguuggacccgguggcu

SEQ ID NO: 6438 - RNA, 21 nt, Artificial Sequence
  Ebola virus siRNA sense strand
uuggguuggacccgguggcuc

SEQ ID NO: 6439 - RNA, 21 nt, Artificial Sequence
  Ebola virus siRNA sense strand
uggguuggacccgguggcucc

SEQ ID NO: 6440 - RNA, 21 nt, Artificial Sequence
  Ebola virus siRNA sense strand
ggguuggacccgguggcucca

SEQ ID NO: 6441 - RNA, 21 nt, Artificial Sequence
  Ebola virus siRNA sense strand
gguuggacccgguggcuccag

SEQ ID NO: 6442 - RNA, 21 nt, Artificial Sequence
  Ebola virus siRNA sense strand
guuggacccgguggcuccagg

SEQ ID NO: 6443 - RNA, 21 nt, Artificial Sequence
  Ebola virus siRNA sense strand
uuggacccgguggcuccagga

SEQ ID NO: 6444 - RNA, 21 nt, Artificial Sequence
  Ebola virus siRNA sense strand
uggacccgguggcuccaggag

SEQ ID NO: 6445 - RNA, 21 nt, Artificial Sequence
  Ebola virus siRNA sense strand
ggacccgguggcuccaggaga

SEQ ID NO: 6446 - RNA, 21 nt, Artificial Sequence
  Ebola virus siRNA sense strand
gacccgguggcuccaggagac

SEQ ID NO: 6447 - RNA, 21 nt, Artificial Sequence
  Ebola virus siRNA sense strand
acccgguggcuccaggagacc

SEQ ID NO: 6448 - RNA, 21 nt, Artificial Sequence
  Ebola virus siRNA sense strand
cccgguggcuccaggagaccu

SEQ ID NO: 6449 - RNA, 21 nt, Artificial Sequence
  Ebola virus siRNA sense strand
ccgguggcuccaggagaccuc

SEQ ID NO: 6450 - RNA, 21 nt, Artificial Sequence
  Ebola virus siRNA sense strand
cgguggcuccaggagaccuca

SEQ ID NO: 6451 - RNA, 21 nt, Artificial Sequence
  Ebola virus siRNA sense strand
gguggcuccaggagaccucac

SEQ ID NO: 6452 - RNA, 21 nt, Artificial Sequence
  Ebola virus siRNA sense strand
guggcuccaggagaccucacc

SEQ ID NO: 6453 - RNA, 21 nt, Artificial Sequence
  Ebola virus siRNA sense strand
uggcuccaggagaccucacca

SEQ ID NO: 6454 - RNA, 21 nt, Artificial Sequence
  Ebola virus siRNA sense strand
ggcuccaggagaccucaccau

SEQ ID NO: 6455 - RNA, 21 nt, Artificial Sequence
  Ebola virus siRNA sense strand
gcuccaggagaccucaccaug

SEQ ID NO: 6456 - RNA, 21 nt, Artificial Sequence
  Ebola virus siRNA sense strand
cuccaggagaccucaccaugg

SEQ ID NO: 6457 - RNA, 21 nt, Artificial Sequence
  Ebola virus siRNA sense strand
uccaggagaccucaccauggu

SEQ ID NO: 6458 - RNA, 21 nt, Artificial Sequence
  Ebola virus siRNA sense strand
ccaggagaccucaccauggua

SEQ ID NO: 6459 - RNA, 21 nt, Artificial Sequence
  Ebola virus siRNA sense strand
caggagaccucaccaugguaa

SEQ ID NO: 6460 - RNA, 21 nt, Artificial Sequence
  Ebola virus siRNA sense strand
aggagaccucaccaugguaau

SEQ ID NO: 6461 - RNA, 21 nt, Artificial Sequence
  Ebola virus siRNA sense strand
ggagaccucaccaugguaauc

SEQ ID NO: 6462 - RNA, 21 nt, Artificial Sequence
  Ebola virus siRNA sense strand
gagaccucaccaugguaauca

SEQ ID NO: 6463 - RNA, 21 nt, Artificial Sequence
  Ebola virus siRNA sense strand
agaccucaccaugguaaucac

SEQ ID NO: 6464 - RNA, 21 nt, Artificial Sequence
  Ebola virus siRNA sense strand
gaccucaccaugguaaucaca

SEQ ID NO: 6465 - RNA, 21 nt, Artificial Sequence
  Ebola virus siRNA sense strand
accucaccaugguaaucacac

SEQ ID NO: 6466 - RNA, 21 nt, Artificial Sequence
  Ebola virus siRNA sense strand
ccucaccaugguaaucacaca

SEQ ID NO: 6467 - RNA, 21 nt, Artificial Sequence
  Ebola virus siRNA sense strand
cucaccaugguaaucacacag

SEQ ID NO: 6468 - RNA, 21 nt, Artificial Sequence
  Ebola virus siRNA sense strand
ucaccaugguaaucacacagg

SEQ ID NO: 6469 - RNA, 21 nt, Artificial Sequence
  Ebola virus siRNA sense strand
caccaugguaaucacacagga

SEQ ID NO: 6470 - RNA, 21 nt, Artificial Sequence
  Ebola virus siRNA sense strand
accaugguaaucacacaggau

SEQ ID NO: 6471 - RNA, 21 nt, Artificial Sequence
  Ebola virus siRNA sense strand
ccaugguaaucacacaggauu

SEQ ID NO: 6472 - RNA, 21 nt, Artificial Sequence
  Ebola virus siRNA sense strand
caugguaaucacacaggauug

SEQ ID NO: 6473 - RNA, 21 nt, Artificial Sequence
  Ebola virus siRNA sense strand
augguaaucacacaggauugu

SEQ ID NO: 6474 - RNA, 21 nt, Artificial Sequence
  Ebola virus siRNA sense strand
ugguaaucacacaggauugug

SEQ ID NO: 6475 - RNA, 21 nt, Artificial Sequence
  Ebola virus siRNA sense strand
gguaaucacacaggauuguga

SEQ ID NO: 6476 - RNA, 21 nt, Artificial Sequence
  Ebola virus siRNA sense strand
guaaucacacaggauugugac

SEQ ID NO: 6477 - RNA, 21 nt, Artificial Sequence
  Ebola virus siRNA sense strand
uaaucacacaggauugugaca

SEQ ID NO: 6478 - RNA, 21 nt, Artificial Sequence
  Ebola virus siRNA sense strand
aaucacacaggauugugacac

SEQ ID NO: 6479 - RNA, 21 nt, Artificial Sequence
  Ebola virus siRNA sense strand
aucacacaggauugugacacg

SEQ ID NO: 6480 - RNA, 21 nt, Artificial Sequence
  Ebola virus siRNA sense strand
ucacacaggauugugacacgu

SEQ ID NO: 6481 - RNA, 21 nt, Artificial Sequence
  Ebola virus siRNA sense strand
cacacaggauugugacacgug

SEQ ID NO: 6482 - RNA, 21 nt, Artificial Sequence
  Ebola virus siRNA sense strand
acacaggauugugacacgugu

SEQ ID NO: 6483 - RNA, 21 nt, Artificial Sequence
  Ebola virus siRNA sense strand
cacaggauugugacacguguc

SEQ ID NO: 6484 - RNA, 21 nt, Artificial Sequence
  Ebola virus siRNA sense strand
acaggauugugacacguguca

SEQ ID NO: 6485 - RNA, 21 nt, Artificial Sequence
  Ebola virus siRNA sense strand
caggauugugacacgugucau

SEQ ID NO: 6486 - RNA, 21 nt, Artificial Sequence
  Ebola virus siRNA sense strand
aggauugugacacgugucauu

SEQ ID NO: 6487 - RNA, 21 nt, Artificial Sequence
  Ebola virus siRNA sense strand
ggauugugacacgugucauuc

SEQ ID NO: 6488 - RNA, 21 nt, Artificial Sequence
  Ebola virus siRNA sense strand
gauugugacacgugucauucu

SEQ ID NO: 6489 - RNA, 21 nt, Artificial Sequence
  Ebola virus siRNA sense strand
auugugacacgugucauucuc

SEQ ID NO: 6490 - RNA, 21 nt, Artificial Sequence
  Ebola virus siRNA sense strand
uugugacacgugucauucucc

SEQ ID NO: 6491 - RNA, 21 nt, Artificial Sequence
  Ebola virus siRNA sense strand
ugugacacgugucauucuccu

SEQ ID NO: 6492 - RNA, 21 nt, Artificial Sequence
  Ebola virus siRNA sense strand
gugacacgugucauucuccug

SEQ ID NO: 6493 - RNA, 21 nt, Artificial Sequence
  Ebola virus siRNA sense strand
ugacacgugucauucuccugc

SEQ ID NO: 6494 - RNA, 21 nt, Artificial Sequence
  Ebola virus siRNA sense strand
gacacgugucauucuccugca

SEQ ID NO: 6495 - RNA, 21 nt, Artificial Sequence
  Ebola virus siRNA sense strand
acacgugucauucuccugcaa

SEQ ID NO: 6496 - RNA, 21 nt, Artificial Sequence
  Ebola virus siRNA sense strand
cacgugucauucuccugcaag

SEQ ID NO: 6497 - RNA, 21 nt, Artificial Sequence
  Ebola virus siRNA sense strand
acgugucauucuccugcaagu

SEQ ID NO: 6498 - RNA, 21 nt, Artificial Sequence
  Ebola virus siRNA sense strand
cgugucauucuccugcaaguc

SEQ ID NO: 6499 - RNA, 21 nt, Artificial Sequence
  Ebola virus siRNA sense strand
gugucauucuccugcaagucu

SEQ ID NO: 6500 - RNA, 21 nt, Artificial Sequence
  Ebola virus siRNA sense strand
ugucauucuccugcaagucuu

SEQ ID NO: 6501 - RNA, 21 nt, Artificial Sequence
  Ebola virus siRNA sense strand
gucauucuccugcaagucuuc

SEQ ID NO: 6502 - RNA, 21 nt, Artificial Sequence
  Ebola virus siRNA sense strand
ucauucuccugcaagucuucc

SEQ ID NO: 6503 - RNA, 21 nt, Artificial Sequence
  Ebola virus siRNA sense strand
cauucuccugcaagucuucca

SEQ ID NO: 6504 - RNA, 21 nt, Artificial Sequence
  Ebola virus siRNA sense strand
auucuccugcaagucuuccag

SEQ ID NO: 6505 - RNA, 21 nt, Artificial Sequence
  Ebola virus siRNA sense strand
uucuccugcaagucuuccagc

SEQ ID NO: 6506 - RNA, 21 nt, Artificial Sequence
  Ebola virus siRNA sense strand
ucuccugcaagucuuccagcu

SEQ ID NO: 6507 - RNA, 21 nt, Artificial Sequence
  Ebola virus siRNA sense strand
cuccugcaagucuuccagcug

SEQ ID NO: 6508 - RNA, 21 nt, Artificial Sequence
  Ebola virus siRNA sense strand
uccugcaagucuuccagcugu

SEQ ID NO: 6509 - RNA, 21 nt, Artificial Sequence
  Ebola virus siRNA sense strand
ccugcaagucuuccagcugug

SEQ ID NO: 6510 - RNA, 21 nt, Artificial Sequence
  Ebola virus siRNA sense strand
cugcaagucuuccagcuguga

SEQ ID NO: 6511 - RNA, 21 nt, Artificial Sequence
  Ebola virus siRNA sense strand
ugcaagucuuccagcugugau

SEQ ID NO: 6512 - RNA, 21 nt, Artificial Sequence
  Ebola virus siRNA sense strand
gcaagucuuccagcugugauu

SEQ ID NO: 6513 - RNA, 21 nt, Artificial Sequence
  Ebola virus siRNA sense strand
caagucuuccagcugugauug

SEQ ID NO: 6514 - RNA, 21 nt, Artificial Sequence
  Ebola virus siRNA sense strand
aagucuuccagcugugauuga

SEQ ID NO: 6515 - RNA, 21 nt, Artificial Sequence
  Ebola virus siRNA sense strand
agucuuccagcugugauugag

SEQ ID NO: 6516 - RNA, 21 nt, Artificial Sequence
  Ebola virus siRNA sense strand
gucuuccagcugugauugaga

SEQ ID NO: 6517 - RNA, 21 nt, Artificial Sequence
  Ebola virus siRNA sense strand
ucuuccagcugugauugagaa

SEQ ID NO: 6518 - RNA, 21 nt, Artificial Sequence
  Ebola virus siRNA sense strand
cuuccagcugugauugagaag

SEQ ID NO: 6519 - RNA, 21 nt, Artificial Sequence
  Ebola virus siRNA sense strand
uuccagcugugauugagaagu

SEQ ID NO: 6520 - RNA, 21 nt, Artificial Sequence
  Ebola virus siRNA sense strand
uccagcugugauugagaagua

SEQ ID NO: 6521 - RNA, 21 nt, Artificial Sequence
  Ebola virus siRNA sense strand
ccagcugugauugagaaguaa

SEQ ID NO: 6522 - RNA, 21 nt, Artificial Sequence
  Ebola virus siRNA sense strand
cagcugugauugagaaguaau

SEQ ID NO: 6523 - RNA, 21 nt, Artificial Sequence
  Ebola virus siRNA sense strand
agcugugauugagaaguaauu

SEQ ID NO: 6524 - RNA, 21 nt, Artificial Sequence
  Ebola virus siRNA sense strand
gcugugauugagaaguaauug

SEQ ID NO: 6525 - RNA, 21 nt, Artificial Sequence
  Ebola virus siRNA sense strand
cugugauugagaaguaauugc

SEQ ID NO: 6526 - RNA, 21 nt, Artificial Sequence
  Ebola virus siRNA sense strand
ugugauugagaaguaauugca

SEQ ID NO: 6527 - RNA, 21 nt, Artificial Sequence
  Ebola virus siRNA sense strand
gugauugagaaguaauugcaa

SEQ ID NO: 6528 - RNA, 21 nt, Artificial Sequence
  Ebola virus siRNA sense strand
ugauugagaaguaauugcaau

SEQ ID NO: 6529 - RNA, 21 nt, Artificial Sequence
  Ebola virus siRNA sense strand
gauugagaaguaauugcaaua

SEQ ID NO: 6530 - RNA, 21 nt, Artificial Sequence
  Ebola virus siRNA sense strand
auugagaaguaauugcaauaa

SEQ ID NO: 6531 - RNA, 21 nt, Artificial Sequence
  Ebola virus siRNA sense strand
uugagaaguaauugcaauaau

SEQ ID NO: 6532 - RNA, 21 nt, Artificial Sequence
  Ebola virus siRNA sense strand
ugagaaguaauugcaauaauu

SEQ ID NO: 6533 - RNA, 21 nt, Artificial Sequence
  Ebola virus siRNA sense strand
gagaaguaauugcaauaauug

SEQ ID NO: 6534 - RNA, 21 nt, Artificial Sequence
  Ebola virus siRNA sense strand
agaaguaauugcaauaauuga

SEQ ID NO: 6535 - RNA, 21 nt, Artificial Sequence
  Ebola virus siRNA sense strand
gaaguaauugcaauaauugac

SEQ ID NO: 6536 - RNA, 21 nt, Artificial Sequence
  Ebola virus siRNA sense strand
aaguaauugcaauaauugacu

SEQ ID NO: 6537 - RNA, 21 nt, Artificial Sequence
  Ebola virus siRNA sense strand
aguaauugcaauaauugacuc

SEQ ID NO: 6538 - RNA, 21 nt, Artificial Sequence
  Ebola virus siRNA sense strand
guaauugcaauaauugacuca

SEQ ID NO: 6539 - RNA, 21 nt, Artificial Sequence
  Ebola virus siRNA sense strand
uaauugcaauaauugacucag

SEQ ID NO: 6540 - RNA, 21 nt, Artificial Sequence
  Ebola virus siRNA sense strand
aauugcaauaauugacucaga

SEQ ID NO: 6541 - RNA, 21 nt, Artificial Sequence
  Ebola virus siRNA sense strand
auugcaauaauugacucagau

SEQ ID NO: 6542 - RNA, 21 nt, Artificial Sequence
  Ebola virus siRNA sense strand
uugcaauaauugacucagauc

SEQ ID NO: 6543 - RNA, 21 nt, Artificial Sequence
  Ebola virus siRNA sense strand
ugcaauaauugacucagaucc

SEQ ID NO: 6544 - RNA, 21 nt, Artificial Sequence
  Ebola virus siRNA sense strand
gcaauaauugacucagaucca

SEQ ID NO: 6545 - RNA, 21 nt, Artificial Sequence
  Ebola virus siRNA sense strand
caauaauugacucagauccag

SEQ ID NO: 6546 - RNA, 21 nt, Artificial Sequence
  Ebola virus siRNA sense strand
aauaauugacucagauccagu

SEQ ID NO: 6547 - RNA, 21 nt, Artificial Sequence
  Ebola virus siRNA sense strand
auaauugacucagauccaguu

SEQ ID NO: 6548 - RNA, 21 nt, Artificial Sequence
  Ebola virus siRNA sense strand
uaauugacucagauccaguuu

SEQ ID NO: 6549 - RNA, 21 nt, Artificial Sequence
  Ebola virus siRNA sense strand
aauugacucagauccaguuuu

SEQ ID NO: 6550 - RNA, 21 nt, Artificial Sequence
  Ebola virus siRNA sense strand
auugacucagauccaguuuua

SEQ ID NO: 6551 - RNA, 21 nt, Artificial Sequence
  Ebola virus siRNA sense strand
uugacucagauccaguuuuau

SEQ ID NO: 6552 - RNA, 21 nt, Artificial Sequence
  Ebola virus siRNA sense strand
ugacucagauccaguuuuaua

SEQ ID NO: 6553 - RNA, 21 nt, Artificial Sequence
  Ebola virus siRNA sense strand
gacucagauccaguuuuauag

SEQ ID NO: 6554 - RNA, 21 nt, Artificial Sequence
  Ebola virus siRNA sense strand
acucagauccaguuuuauaga

SEQ ID NO: 6555 - RNA, 21 nt, Artificial Sequence
  Ebola virus siRNA sense strand
cucagauccaguuuuauagaa

SEQ ID NO: 6556 - RNA, 21 nt, Artificial Sequence
  Ebola virus siRNA sense strand
ucagauccaguuuuauagaau

SEQ ID NO: 6557 - RNA, 21 nt, Artificial Sequence
  Ebola virus siRNA sense strand
cagauccaguuuuauagaauc

SEQ ID NO: 6558 - RNA, 21 nt, Artificial Sequence
  Ebola virus siRNA sense strand
agauccaguuuuauagaaucu

SEQ ID NO: 6559 - RNA, 21 nt, Artificial Sequence
  Ebola virus siRNA sense strand
gauccaguuuuauagaaucuu

SEQ ID NO: 6560 - RNA, 21 nt, Artificial Sequence
  Ebola virus siRNA sense strand
auccaguuuuauagaaucuuc

SEQ ID NO: 6561 - RNA, 21 nt, Artificial Sequence
  Ebola virus siRNA sense strand
uccaguuuuauagaaucuucu

SEQ ID NO: 6562 - RNA, 21 nt, Artificial Sequence
  Ebola virus siRNA sense strand
ccaguuuuauagaaucuucuc

SEQ ID NO: 6563 - RNA, 21 nt, Artificial Sequence
  Ebola virus siRNA sense strand
caguuuuauagaaucuucuca

SEQ ID NO: 6564 - RNA, 21 nt, Artificial Sequence
  Ebola virus siRNA sense strand
aguuuuauagaaucuucucag

SEQ ID NO: 6565 - RNA, 21 nt, Artificial Sequence
  Ebola virus siRNA sense strand
guuuuauagaaucuucucagg

SEQ ID NO: 6566 - RNA, 21 nt, Artificial Sequence
  Ebola virus siRNA sense strand
uuuuauagaaucuucucaggg

SEQ ID NO: 6567 - RNA, 21 nt, Artificial Sequence
  Ebola virus siRNA sense strand
uuuauagaaucuucucaggga

SEQ ID NO: 6568 - RNA, 21 nt, Artificial Sequence
  Ebola virus siRNA sense strand
uuauagaaucuucucagggau

SEQ ID NO: 6569 - RNA, 21 nt, Artificial Sequence
  Ebola virus siRNA sense strand
uauagaaucuucucagggaua

SEQ ID NO: 6570 - RNA, 21 nt, Artificial Sequence
  Ebola virus siRNA sense strand
auagaaucuucucagggauag

SEQ ID NO: 6571 - RNA, 21 nt, Artificial Sequence
  Ebola virus siRNA sense strand
uagaaucuucucagggauagu

SEQ ID NO: 6572 - RNA, 21 nt, Artificial Sequence
  Ebola virus siRNA sense strand
agaaucuucucagggauagug

SEQ ID NO: 6573 - RNA, 21 nt, Artificial Sequence
  Ebola virus siRNA sense strand
gaaucuucucagggauaguga

SEQ ID NO: 6574 - RNA, 21 nt, Artificial Sequence
  Ebola virus siRNA sense strand
aaucuucucagggauagugau

SEQ ID NO: 6575 - RNA, 21 nt, Artificial Sequence
  Ebola virus siRNA sense strand
aucuucucagggauagugaua

SEQ ID NO: 6576 - RNA, 21 nt, Artificial Sequence
  Ebola virus siRNA sense strand
ucuucucagggauagugauaa

SEQ ID NO: 6577 - RNA, 21 nt, Artificial Sequence
  Ebola virus siRNA sense strand
cuucucagggauagugauaac

SEQ ID NO: 6578 - RNA, 21 nt, Artificial Sequence
  Ebola virus siRNA sense strand
uucucagggauagugauaaca

SEQ ID NO: 6579 - RNA, 21 nt, Artificial Sequence
  Ebola virus siRNA sense strand
ucucagggauagugauaacau

SEQ ID NO: 6580 - RNA, 21 nt, Artificial Sequence
  Ebola virus siRNA sense strand
cucagggauagugauaacauc

SEQ ID NO: 6581 - RNA, 21 nt, Artificial Sequence
  Ebola virus siRNA sense strand
ucagggauagugauaacaucu

SEQ ID NO: 6582 - RNA, 21 nt, Artificial Sequence
  Ebola virus siRNA sense strand
cagggauagugauaacaucua

SEQ ID NO: 6583 - RNA, 21 nt, Artificial Sequence
  Ebola virus siRNA sense strand
agggauagugauaacaucuau

SEQ ID NO: 6584 - RNA, 21 nt, Artificial Sequence
  Ebola virus siRNA sense strand
gggauagugauaacaucuauu

SEQ ID NO: 6585 - RNA, 21 nt, Artificial Sequence
  Ebola virus siRNA sense strand
ggauagugauaacaucuauuu

SEQ ID NO: 6586 - RNA, 21 nt, Artificial Sequence
  Ebola virus siRNA sense strand
gauagugauaacaucuauuua

SEQ ID NO: 6587 - RNA, 21 nt, Artificial Sequence
  Ebola virus siRNA sense strand
auagugauaacaucuauuuag

SEQ ID NO: 6588 - RNA, 21 nt, Artificial Sequence
  Ebola virus siRNA sense strand
uagugauaacaucuauuuagu

SEQ ID NO: 6589 - RNA, 21 nt, Artificial Sequence
  Ebola virus siRNA sense strand
agugauaacaucuauuuagua

SEQ ID NO: 6590 - RNA, 21 nt, Artificial Sequence
  Ebola virus siRNA sense strand
gugauaacaucuauuuaguaa

SEQ ID NO: 6591 - RNA, 21 nt, Artificial Sequence
  Ebola virus siRNA sense strand
ugauaacaucuauuuaguaau

SEQ ID NO: 6592 - RNA, 21 nt, Artificial Sequence
  Ebola virus siRNA sense strand
gauaacaucuauuuaguaauc

SEQ ID NO: 6593 - RNA, 21 nt, Artificial Sequence
  Ebola virus siRNA sense strand
auaacaucuauuuaguaaucc

SEQ ID NO: 6594 - RNA, 21 nt, Artificial Sequence
  Ebola virus siRNA sense strand
uaacaucuauuuaguaauccg

SEQ ID NO: 6595 - RNA, 21 nt, Artificial Sequence
  Ebola virus siRNA sense strand
aacaucuauuuaguaauccgu

SEQ ID NO: 6596 - RNA, 21 nt, Artificial Sequence
  Ebola virus siRNA sense strand
acaucuauuuaguaauccguc

SEQ ID NO: 6597 - RNA, 21 nt, Artificial Sequence
  Ebola virus siRNA sense strand
caucuauuuaguaauccgucc

SEQ ID NO: 6598 - RNA, 21 nt, Artificial Sequence
  Ebola virus siRNA sense strand
aucuauuuaguaauccgucca

SEQ ID NO: 6599 - RNA, 21 nt, Artificial Sequence
  Ebola virus siRNA sense strand
ucuauuuaguaauccguccau

SEQ ID NO: 6600 - RNA, 21 nt, Artificial Sequence
  Ebola virus siRNA sense strand
cuauuuaguaauccguccauu

SEQ ID NO: 6601 - RNA, 21 nt, Artificial Sequence
  Ebola virus siRNA sense strand
uauuuaguaauccguccauua

SEQ ID NO: 6602 - RNA, 21 nt, Artificial Sequence
  Ebola virus siRNA sense strand
auuuaguaauccguccauuag

SEQ ID NO: 6603 - RNA, 21 nt, Artificial Sequence
  Ebola virus siRNA sense strand
uuuaguaauccguccauuaga

SEQ ID NO: 6604 - RNA, 21 nt, Artificial Sequence
  Ebola virus siRNA sense strand
uuaguaauccguccauuagag

SEQ ID NO: 6605 - RNA, 21 nt, Artificial Sequence
  Ebola virus siRNA sense strand
uaguaauccguccauuagagg

SEQ ID NO: 6606 - RNA, 21 nt, Artificial Sequence
  Ebola virus siRNA sense strand
aguaauccguccauuagagga

SEQ ID NO: 6607 - RNA, 21 nt, Artificial Sequence
  Ebola virus siRNA sense strand
guaauccguccauuagaggag

SEQ ID NO: 6608 - RNA, 21 nt, Artificial Sequence
  Ebola virus siRNA sense strand
uaauccguccauuagaggaga

SEQ ID NO: 6609 - RNA, 21 nt, Artificial Sequence
  Ebola virus siRNA sense strand
aauccguccauuagaggagac

SEQ ID NO: 6610 - RNA, 21 nt, Artificial Sequence
  Ebola virus siRNA sense strand
auccguccauuagaggagaca

SEQ ID NO: 6611 - RNA, 21 nt, Artificial Sequence
  Ebola virus siRNA sense strand
uccguccauuagaggagacac

SEQ ID NO: 6612 - RNA, 21 nt, Artificial Sequence
  Ebola virus siRNA sense strand
ccguccauuagaggagacacu

SEQ ID NO: 6613 - RNA, 21 nt, Artificial Sequence
  Ebola virus siRNA sense strand
cguccauuagaggagacacuu

SEQ ID NO: 6614 - RNA, 21 nt, Artificial Sequence
  Ebola virus siRNA sense strand
guccauuagaggagacacuuu

SEQ ID NO: 6615 - RNA, 21 nt, Artificial Sequence
  Ebola virus siRNA sense strand
uccauuagaggagacacuuuu

SEQ ID NO: 6616 - RNA, 21 nt, Artificial Sequence
  Ebola virus siRNA sense strand
ccauuagaggagacacuuuua

SEQ ID NO: 6617 - RNA, 21 nt, Artificial Sequence
  Ebola virus siRNA sense strand
cauuagaggagacacuuuuaa

SEQ ID NO: 6618 - RNA, 21 nt, Artificial Sequence
  Ebola virus siRNA sense strand
auuagaggagacacuuuuaau

SEQ ID NO: 6619 - RNA, 21 nt, Artificial Sequence
  Ebola virus siRNA sense strand
uuagaggagacacuuuuaauu

SEQ ID NO: 6620 - RNA, 21 nt, Artificial Sequence
  Ebola virus siRNA sense strand
uagaggagacacuuuuaauug

SEQ ID NO: 6621 - RNA, 21 nt, Artificial Sequence
  Ebola virus siRNA sense strand
agaggagacacuuuuaauuga

SEQ ID NO: 6622 - RNA, 21 nt, Artificial Sequence
  Ebola virus siRNA sense strand
gaggagacacuuuuaauugau

SEQ ID NO: 6623 - RNA, 21 nt, Artificial Sequence
  Ebola virus siRNA sense strand
aggagacacuuuuaauugauc

SEQ ID NO: 6624 - RNA, 21 nt, Artificial Sequence
  Ebola virus siRNA sense strand
ggagacacuuuuaauugauca

SEQ ID NO: 6625 - RNA, 21 nt, Artificial Sequence
  Ebola virus siRNA sense strand
gagacacuuuuaauugaucaa

SEQ ID NO: 6626 - RNA, 21 nt, Artificial Sequence
  Ebola virus siRNA sense strand
agacacuuuuaauugaucaau

SEQ ID NO: 6627 - RNA, 21 nt, Artificial Sequence
  Ebola virus siRNA sense strand
gacacuuuuaauugaucaaua

SEQ ID NO: 6628 - RNA, 21 nt, Artificial Sequence
  Ebola virus siRNA sense strand
acacuuuuaauugaucaauau

SEQ ID NO: 6629 - RNA, 21 nt, Artificial Sequence
  Ebola virus siRNA sense strand
cacuuuuaauugaucaauaua

SEQ ID NO: 6630 - RNA, 21 nt, Artificial Sequence
  Ebola virus siRNA sense strand
acuuuuaauugaucaauauac

SEQ ID NO: 6631 - RNA, 21 nt, Artificial Sequence
  Ebola virus siRNA sense strand
cuuuuaauugaucaauauacu

SEQ ID NO: 6632 - RNA, 21 nt, Artificial Sequence
  Ebola virus siRNA sense strand
uuuuaauugaucaauauacua

SEQ ID NO: 6633 - RNA, 21 nt, Artificial Sequence
  Ebola virus siRNA sense strand
uuuaauugaucaauauacuaa

SEQ ID NO: 6634 - RNA, 21 nt, Artificial Sequence
  Ebola virus siRNA sense strand
uuaauugaucaauauacuaaa

SEQ ID NO: 6635 - RNA, 21 nt, Artificial Sequence
  Ebola virus siRNA sense strand
uaauugaucaauauacuaaag

SEQ ID NO: 6636 - RNA, 21 nt, Artificial Sequence
  Ebola virus siRNA sense strand
aauugaucaauauacuaaagg

SEQ ID NO: 6637 - RNA, 21 nt, Artificial Sequence
  Ebola virus siRNA sense strand
auugaucaauauacuaaaggu

SEQ ID NO: 6638 - RNA, 21 nt, Artificial Sequence
  Ebola virus siRNA sense strand
uugaucaauauacuaaaggug

SEQ ID NO: 6639 - RNA, 21 nt, Artificial Sequence
  Ebola virus siRNA sense strand
ugaucaauauacuaaaggugc

SEQ ID NO: 6640 - RNA, 21 nt, Artificial Sequence
  Ebola virus siRNA sense strand
gaucaauauacuaaaggugcu

SEQ ID NO: 6641 - RNA, 21 nt, Artificial Sequence
  Ebola virus siRNA sense strand
aucaauauacuaaaggugcuu

SEQ ID NO: 6642 - RNA, 21 nt, Artificial Sequence
  Ebola virus siRNA sense strand
ucaauauacuaaaggugcuuu

SEQ ID NO: 6643 - RNA, 21 nt, Artificial Sequence
  Ebola virus siRNA sense strand
caauauacuaaaggugcuuua

SEQ ID NO: 6644 - RNA, 21 nt, Artificial Sequence
  Ebola virus siRNA sense strand
aauauacuaaaggugcuuuac

SEQ ID NO: 6645 - RNA, 21 nt, Artificial Sequence
  Ebola virus siRNA sense strand
auauacuaaaggugcuuuaca

SEQ ID NO: 6646 - RNA, 21 nt, Artificial Sequence
  Ebola virus siRNA sense strand
uauacuaaaggugcuuuacac

SEQ ID NO: 6647 - RNA, 21 nt, Artificial Sequence
  Ebola virus siRNA sense strand
auacuaaaggugcuuuacacc

SEQ ID NO: 6648 - RNA, 21 nt, Artificial Sequence
  Ebola virus siRNA sense strand
uacuaaaggugcuuuacacca

SEQ ID NO: 6649 - RNA, 21 nt, Artificial Sequence
  Ebola virus siRNA sense strand
acuaaaggugcuuuacaccau

SEQ ID NO: 6650 - RNA, 21 nt, Artificial Sequence
  Ebola virus siRNA sense strand
cuaaaggugcuuuacaccauu

SEQ ID NO: 6651 - RNA, 21 nt, Artificial Sequence
  Ebola virus siRNA sense strand
uaaaggugcuuuacaccauug

SEQ ID NO: 6652 - RNA, 21 nt, Artificial Sequence
  Ebola virus siRNA sense strand
aaaggugcuuuacaccauugu

SEQ ID NO: 6653 - RNA, 21 nt, Artificial Sequence
  Ebola virus siRNA sense strand
aaggugcuuuacaccauuguc

SEQ ID NO: 6654 - RNA, 21 nt, Artificial Sequence
  Ebola virus siRNA sense strand
aggugcuuuacaccauugucu

SEQ ID NO: 6655 - RNA, 21 nt, Artificial Sequence
  Ebola virus siRNA sense strand
ggugcuuuacaccauugucuu

SEQ ID NO: 6656 - RNA, 21 nt, Artificial Sequence
  Ebola virus siRNA sense strand
gugcuuuacaccauugucuuu

SEQ ID NO: 6657 - RNA, 21 nt, Artificial Sequence
  Ebola virus siRNA sense strand
ugcuuuacaccauugucuuuu

SEQ ID NO: 6658 - RNA, 21 nt, Artificial Sequence
  Ebola virus siRNA sense strand
gcuuuacaccauugucuuuuu

SEQ ID NO: 6659 - RNA, 21 nt, Artificial Sequence
  Ebola virus siRNA sense strand
cuuuacaccauugucuuuuuu

SEQ ID NO: 6660 - RNA, 21 nt, Artificial Sequence
  Ebola virus siRNA sense strand
uuuacaccauugucuuuuuuc

SEQ ID NO: 6661 - RNA, 21 nt, Artificial Sequence
  Ebola virus siRNA sense strand
uuacaccauugucuuuuuucu

SEQ ID NO: 6662 - RNA, 21 nt, Artificial Sequence
  Ebola virus siRNA sense strand
uacaccauugucuuuuuucuc

SEQ ID NO: 6663 - RNA, 21 nt, Artificial Sequence
  Ebola virus siRNA sense strand
acaccauugucuuuuuucucu

SEQ ID NO: 6664 - RNA, 21 nt, Artificial Sequence
  Ebola virus siRNA sense strand
caccauugucuuuuuucucuc

SEQ ID NO: 6665 - RNA, 21 nt, Artificial Sequence
  Ebola virus siRNA sense strand
accauugucuuuuuucucucc

SEQ ID NO: 6666 - RNA, 21 nt, Artificial Sequence
  Ebola virus siRNA sense strand
ccauugucuuuuuucucuccu

SEQ ID NO: 6667 - RNA, 21 nt, Artificial Sequence
  Ebola virus siRNA sense strand
cauugucuuuuuucucuccua

SEQ ID NO: 6668 - RNA, 21 nt, Artificial Sequence
  Ebola virus siRNA sense strand
auugucuuuuuucucuccuaa

SEQ ID NO: 6669 - RNA, 21 nt, Artificial Sequence
  Ebola virus siRNA sense strand
uugucuuuuuucucuccuaaa

SEQ ID NO: 6670 - RNA, 21 nt, Artificial Sequence
  Ebola virus siRNA sense strand
ugucuuuuuucucuccuaaau

SEQ ID NO: 6671 - RNA, 21 nt, Artificial Sequence
  Ebola virus siRNA sense strand
gucuuuuuucucuccuaaaug

SEQ ID NO: 6672 - RNA, 21 nt, Artificial Sequence
  Ebola virus siRNA sense strand
ucuuuuuucucuccuaaaugu

SEQ ID NO: 6673 - RNA, 21 nt, Artificial Sequence
  Ebola virus siRNA sense strand
cuuuuuucucuccuaaaugua

SEQ ID NO: 6674 - RNA, 21 nt, Artificial Sequence
  Ebola virus siRNA sense strand
uuuuuucucuccuaaauguag

SEQ ID NO: 6675 - RNA, 21 nt, Artificial Sequence
  Ebola virus siRNA sense strand
uuuuucucuccuaaauguaga

SEQ ID NO: 6676 - RNA, 21 nt, Artificial Sequence
  Ebola virus siRNA sense strand
uuuucucuccuaaauguagaa

SEQ ID NO: 6677 - RNA, 21 nt, Artificial Sequence
  Ebola virus siRNA sense strand
uuucucuccuaaauguagaac

SEQ ID NO: 6678 - RNA, 21 nt, Artificial Sequence
  Ebola virus siRNA sense strand
uucucuccuaaauguagaacu

SEQ ID NO: 6679 - RNA, 21 nt, Artificial Sequence
  Ebola virus siRNA sense strand
ucucuccuaaauguagaacuu

SEQ ID NO: 6680 - RNA, 21 nt, Artificial Sequence
  Ebola virus siRNA sense strand
cucuccuaaauguagaacuua

SEQ ID NO: 6681 - RNA, 21 nt, Artificial Sequence
  Ebola virus siRNA sense strand
ucuccuaaauguagaacuuaa

SEQ ID NO: 6682 - RNA, 21 nt, Artificial Sequence
  Ebola virus siRNA sense strand
cuccuaaauguagaacuuaac

SEQ ID NO: 6683 - RNA, 21 nt, Artificial Sequence
  Ebola virus siRNA sense strand
uccuaaauguagaacuuaaca

SEQ ID NO: 6684 - RNA, 21 nt, Artificial Sequence
  Ebola virus siRNA sense strand
ccuaaauguagaacuuaacaa

SEQ ID NO: 6685 - RNA, 21 nt, Artificial Sequence
  Ebola virus siRNA sense strand
cuaaauguagaacuuaacaaa

SEQ ID NO: 6686 - RNA, 21 nt, Artificial Sequence
  Ebola virus siRNA sense strand
uaaauguagaacuuaacaaaa

SEQ ID NO: 6687 - RNA, 21 nt, Artificial Sequence
  Ebola virus siRNA sense strand
aaauguagaacuuaacaaaag

SEQ ID NO: 6688 - RNA, 21 nt, Artificial Sequence
  Ebola virus siRNA sense strand
aauguagaacuuaacaaaaga

SEQ ID NO: 6689 - RNA, 21 nt, Artificial Sequence
  Ebola virus siRNA sense strand
auguagaacuuaacaaaagac

SEQ ID NO: 6690 - RNA, 21 nt, Artificial Sequence
  Ebola virus siRNA sense strand
uguagaacuuaacaaaagacu

SEQ ID NO: 6691 - RNA, 21 nt, Artificial Sequence
  Ebola virus siRNA sense strand
guagaacuuaacaaaagacuc

SEQ ID NO: 6692 - RNA, 21 nt, Artificial Sequence
  Ebola virus siRNA sense strand
uagaacuuaacaaaagacuca

SEQ ID NO: 6693 - RNA, 21 nt, Artificial Sequence
  Ebola virus siRNA sense strand
agaacuuaacaaaagacucau

SEQ ID NO: 6694 - RNA, 21 nt, Artificial Sequence
  Ebola virus siRNA sense strand
gaacuuaacaaaagacucaua

SEQ ID NO: 6695 - RNA, 21 nt, Artificial Sequence
  Ebola virus siRNA sense strand
aacuuaacaaaagacucauaa

SEQ ID NO: 6696 - RNA, 21 nt, Artificial Sequence
  Ebola virus siRNA sense strand
acuuaacaaaagacucauaau

SEQ ID NO: 6697 - RNA, 21 nt, Artificial Sequence
  Ebola virus siRNA sense strand
cuuaacaaaagacucauaaua

SEQ ID NO: 6698 - RNA, 21 nt, Artificial Sequence
  Ebola virus siRNA sense strand
uuaacaaaagacucauaauau

SEQ ID NO: 6699 - RNA, 21 nt, Artificial Sequence
  Ebola virus siRNA sense strand
uaacaaaagacucauaauaua

SEQ ID NO: 6700 - RNA, 21 nt, Artificial Sequence
  Ebola virus siRNA sense strand
aacaaaagacucauaauauac

SEQ ID NO: 6701 - RNA, 21 nt, Artificial Sequence
  Ebola virus siRNA sense strand
acaaaagacucauaauauacu

SEQ ID NO: 6702 - RNA, 21 nt, Artificial Sequence
  Ebola virus siRNA sense strand
caaaagacucauaauauacuu

SEQ ID NO: 6703 - RNA, 21 nt, Artificial Sequence
  Ebola virus siRNA sense strand
aaaagacucauaauauacuug

SEQ ID NO: 6704 - RNA, 21 nt, Artificial Sequence
  Ebola virus siRNA sense strand
aaagacucauaauauacuugu

SEQ ID NO: 6705 - RNA, 21 nt, Artificial Sequence
  Ebola virus siRNA sense strand
aagacucauaauauacuuguu

SEQ ID NO: 6706 - RNA, 21 nt, Artificial Sequence
  Ebola virus siRNA sense strand
agacucauaauauacuuguuu

SEQ ID NO: 6707 - RNA, 21 nt, Artificial Sequence
  Ebola virus siRNA sense strand
gacucauaauauacuuguuuu

SEQ ID NO: 6708 - RNA, 21 nt, Artificial Sequence
  Ebola virus siRNA sense strand
acucauaauauacuuguuuuu

SEQ ID NO: 6709 - RNA, 21 nt, Artificial Sequence
  Ebola virus siRNA sense strand
cucauaauauacuuguuuuua

SEQ ID NO: 6710 - RNA, 21 nt, Artificial Sequence
  Ebola virus siRNA sense strand
ucauaauauacuuguuuuuaa

SEQ ID NO: 6711 - RNA, 21 nt, Artificial Sequence
  Ebola virus siRNA sense strand
cauaauauacuuguuuuuaaa

SEQ ID NO: 6712 - RNA, 21 nt, Artificial Sequence
  Ebola virus siRNA sense strand
auaauauacuuguuuuuaaag

SEQ ID NO: 6713 - RNA, 21 nt, Artificial Sequence
  Ebola virus siRNA sense strand
uaauauacuuguuuuuaaagg

SEQ ID NO: 6714 - RNA, 21 nt, Artificial Sequence
  Ebola virus siRNA sense strand
aauauacuuguuuuuaaagga

SEQ ID NO: 6715 - RNA, 21 nt, Artificial Sequence
  Ebola virus siRNA sense strand
auauacuuguuuuuaaaggau

SEQ ID NO: 6716 - RNA, 21 nt, Artificial Sequence
  Ebola virus siRNA sense strand
uauacuuguuuuuaaaggauu

SEQ ID NO: 6717 - RNA, 21 nt, Artificial Sequence
  Ebola virus siRNA sense strand
auacuuguuuuuaaaggauug

SEQ ID NO: 6718 - RNA, 21 nt, Artificial Sequence
  Ebola virus siRNA sense strand
uacuuguuuuuaaaggauuga

SEQ ID NO: 6719 - RNA, 21 nt, Artificial Sequence
  Ebola virus siRNA sense strand
acuuguuuuuaaaggauugau

SEQ ID NO: 6720 - RNA, 21 nt, Artificial Sequence
  Ebola virus siRNA sense strand
cuuguuuuuaaaggauugauu

SEQ ID NO: 6721 - RNA, 21 nt, Artificial Sequence
  Ebola virus siRNA sense strand
uuguuuuuaaaggauugauug

SEQ ID NO: 6722 - RNA, 21 nt, Artificial Sequence
  Ebola virus siRNA sense strand
uguuuuuaaaggauugauuga

SEQ ID NO: 6723 - RNA, 21 nt, Artificial Sequence
  Ebola virus siRNA sense strand
guuuuuaaaggauugauugau

SEQ ID NO: 6724 - RNA, 21 nt, Artificial Sequence
  Ebola virus siRNA sense strand
uuuuuaaaggauugauugaug

SEQ ID NO: 6725 - RNA, 21 nt, Artificial Sequence
  Ebola virus siRNA sense strand
uuuuaaaggauugauugauga

SEQ ID NO: 6726 - RNA, 21 nt, Artificial Sequence
  Ebola virus siRNA sense strand
uuuaaaggauugauugaugaa

SEQ ID NO: 6727 - RNA, 21 nt, Artificial Sequence
  Ebola virus siRNA sense strand
uuaaaggauugauugaugaaa

SEQ ID NO: 6728 - RNA, 21 nt, Artificial Sequence
  Ebola virus siRNA sense strand
uaaaggauugauugaugaaag

SEQ ID NO: 6729 - RNA, 21 nt, Artificial Sequence
  Ebola virus siRNA sense strand
aaaggauugauugaugaaaga

SEQ ID NO: 6730 - RNA, 21 nt, Artificial Sequence
  Ebola virus siRNA sense strand
aaggauugauugaugaaagau

SEQ ID NO: 6731 - RNA, 21 nt, Artificial Sequence
  Ebola virus siRNA sense strand
aggauugauugaugaaagauc

SEQ ID NO: 6732 - RNA, 21 nt, Artificial Sequence
  Ebola virus siRNA sense strand
ggauugauugaugaaagauca

SEQ ID NO: 6733 - RNA, 21 nt, Artificial Sequence
  Ebola virus siRNA sense strand
gauugauugaugaaagaucau

SEQ ID NO: 6734 - RNA, 21 nt, Artificial Sequence
  Ebola virus siRNA sense strand
auugauugaugaaagaucaua

SEQ ID NO: 6735 - RNA, 21 nt, Artificial Sequence
  Ebola virus siRNA sense strand
uugauugaugaaagaucauaa

SEQ ID NO: 6736 - RNA, 21 nt, Artificial Sequence
  Ebola virus siRNA sense strand
ugauugaugaaagaucauaac

SEQ ID NO: 6737 - RNA, 21 nt, Artificial Sequence
  Ebola virus siRNA sense strand
gauugaugaaagaucauaacu

SEQ ID NO: 6738 - RNA, 21 nt, Artificial Sequence
  Ebola virus siRNA sense strand
auugaugaaagaucauaacua

SEQ ID NO: 6739 - RNA, 21 nt, Artificial Sequence
  Ebola virus siRNA sense strand
uugaugaaagaucauaacuaa

SEQ ID NO: 6740 - RNA, 21 nt, Artificial Sequence
  Ebola virus siRNA sense strand
ugaugaaagaucauaacuaau

SEQ ID NO: 6741 - RNA, 21 nt, Artificial Sequence
  Ebola virus siRNA sense strand
gaugaaagaucauaacuaaua

SEQ ID NO: 6742 - RNA, 21 nt, Artificial Sequence
  Ebola virus siRNA sense strand
augaaagaucauaacuaauaa

SEQ ID NO: 6743 - RNA, 21 nt, Artificial Sequence
  Ebola virus siRNA sense strand
ugaaagaucauaacuaauaac

SEQ ID NO: 6744 - RNA, 21 nt, Artificial Sequence
  Ebola virus siRNA sense strand
gaaagaucauaacuaauaaca

SEQ ID NO: 6745 - RNA, 21 nt, Artificial Sequence
  Ebola virus siRNA sense strand
aaagaucauaacuaauaacau

SEQ ID NO: 6746 - RNA, 21 nt, Artificial Sequence
  Ebola virus siRNA sense strand
aagaucauaacuaauaacauu

SEQ ID NO: 6747 - RNA, 21 nt, Artificial Sequence
  Ebola virus siRNA sense strand
agaucauaacuaauaacauua

SEQ ID NO: 6748 - RNA, 21 nt, Artificial Sequence
  Ebola virus siRNA sense strand
gaucauaacuaauaacauuac

SEQ ID NO: 6749 - RNA, 21 nt, Artificial Sequence
  Ebola virus siRNA sense strand
aucauaacuaauaacauuaca

SEQ ID NO: 6750 - RNA, 21 nt, Artificial Sequence
  Ebola virus siRNA sense strand
ucauaacuaauaacauuacaa

SEQ ID NO: 6751 - RNA, 21 nt, Artificial Sequence
  Ebola virus siRNA sense strand
cauaacuaauaacauuacaaa

SEQ ID NO: 6752 - RNA, 21 nt, Artificial Sequence
  Ebola virus siRNA sense strand
auaacuaauaacauuacaaau

SEQ ID NO: 6753 - RNA, 21 nt, Artificial Sequence
  Ebola virus siRNA sense strand
uaacuaauaacauuacaaaua

SEQ ID NO: 6754 - RNA, 21 nt, Artificial Sequence
  Ebola virus siRNA sense strand
aacuaauaacauuacaaauaa

SEQ ID NO: 6755 - RNA, 21 nt, Artificial Sequence
  Ebola virus siRNA sense strand
acuaauaacauuacaaauaau

SEQ ID NO: 6756 - RNA, 21 nt, Artificial Sequence
  Ebola virus siRNA sense strand
cuaauaacauuacaaauaauc

SEQ ID NO: 6757 - RNA, 21 nt, Artificial Sequence
  Ebola virus siRNA sense strand
uaauaacauuacaaauaaucc

SEQ ID NO: 6758 - RNA, 21 nt, Artificial Sequence
  Ebola virus siRNA sense strand
aauaacauuacaaauaauccu

SEQ ID NO: 6759 - RNA, 21 nt, Artificial Sequence
  Ebola virus siRNA sense strand
auaacauuacaaauaauccua

SEQ ID NO: 6760 - RNA, 21 nt, Artificial Sequence
  Ebola virus siRNA sense strand
uaacauuacaaauaauccuac

SEQ ID NO: 6761 - RNA, 21 nt, Artificial Sequence
  Ebola virus siRNA sense strand
aacauuacaaauaauccuacu

SEQ ID NO: 6762 - RNA, 21 nt, Artificial Sequence
  Ebola virus siRNA sense strand
acauuacaaauaauccuacua

SEQ ID NO: 6763 - RNA, 21 nt, Artificial Sequence
  Ebola virus siRNA sense strand
cauuacaaauaauccuacuau

SEQ ID NO: 6764 - RNA, 21 nt, Artificial Sequence
  Ebola virus siRNA sense strand
auuacaaauaauccuacuaua

SEQ ID NO: 6765 - RNA, 21 nt, Artificial Sequence
  Ebola virus siRNA sense strand
uuacaaauaauccuacuauaa

SEQ ID NO: 6766 - RNA, 21 nt, Artificial Sequence
  Ebola virus siRNA sense strand
uacaaauaauccuacuauaau

SEQ ID NO: 6767 - RNA, 21 nt, Artificial Sequence
  Ebola virus siRNA sense strand
acaaauaauccuacuauaauc

SEQ ID NO: 6768 - RNA, 21 nt, Artificial Sequence
  Ebola virus siRNA sense strand
caaauaauccuacuauaauca

SEQ ID NO: 6769 - RNA, 21 nt, Artificial Sequence
  Ebola virus siRNA sense strand
aaauaauccuacuauaaucaa

SEQ ID NO: 6770 - RNA, 21 nt, Artificial Sequence
  Ebola virus siRNA sense strand
aauaauccuacuauaaucaau

SEQ ID NO: 6771 - RNA, 21 nt, Artificial Sequence
  Ebola virus siRNA sense strand
auaauccuacuauaaucaaua

SEQ ID NO: 6772 - RNA, 21 nt, Artificial Sequence
  Ebola virus siRNA sense strand
uaauccuacuauaaucaauac

SEQ ID NO: 6773 - RNA, 21 nt, Artificial Sequence
  Ebola virus siRNA sense strand
aauccuacuauaaucaauacg

SEQ ID NO: 6774 - RNA, 21 nt, Artificial Sequence
  Ebola virus siRNA sense strand
auccuacuauaaucaauacgg

SEQ ID NO: 6775 - RNA, 21 nt, Artificial Sequence
  Ebola virus siRNA sense strand
uccuacuauaaucaauacggu

SEQ ID NO: 6776 - RNA, 21 nt, Artificial Sequence
  Ebola virus siRNA sense strand
ccuacuauaaucaauacggug

SEQ ID NO: 6777 - RNA, 21 nt, Artificial Sequence
  Ebola virus siRNA sense strand
cuacuauaaucaauacgguga

SEQ ID NO: 6778 - RNA, 21 nt, Artificial Sequence
  Ebola virus siRNA sense strand
uacuauaaucaauacggugau

SEQ ID NO: 6779 - RNA, 21 nt, Artificial Sequence
  Ebola virus siRNA sense strand
acuauaaucaauacggugauu

SEQ ID NO: 6780 - RNA, 21 nt, Artificial Sequence
  Ebola virus siRNA sense strand
cuauaaucaauacggugauuc

SEQ ID NO: 6781 - RNA, 21 nt, Artificial Sequence
  Ebola virus siRNA sense strand
uauaaucaauacggugauuca

SEQ ID NO: 6782 - RNA, 21 nt, Artificial Sequence
  Ebola virus siRNA sense strand
auaaucaauacggugauucaa

SEQ ID NO: 6783 - RNA, 21 nt, Artificial Sequence
  Ebola virus siRNA sense strand
uaaucaauacggugauucaaa

SEQ ID NO: 6784 - RNA, 21 nt, Artificial Sequence
  Ebola virus siRNA sense strand
aaucaauacggugauucaaau

SEQ ID NO: 6785 - RNA, 21 nt, Artificial Sequence
  Ebola virus siRNA sense strand
aucaauacggugauucaaaug

SEQ ID NO: 6786 - RNA, 21 nt, Artificial Sequence
  Ebola virus siRNA sense strand
ucaauacggugauucaaaugu

SEQ ID NO: 6787 - RNA, 21 nt, Artificial Sequence
  Ebola virus siRNA sense strand
caauacggugauucaaauguu

SEQ ID NO: 6788 - RNA, 21 nt, Artificial Sequence
  Ebola virus siRNA sense strand
aauacggugauucaaauguua

SEQ ID NO: 6789 - RNA, 21 nt, Artificial Sequence
  Ebola virus siRNA sense strand
auacggugauucaaauguuaa

SEQ ID NO: 6790 - RNA, 21 nt, Artificial Sequence
  Ebola virus siRNA sense strand
uacggugauucaaauguuaau

SEQ ID NO: 6791 - RNA, 21 nt, Artificial Sequence
  Ebola virus siRNA sense strand
acggugauucaaauguuaauc

SEQ ID NO: 6792 - RNA, 21 nt, Artificial Sequence
  Ebola virus siRNA sense strand
cggugauucaaauguuaaucu

SEQ ID NO: 6793 - RNA, 21 nt, Artificial Sequence
  Ebola virus siRNA sense strand
ggugauucaaauguuaaucuu

SEQ ID NO: 6794 - RNA, 21 nt, Artificial Sequence
  Ebola virus siRNA sense strand
gugauucaaauguuaaucuuu

SEQ ID NO: 6795 - RNA, 21 nt, Artificial Sequence
  Ebola virus siRNA sense strand
ugauucaaauguuaaucuuuc

SEQ ID NO: 6796 - RNA, 21 nt, Artificial Sequence
  Ebola virus siRNA sense strand
gauucaaauguuaaucuuucu

SEQ ID NO: 6797 - RNA, 21 nt, Artificial Sequence
  Ebola virus siRNA sense strand
auucaaauguuaaucuuucuc

SEQ ID NO: 6798 - RNA, 21 nt, Artificial Sequence
  Ebola virus siRNA sense strand
uucaaauguuaaucuuucuca

SEQ ID NO: 6799 - RNA, 21 nt, Artificial Sequence
  Ebola virus siRNA sense strand
ucaaauguuaaucuuucucau

SEQ ID NO: 6800 - RNA, 21 nt, Artificial Sequence
  Ebola virus siRNA sense strand
caaauguuaaucuuucucauu

SEQ ID NO: 6801 - RNA, 21 nt, Artificial Sequence
  Ebola virus siRNA sense strand
aaauguuaaucuuucucauug

SEQ ID NO: 6802 - RNA, 21 nt, Artificial Sequence
  Ebola virus siRNA sense strand
aauguuaaucuuucucauugc

SEQ ID NO: 6803 - RNA, 21 nt, Artificial Sequence
  Ebola virus siRNA sense strand
auguuaaucuuucucauugca

SEQ ID NO: 6804 - RNA, 21 nt, Artificial Sequence
  Ebola virus siRNA sense strand
uguuaaucuuucucauugcac

SEQ ID NO: 6805 - RNA, 21 nt, Artificial Sequence
  Ebola virus siRNA sense strand
guuaaucuuucucauugcaca

SEQ ID NO: 6806 - RNA, 21 nt, Artificial Sequence
  Ebola virus siRNA sense strand
uuaaucuuucucauugcacau

SEQ ID NO: 6807 - RNA, 21 nt, Artificial Sequence
  Ebola virus siRNA sense strand
uaaucuuucucauugcacaua

SEQ ID NO: 6808 - RNA, 21 nt, Artificial Sequence
  Ebola virus siRNA sense strand
aaucuuucucauugcacauac

SEQ ID NO: 6809 - RNA, 21 nt, Artificial Sequence
  Ebola virus siRNA sense strand
aucuuucucauugcacauacu

SEQ ID NO: 6810 - RNA, 21 nt, Artificial Sequence
  Ebola virus siRNA sense strand
ucuuucucauugcacauacuu

SEQ ID NO: 6811 - RNA, 21 nt, Artificial Sequence
  Ebola virus siRNA sense strand
cuuucucauugcacauacuuu

SEQ ID NO: 6812 - RNA, 21 nt, Artificial Sequence
  Ebola virus siRNA sense strand
uuucucauugcacauacuuuu

SEQ ID NO: 6813 - RNA, 21 nt, Artificial Sequence
  Ebola virus siRNA sense strand
uucucauugcacauacuuuuu

SEQ ID NO: 6814 - RNA, 21 nt, Artificial Sequence
  Ebola virus siRNA sense strand
ucucauugcacauacuuuuug

SEQ ID NO: 6815 - RNA, 21 nt, Artificial Sequence
  Ebola virus siRNA sense strand
cucauugcacauacuuuuugc

SEQ ID NO: 6816 - RNA, 21 nt, Artificial Sequence
  Ebola virus siRNA sense strand
ucauugcacauacuuuuugcc

SEQ ID NO: 6817 - RNA, 21 nt, Artificial Sequence
  Ebola virus siRNA sense strand
cauugcacauacuuuuugccc

SEQ ID NO: 6818 - RNA, 21 nt, Artificial Sequence
  Ebola virus siRNA sense strand
auugcacauacuuuuugcccu

SEQ ID NO: 6819 - RNA, 21 nt, Artificial Sequence
  Ebola virus siRNA sense strand
uugcacauacuuuuugcccuu

SEQ ID NO: 6820 - RNA, 21 nt, Artificial Sequence
  Ebola virus siRNA sense strand
ugcacauacuuuuugcccuua

SEQ ID NO: 6821 - RNA, 21 nt, Artificial Sequence
  Ebola virus siRNA sense strand
gcacauacuuuuugcccuuau

SEQ ID NO: 6822 - RNA, 21 nt, Artificial Sequence
  Ebola virus siRNA sense strand
cacauacuuuuugcccuuauc

SEQ ID NO: 6823 - RNA, 21 nt, Artificial Sequence
  Ebola virus siRNA sense strand
acauacuuuuugcccuuaucc

SEQ ID NO: 6824 - RNA, 21 nt, Artificial Sequence
  Ebola virus siRNA sense strand
cauacuuuuugcccuuauccu

SEQ ID NO: 6825 - RNA, 21 nt, Artificial Sequence
  Ebola virus siRNA sense strand
auacuuuuugcccuuauccuc

SEQ ID NO: 6826 - RNA, 21 nt, Artificial Sequence
  Ebola virus siRNA sense strand
uacuuuuugcccuuauccuca

SEQ ID NO: 6827 - RNA, 21 nt, Artificial Sequence
  Ebola virus siRNA sense strand
acuuuuugcccuuauccucaa

SEQ ID NO: 6828 - RNA, 21 nt, Artificial Sequence
  Ebola virus siRNA sense strand
cuuuuugcccuuauccucaaa

SEQ ID NO: 6829 - RNA, 21 nt, Artificial Sequence
  Ebola virus siRNA sense strand
uuuuugcccuuauccucaaau

SEQ ID NO: 6830 - RNA, 21 nt, Artificial Sequence
  Ebola virus siRNA sense strand
uuuugcccuuauccucaaauu

SEQ ID NO: 6831 - RNA, 21 nt, Artificial Sequence
  Ebola virus siRNA sense strand
uuugcccuuauccucaaauug

SEQ ID NO: 6832 - RNA, 21 nt, Artificial Sequence
  Ebola virus siRNA sense strand
uugcccuuauccucaaauugc

SEQ ID NO: 6833 - RNA, 21 nt, Artificial Sequence
  Ebola virus siRNA sense strand
ugcccuuauccucaaauugcc

SEQ ID NO: 6834 - RNA, 21 nt, Artificial Sequence
  Ebola virus siRNA sense strand
gcccuuauccucaaauugccu

SEQ ID NO: 6835 - RNA, 21 nt, Artificial Sequence
  Ebola virus siRNA sense strand
cccuuauccucaaauugccug

SEQ ID NO: 6836 - RNA, 21 nt, Artificial Sequence
  Ebola virus siRNA sense strand
ccuuauccucaaauugccugc

SEQ ID NO: 6837 - RNA, 21 nt, Artificial Sequence
  Ebola virus siRNA sense strand
cuuauccucaaauugccugca

SEQ ID NO: 6838 - RNA, 21 nt, Artificial Sequence
  Ebola virus siRNA sense strand
uuauccucaaauugccugcau

SEQ ID NO: 6839 - RNA, 21 nt, Artificial Sequence
  Ebola virus siRNA sense strand
uauccucaaauugccugcaug

SEQ ID NO: 6840 - RNA, 21 nt, Artificial Sequence
  Ebola virus siRNA sense strand
auccucaaauugccugcaugc

SEQ ID NO: 6841 - RNA, 21 nt, Artificial Sequence
  Ebola virus siRNA sense strand
uccucaaauugccugcaugcu

SEQ ID NO: 6842 - RNA, 21 nt, Artificial Sequence
  Ebola virus siRNA sense strand
ccucaaauugccugcaugcuu

SEQ ID NO: 6843 - RNA, 21 nt, Artificial Sequence
  Ebola virus siRNA sense strand
cucaaauugccugcaugcuua

SEQ ID NO: 6844 - RNA, 21 nt, Artificial Sequence
  Ebola virus siRNA sense strand
ucaaauugccugcaugcuuac

SEQ ID NO: 6845 - RNA, 21 nt, Artificial Sequence
  Ebola virus siRNA sense strand
caaauugccugcaugcuuaca

SEQ ID NO: 6846 - RNA, 21 nt, Artificial Sequence
  Ebola virus siRNA sense strand
aaauugccugcaugcuuacau

SEQ ID NO: 6847 - RNA, 21 nt, Artificial Sequence
  Ebola virus siRNA sense strand
aauugccugcaugcuuacauc

SEQ ID NO: 6848 - RNA, 21 nt, Artificial Sequence
  Ebola virus siRNA sense strand
auugccugcaugcuuacaucu

SEQ ID NO: 6849 - RNA, 21 nt, Artificial Sequence
  Ebola virus siRNA sense strand
uugccugcaugcuuacaucug

SEQ ID NO: 6850 - RNA, 21 nt, Artificial Sequence
  Ebola virus siRNA sense strand
ugccugcaugcuuacaucuga

SEQ ID NO: 6851 - RNA, 21 nt, Artificial Sequence
  Ebola virus siRNA sense strand
gccugcaugcuuacaucugag

SEQ ID NO: 6852 - RNA, 21 nt, Artificial Sequence
  Ebola virus siRNA sense strand
ccugcaugcuuacaucugagg

SEQ ID NO: 6853 - RNA, 21 nt, Artificial Sequence
  Ebola virus siRNA sense strand
cugcaugcuuacaucugagga

SEQ ID NO: 6854 - RNA, 21 nt, Artificial Sequence
  Ebola virus siRNA sense strand
ugcaugcuuacaucugaggau

SEQ ID NO: 6855 - RNA, 21 nt, Artificial Sequence
  Ebola virus siRNA sense strand
gcaugcuuacaucugaggaua

SEQ ID NO: 6856 - RNA, 21 nt, Artificial Sequence
  Ebola virus siRNA sense strand
caugcuuacaucugaggauag

SEQ ID NO: 6857 - RNA, 21 nt, Artificial Sequence
  Ebola virus siRNA sense strand
augcuuacaucugaggauagc

SEQ ID NO: 6858 - RNA, 21 nt, Artificial Sequence
  Ebola virus siRNA sense strand
ugcuuacaucugaggauagcc

SEQ ID NO: 6859 - RNA, 21 nt, Artificial Sequence
  Ebola virus siRNA sense strand
gcuuacaucugaggauagcca

SEQ ID NO: 6860 - RNA, 21 nt, Artificial Sequence
  Ebola virus siRNA sense strand
cuuacaucugaggauagccag

SEQ ID NO: 6861 - RNA, 21 nt, Artificial Sequence
  Ebola virus siRNA sense strand
uuacaucugaggauagccagu

SEQ ID NO: 6862 - RNA, 21 nt, Artificial Sequence
  Ebola virus siRNA sense strand
uacaucugaggauagccagug

SEQ ID NO: 6863 - RNA, 21 nt, Artificial Sequence
  Ebola virus siRNA sense strand
acaucugaggauagccagugu

SEQ ID NO: 6864 - RNA, 21 nt, Artificial Sequence
  Ebola virus siRNA sense strand
caucugaggauagccagugug

SEQ ID NO: 6865 - RNA, 21 nt, Artificial Sequence
  Ebola virus siRNA sense strand
aucugaggauagccaguguga

SEQ ID NO: 6866 - RNA, 21 nt, Artificial Sequence
  Ebola virus siRNA sense strand
ucugaggauagccagugugac

SEQ ID NO: 6867 - RNA, 21 nt, Artificial Sequence
  Ebola virus siRNA sense strand
cugaggauagccagugugacu

SEQ ID NO: 6868 - RNA, 21 nt, Artificial Sequence
  Ebola virus siRNA sense strand
ugaggauagccagugugacuu

SEQ ID NO: 6869 - RNA, 21 nt, Artificial Sequence
  Ebola virus siRNA sense strand
gaggauagccagugugacuug

SEQ ID NO: 6870 - RNA, 21 nt, Artificial Sequence
  Ebola virus siRNA sense strand
aggauagccagugugacuugg

SEQ ID NO: 6871 - RNA, 21 nt, Artificial Sequence
  Ebola virus siRNA sense strand
ggauagccagugugacuugga

SEQ ID NO: 6872 - RNA, 21 nt, Artificial Sequence
  Ebola virus siRNA sense strand
gauagccagugugacuuggau

SEQ ID NO: 6873 - RNA, 21 nt, Artificial Sequence
  Ebola virus siRNA sense strand
auagccagugugacuuggauu

SEQ ID NO: 6874 - RNA, 21 nt, Artificial Sequence
  Ebola virus siRNA sense strand
uagccagugugacuuggauug

SEQ ID NO: 6875 - RNA, 21 nt, Artificial Sequence
  Ebola virus siRNA sense strand
agccagugugacuuggauugg

SEQ ID NO: 6876 - RNA, 21 nt, Artificial Sequence
  Ebola virus siRNA sense strand
gccagugugacuuggauugga

SEQ ID NO: 6877 - RNA, 21 nt, Artificial Sequence
  Ebola virus siRNA sense strand
ccagugugacuuggauuggaa

SEQ ID NO: 6878 - RNA, 21 nt, Artificial Sequence
  Ebola virus siRNA sense strand
cagugugacuuggauuggaaa

SEQ ID NO: 6879 - RNA, 21 nt, Artificial Sequence
  Ebola virus siRNA sense strand
agugugacuuggauuggaaau

SEQ ID NO: 6880 - RNA, 21 nt, Artificial Sequence
  Ebola virus siRNA sense strand
gugugacuuggauuggaaaug

SEQ ID NO: 6881 - RNA, 21 nt, Artificial Sequence
  Ebola virus siRNA sense strand
ugugacuuggauuggaaaugu

SEQ ID NO: 6882 - RNA, 21 nt, Artificial Sequence
  Ebola virus siRNA sense strand
gugacuuggauuggaaaugug

SEQ ID NO: 6883 - RNA, 21 nt, Artificial Sequence
  Ebola virus siRNA sense strand
ugacuuggauuggaaaugugg

SEQ ID NO: 6884 - RNA, 21 nt, Artificial Sequence
  Ebola virus siRNA sense strand
gacuuggauuggaaaugugga

SEQ ID NO: 6885 - RNA, 21 nt, Artificial Sequence
  Ebola virus siRNA sense strand
acuuggauuggaaauguggag

SEQ ID NO: 6886 - RNA, 21 nt, Artificial Sequence
  Ebola virus siRNA sense strand
cuuggauuggaaauguggaga

SEQ ID NO: 6887 - RNA, 21 nt, Artificial Sequence
  Ebola virus siRNA sense strand
uuggauuggaaauguggagaa

SEQ ID NO: 6888 - RNA, 21 nt, Artificial Sequence
  Ebola virus siRNA sense strand
uggauuggaaauguggagaaa

SEQ ID NO: 6889 - RNA, 21 nt, Artificial Sequence
  Ebola virus siRNA sense strand
ggauuggaaauguggagaaaa

SEQ ID NO: 6890 - RNA, 21 nt, Artificial Sequence
  Ebola virus siRNA sense strand
gauuggaaauguggagaaaaa

SEQ ID NO: 6891 - RNA, 21 nt, Artificial Sequence
  Ebola virus siRNA sense strand
auuggaaauguggagaaaaaa

SEQ ID NO: 6892 - RNA, 21 nt, Artificial Sequence
  Ebola virus siRNA sense strand
uuggaaauguggagaaaaaau

SEQ ID NO: 6893 - RNA, 21 nt, Artificial Sequence
  Ebola virus siRNA sense strand
uggaaauguggagaaaaaauc

SEQ ID NO: 6894 - RNA, 21 nt, Artificial Sequence
  Ebola virus siRNA sense strand
ggaaauguggagaaaaaaucg

SEQ ID NO: 6895 - RNA, 21 nt, Artificial Sequence
  Ebola virus siRNA sense strand
gaaauguggagaaaaaaucgg

SEQ ID NO: 6896 - RNA, 21 nt, Artificial Sequence
  Ebola virus siRNA sense strand
aaauguggagaaaaaaucggg

SEQ ID NO: 6897 - RNA, 21 nt, Artificial Sequence
  Ebola virus siRNA sense strand
aauguggagaaaaaaucggga

SEQ ID NO: 6898 - RNA, 21 nt, Artificial Sequence
  Ebola virus siRNA sense strand
auguggagaaaaaaucgggac

SEQ ID NO: 6899 - RNA, 21 nt, Artificial Sequence
  Ebola virus siRNA sense strand
uguggagaaaaaaucgggacc

SEQ ID NO: 6900 - RNA, 21 nt, Artificial Sequence
  Ebola virus siRNA sense strand
guggagaaaaaaucgggaccc

SEQ ID NO: 6901 - RNA, 21 nt, Artificial Sequence
  Ebola virus siRNA sense strand
uggagaaaaaaucgggaccca

SEQ ID NO: 6902 - RNA, 21 nt, Artificial Sequence
  Ebola virus siRNA sense strand
ggagaaaaaaucgggacccau

SEQ ID NO: 6903 - RNA, 21 nt, Artificial Sequence
  Ebola virus siRNA sense strand
gagaaaaaaucgggacccauu

SEQ ID NO: 6904 - RNA, 21 nt, Artificial Sequence
  Ebola virus siRNA sense strand
agaaaaaaucgggacccauuu

SEQ ID NO: 6905 - RNA, 21 nt, Artificial Sequence
  Ebola virus siRNA sense strand
gaaaaaaucgggacccauuuc

SEQ ID NO: 6906 - RNA, 21 nt, Artificial Sequence
  Ebola virus siRNA sense strand
aaaaaaucgggacccauuucu

SEQ ID NO: 6907 - RNA, 21 nt, Artificial Sequence
  Ebola virus siRNA sense strand
aaaaaucgggacccauuucua

SEQ ID NO: 6908 - RNA, 21 nt, Artificial Sequence
  Ebola virus siRNA sense strand
aaaaucgggacccauuucuag

SEQ ID NO: 6909 - RNA, 21 nt, Artificial Sequence
  Ebola virus siRNA sense strand
aaaucgggacccauuucuagg

SEQ ID NO: 6910 - RNA, 21 nt, Artificial Sequence
  Ebola virus siRNA sense strand
aaucgggacccauuucuaggu

SEQ ID NO: 6911 - RNA, 21 nt, Artificial Sequence
  Ebola virus siRNA sense strand
aucgggacccauuucuagguu

SEQ ID NO: 6912 - RNA, 21 nt, Artificial Sequence
  Ebola virus siRNA sense strand
ucgggacccauuucuagguug

SEQ ID NO: 6913 - RNA, 21 nt, Artificial Sequence
  Ebola virus siRNA sense strand
cgggacccauuucuagguugu

SEQ ID NO: 6914 - RNA, 21 nt, Artificial Sequence
  Ebola virus siRNA sense strand
gggacccauuucuagguuguu

SEQ ID NO: 6915 - RNA, 21 nt, Artificial Sequence
  Ebola virus siRNA sense strand
ggacccauuucuagguuguuc

SEQ ID NO: 6916 - RNA, 21 nt, Artificial Sequence
  Ebola virus siRNA sense strand
gacccauuucuagguuguuca

SEQ ID NO: 6917 - RNA, 21 nt, Artificial Sequence
  Ebola virus siRNA sense strand
acccauuucuagguuguucac

SEQ ID NO: 6918 - RNA, 21 nt, Artificial Sequence
  Ebola virus siRNA sense strand
cccauuucuagguuguucaca

SEQ ID NO: 6919 - RNA, 21 nt, Artificial Sequence
  Ebola virus siRNA sense strand
ccauuucuagguuguucacaa

SEQ ID NO: 6920 - RNA, 21 nt, Artificial Sequence
  Ebola virus siRNA sense strand
cauuucuagguuguucacaau

SEQ ID NO: 6921 - RNA, 21 nt, Artificial Sequence
  Ebola virus siRNA sense strand
auuucuagguuguucacaauc

SEQ ID NO: 6922 - RNA, 21 nt, Artificial Sequence
  Ebola virus siRNA sense strand
uuucuagguuguucacaaucc

SEQ ID NO: 6923 - RNA, 21 nt, Artificial Sequence
  Ebola virus siRNA sense strand
uucuagguuguucacaaucca

SEQ ID NO: 6924 - RNA, 21 nt, Artificial Sequence
  Ebola virus siRNA sense strand
ucuagguuguucacaauccaa

SEQ ID NO: 6925 - RNA, 21 nt, Artificial Sequence
  Ebola virus siRNA sense strand
cuagguuguucacaauccaag

SEQ ID NO: 6926 - RNA, 21 nt, Artificial Sequence
  Ebola virus siRNA sense strand
uagguuguucacaauccaagu

SEQ ID NO: 6927 - RNA, 21 nt, Artificial Sequence
  Ebola virus siRNA sense strand
agguuguucacaauccaagua

SEQ ID NO: 6928 - RNA, 21 nt, Artificial Sequence
  Ebola virus siRNA sense strand
gguuguucacaauccaaguac

SEQ ID NO: 6929 - RNA, 21 nt, Artificial Sequence
  Ebola virus siRNA sense strand
guuguucacaauccaaguaca

SEQ ID NO: 6930 - RNA, 21 nt, Artificial Sequence
  Ebola virus siRNA sense strand
uuguucacaauccaaguacag

SEQ ID NO: 6931 - RNA, 21 nt, Artificial Sequence
  Ebola virus siRNA sense strand
uguucacaauccaaguacaga

SEQ ID NO: 6932 - RNA, 21 nt, Artificial Sequence
  Ebola virus siRNA sense strand
guucacaauccaaguacagac

SEQ ID NO: 6933 - RNA, 21 nt, Artificial Sequence
  Ebola virus siRNA sense strand
uucacaauccaaguacagaca

SEQ ID NO: 6934 - RNA, 21 nt, Artificial Sequence
  Ebola virus siRNA sense strand
ucacaauccaaguacagacau

SEQ ID NO: 6935 - RNA, 21 nt, Artificial Sequence
  Ebola virus siRNA sense strand
cacaauccaaguacagacauu

SEQ ID NO: 6936 - RNA, 21 nt, Artificial Sequence
  Ebola virus siRNA sense strand
acaauccaaguacagacauug

SEQ ID NO: 6937 - RNA, 21 nt, Artificial Sequence
  Ebola virus siRNA sense strand
caauccaaguacagacauugc

SEQ ID NO: 6938 - RNA, 21 nt, Artificial Sequence
  Ebola virus siRNA sense strand
aauccaaguacagacauugcc

SEQ ID NO: 6939 - RNA, 21 nt, Artificial Sequence
  Ebola virus siRNA sense strand
auccaaguacagacauugccc

SEQ ID NO: 6940 - RNA, 21 nt, Artificial Sequence
  Ebola virus siRNA sense strand
uccaaguacagacauugcccu

SEQ ID NO: 6941 - RNA, 21 nt, Artificial Sequence
  Ebola virus siRNA sense strand
ccaaguacagacauugcccuu

SEQ ID NO: 6942 - RNA, 21 nt, Artificial Sequence
  Ebola virus siRNA sense strand
caaguacagacauugcccuuc

SEQ ID NO: 6943 - RNA, 21 nt, Artificial Sequence
  Ebola virus siRNA sense strand
aaguacagacauugcccuucu

SEQ ID NO: 6944 - RNA, 21 nt, Artificial Sequence
  Ebola virus siRNA sense strand
aguacagacauugcccuucua

SEQ ID NO: 6945 - RNA, 21 nt, Artificial Sequence
  Ebola virus siRNA sense strand
guacagacauugcccuucuaa

SEQ ID NO: 6946 - RNA, 21 nt, Artificial Sequence
  Ebola virus siRNA sense strand
uacagacauugcccuucuaau

SEQ ID NO: 6947 - RNA, 21 nt, Artificial Sequence
  Ebola virus siRNA sense strand
acagacauugcccuucuaauu

SEQ ID NO: 6948 - RNA, 21 nt, Artificial Sequence
  Ebola virus siRNA sense strand
cagacauugcccuucuaauua

SEQ ID NO: 6949 - RNA, 21 nt, Artificial Sequence
  Ebola virus siRNA sense strand
agacauugcccuucuaauuaa

SEQ ID NO: 6950 - RNA, 21 nt, Artificial Sequence
  Ebola virus siRNA sense strand
gacauugcccuucuaauuaag

SEQ ID NO: 6951 - RNA, 21 nt, Artificial Sequence
  Ebola virus siRNA sense strand
acauugcccuucuaauuaaga

SEQ ID NO: 6952 - RNA, 21 nt, Artificial Sequence
  Ebola virus siRNA sense strand
cauugcccuucuaauuaagaa

SEQ ID NO: 6953 - RNA, 21 nt, Artificial Sequence
  Ebola virus siRNA sense strand
auugcccuucuaauuaagaaa

SEQ ID NO: 6954 - RNA, 21 nt, Artificial Sequence
  Ebola virus siRNA sense strand
uugcccuucuaauuaagaaaa

SEQ ID NO: 6955 - RNA, 21 nt, Artificial Sequence
  Ebola virus siRNA sense strand
ugcccuucuaauuaagaaaaa

SEQ ID NO: 6956 - RNA, 21 nt, Artificial Sequence
  Ebola virus siRNA sense strand
gcccuucuaauuaagaaaaaa

SEQ ID NO: 6957 - RNA, 21 nt, Artificial Sequence
  Ebola virus siRNA sense strand
cccuucuaauuaagaaaaaau

SEQ ID NO: 6958 - RNA, 21 nt, Artificial Sequence
  Ebola virus siRNA sense strand
ccuucuaauuaagaaaaaauc

SEQ ID NO: 6959 - RNA, 21 nt, Artificial Sequence
  Ebola virus siRNA sense strand
cuucuaauuaagaaaaaaucg

SEQ ID NO: 6960 - RNA, 21 nt, Artificial Sequence
  Ebola virus siRNA sense strand
uucuaauuaagaaaaaaucgg

SEQ ID NO: 6961 - RNA, 21 nt, Artificial Sequence
  Ebola virus siRNA sense strand
ucuaauuaagaaaaaaucggc

SEQ ID NO: 6962 - RNA, 21 nt, Artificial Sequence
  Ebola virus siRNA sense strand
cuaauuaagaaaaaaucggcg

SEQ ID NO: 6963 - RNA, 21 nt, Artificial Sequence
  Ebola virus siRNA sense strand
uaauuaagaaaaaaucggcga

SEQ ID NO: 6964 - RNA, 21 nt, Artificial Sequence
  Ebola virus siRNA sense strand
aauuaagaaaaaaucggcgau

SEQ ID NO: 6965 - RNA, 21 nt, Artificial Sequence
  Ebola virus siRNA sense strand
auuaagaaaaaaucggcgaug

SEQ ID NO: 6966 - RNA, 21 nt, Artificial Sequence
  Ebola virus siRNA sense strand
uuaagaaaaaaucggcgauga

SEQ ID NO: 6967 - RNA, 21 nt, Artificial Sequence
  Ebola virus siRNA sense strand
uaagaaaaaaucggcgaugaa

SEQ ID NO: 6968 - RNA, 21 nt, Artificial Sequence
  Ebola virus siRNA sense strand
aagaaaaaaucggcgaugaag

SEQ ID NO: 6969 - RNA, 21 nt, Artificial Sequence
  Ebola virus siRNA sense strand
agaaaaaaucggcgaugaaga

SEQ ID NO: 6970 - RNA, 21 nt, Artificial Sequence
  Ebola virus siRNA sense strand
gaaaaaaucggcgaugaagau

SEQ ID NO: 6971 - RNA, 21 nt, Artificial Sequence
  Ebola virus siRNA sense strand
aaaaaaucggcgaugaagauu

SEQ ID NO: 6972 - RNA, 21 nt, Artificial Sequence
  Ebola virus siRNA sense strand
aaaaaucggcgaugaagauua

SEQ ID NO: 6973 - RNA, 21 nt, Artificial Sequence
  Ebola virus siRNA sense strand
aaaaucggcgaugaagauuaa

SEQ ID NO: 6974 - RNA, 21 nt, Artificial Sequence
  Ebola virus siRNA sense strand
aaaucggcgaugaagauuaag

SEQ ID NO: 6975 - RNA, 21 nt, Artificial Sequence
  Ebola virus siRNA sense strand
aaucggcgaugaagauuaagc

SEQ ID NO: 6976 - RNA, 21 nt, Artificial Sequence
  Ebola virus siRNA sense strand
aucggcgaugaagauuaagcc

SEQ ID NO: 6977 - RNA, 21 nt, Artificial Sequence
  Ebola virus siRNA sense strand
ucggcgaugaagauuaagccg

SEQ ID NO: 6978 - RNA, 21 nt, Artificial Sequence
  Ebola virus siRNA sense strand
cggcgaugaagauuaagccga

SEQ ID NO: 6979 - RNA, 21 nt, Artificial Sequence
  Ebola virus siRNA sense strand
ggcgaugaagauuaagccgac

SEQ ID NO: 6980 - RNA, 21 nt, Artificial Sequence
  Ebola virus siRNA sense strand
gcgaugaagauuaagccgaca

SEQ ID NO: 6981 - RNA, 21 nt, Artificial Sequence
  Ebola virus siRNA sense strand
cgaugaagauuaagccgacag

SEQ ID NO: 6982 - RNA, 21 nt, Artificial Sequence
  Ebola virus siRNA sense strand
gaugaagauuaagccgacagu

SEQ ID NO: 6983 - RNA, 21 nt, Artificial Sequence
  Ebola virus siRNA sense strand
augaagauuaagccgacagug

SEQ ID NO: 6984 - RNA, 21 nt, Artificial Sequence
  Ebola virus siRNA sense strand
ugaagauuaagccgacaguga

SEQ ID NO: 6985 - RNA, 21 nt, Artificial Sequence
  Ebola virus siRNA sense strand
gaagauuaagccgacagugag

SEQ ID NO: 6986 - RNA, 21 nt, Artificial Sequence
  Ebola virus siRNA sense strand
aagauuaagccgacagugagc

SEQ ID NO: 6987 - RNA, 21 nt, Artificial Sequence
  Ebola virus siRNA sense strand
agauuaagccgacagugagcg

SEQ ID NO: 6988 - RNA, 21 nt, Artificial Sequence
  Ebola virus siRNA sense strand
gauuaagccgacagugagcgu

SEQ ID NO: 6989 - RNA, 21 nt, Artificial Sequence
  Ebola virus siRNA sense strand
auuaagccgacagugagcgua

SEQ ID NO: 6990 - RNA, 21 nt, Artificial Sequence
  Ebola virus siRNA sense strand
uuaagccgacagugagcguaa

SEQ ID NO: 6991 - RNA, 21 nt, Artificial Sequence
  Ebola virus siRNA sense strand
uaagccgacagugagcguaau

SEQ ID NO: 6992 - RNA, 21 nt, Artificial Sequence
  Ebola virus siRNA sense strand
aagccgacagugagcguaauc

SEQ ID NO: 6993 - RNA, 21 nt, Artificial Sequence
  Ebola virus siRNA sense strand
agccgacagugagcguaaucu

SEQ ID NO: 6994 - RNA, 21 nt, Artificial Sequence
  Ebola virus siRNA sense strand
gccgacagugagcguaaucuu

SEQ ID NO: 6995 - RNA, 21 nt, Artificial Sequence
  Ebola virus siRNA sense strand
ccgacagugagcguaaucuuc

SEQ ID NO: 6996 - RNA, 21 nt, Artificial Sequence
  Ebola virus siRNA sense strand
cgacagugagcguaaucuuca

SEQ ID NO: 6997 - RNA, 21 nt, Artificial Sequence
  Ebola virus siRNA sense strand
gacagugagcguaaucuucau

SEQ ID NO: 6998 - RNA, 21 nt, Artificial Sequence
  Ebola virus siRNA sense strand
acagugagcguaaucuucauc

SEQ ID NO: 6999 - RNA, 21 nt, Artificial Sequence
  Ebola virus siRNA sense strand
cagugagcguaaucuucaucu

SEQ ID NO: 7000 - RNA, 21 nt, Artificial Sequence
  Ebola virus siRNA sense strand
agugagcguaaucuucaucuc

SEQ ID NO: 7001 - RNA, 21 nt, Artificial Sequence
  Ebola virus siRNA sense strand
gugagcguaaucuucaucucu

SEQ ID NO: 7002 - RNA, 21 nt, Artificial Sequence
  Ebola virus siRNA sense strand
ugagcguaaucuucaucucuc

SEQ ID NO: 7003 - RNA, 21 nt, Artificial Sequence
  Ebola virus siRNA sense strand
gagcguaaucuucaucucucu

SEQ ID NO: 7004 - RNA, 21 nt, Artificial Sequence
  Ebola virus siRNA sense strand
agcguaaucuucaucucucuu

SEQ ID NO: 7005 - RNA, 21 nt, Artificial Sequence
  Ebola virus siRNA sense strand
gcguaaucuucaucucucuua

SEQ ID NO: 7006 - RNA, 21 nt, Artificial Sequence
  Ebola virus siRNA sense strand
cguaaucuucaucucucuuag

SEQ ID NO: 7007 - RNA, 21 nt, Artificial Sequence
  Ebola virus siRNA sense strand
guaaucuucaucucucuuaga

SEQ ID NO: 7008 - RNA, 21 nt, Artificial Sequence
  Ebola virus siRNA sense strand
uaaucuucaucucucuuagau

SEQ ID NO: 7009 - RNA, 21 nt, Artificial Sequence
  Ebola virus siRNA sense strand
aaucuucaucucucuuagauu

SEQ ID NO: 7010 - RNA, 21 nt, Artificial Sequence
  Ebola virus siRNA sense strand
aucuucaucucucuuagauua

SEQ ID NO: 7011 - RNA, 21 nt, Artificial Sequence
  Ebola virus siRNA sense strand
ucuucaucucucuuagauuau

SEQ ID NO: 7012 - RNA, 21 nt, Artificial Sequence
  Ebola virus siRNA sense strand
cuucaucucucuuagauuauu

SEQ ID NO: 7013 - RNA, 21 nt, Artificial Sequence
  Ebola virus siRNA sense strand
uucaucucucuuagauuauuu

SEQ ID NO: 7014 - RNA, 21 nt, Artificial Sequence
  Ebola virus siRNA sense strand
ucaucucucuuagauuauuug

SEQ ID NO: 7015 - RNA, 21 nt, Artificial Sequence
  Ebola virus siRNA sense strand
caucucucuuagauuauuugu

SEQ ID NO: 7016 - RNA, 21 nt, Artificial Sequence
  Ebola virus siRNA sense strand
aucucucuuagauuauuuguu

SEQ ID NO: 7017 - RNA, 21 nt, Artificial Sequence
  Ebola virus siRNA sense strand
ucucucuuagauuauuuguuu

SEQ ID NO: 7018 - RNA, 21 nt, Artificial Sequence
  Ebola virus siRNA sense strand
cucucuuagauuauuuguuuu

SEQ ID NO: 7019 - RNA, 21 nt, Artificial Sequence
  Ebola virus siRNA sense strand
ucucuuagauuauuuguuuuc

SEQ ID NO: 7020 - RNA, 21 nt, Artificial Sequence
  Ebola virus siRNA sense strand
cucuuagauuauuuguuuucc

SEQ ID NO: 7021 - RNA, 21 nt, Artificial Sequence
  Ebola virus siRNA sense strand
ucuuagauuauuuguuuucca

SEQ ID NO: 7022 - RNA, 21 nt, Artificial Sequence
  Ebola virus siRNA sense strand
cuuagauuauuuguuuuccag

SEQ ID NO: 7023 - RNA, 21 nt, Artificial Sequence
  Ebola virus siRNA sense strand
uuagauuauuuguuuuccaga

SEQ ID NO: 7024 - RNA, 21 nt, Artificial Sequence
  Ebola virus siRNA sense strand
uagauuauuuguuuuccagag

SEQ ID NO: 7025 - RNA, 21 nt, Artificial Sequence
  Ebola virus siRNA sense strand
agauuauuuguuuuccagagu

SEQ ID NO: 7026 - RNA, 21 nt, Artificial Sequence
  Ebola virus siRNA sense strand
gauuauuuguuuuccagagua

SEQ ID NO: 7027 - RNA, 21 nt, Artificial Sequence
  Ebola virus siRNA sense strand
auuauuuguuuuccagaguag

SEQ ID NO: 7028 - RNA, 21 nt, Artificial Sequence
  Ebola virus siRNA sense strand
uuauuuguuuuccagaguagg

SEQ ID NO: 7029 - RNA, 21 nt, Artificial Sequence
  Ebola virus siRNA sense strand
uauuuguuuuccagaguaggg

SEQ ID NO: 7030 - RNA, 21 nt, Artificial Sequence
  Ebola virus siRNA sense strand
auuuguuuuccagaguagggg

SEQ ID NO: 7031 - RNA, 21 nt, Artificial Sequence
  Ebola virus siRNA sense strand
uuuguuuuccagaguaggggu

SEQ ID NO: 7032 - RNA, 21 nt, Artificial Sequence
  Ebola virus siRNA sense strand
uuguuuuccagaguagggguc

SEQ ID NO: 7033 - RNA, 21 nt, Artificial Sequence
  Ebola virus siRNA sense strand
uguuuuccagaguaggggucg

SEQ ID NO: 7034 - RNA, 21 nt, Artificial Sequence
  Ebola virus siRNA sense strand
guuuuccagaguaggggucgu

SEQ ID NO: 7035 - RNA, 21 nt, Artificial Sequence
  Ebola virus siRNA sense strand
uuuuccagaguaggggucguc

SEQ ID NO: 7036 - RNA, 21 nt, Artificial Sequence
  Ebola virus siRNA sense strand
uuuccagaguaggggucguca

SEQ ID NO: 7037 - RNA, 21 nt, Artificial Sequence
  Ebola virus siRNA sense strand
uuccagaguaggggucgucag

SEQ ID NO: 7038 - RNA, 21 nt, Artificial Sequence
  Ebola virus siRNA sense strand
uccagaguaggggucgucagg

SEQ ID NO: 7039 - RNA, 21 nt, Artificial Sequence
  Ebola virus siRNA sense strand
ccagaguaggggucgucaggu

SEQ ID NO: 7040 - RNA, 21 nt, Artificial Sequence
  Ebola virus siRNA sense strand
cagaguaggggucgucagguc

SEQ ID NO: 7041 - RNA, 21 nt, Artificial Sequence
  Ebola virus siRNA sense strand
agaguaggggucgucaggucc

SEQ ID NO: 7042 - RNA, 21 nt, Artificial Sequence
  Ebola virus siRNA sense strand
gaguaggggucgucagguccu

SEQ ID NO: 7043 - RNA, 21 nt, Artificial Sequence
  Ebola virus siRNA sense strand
aguaggggucgucagguccuu

SEQ ID NO: 7044 - RNA, 21 nt, Artificial Sequence
  Ebola virus siRNA sense strand
guaggggucgucagguccuuu

SEQ ID NO: 7045 - RNA, 21 nt, Artificial Sequence
  Ebola virus siRNA sense strand
uaggggucgucagguccuuuu

SEQ ID NO: 7046 - RNA, 21 nt, Artificial Sequence
  Ebola virus siRNA sense strand
aggggucgucagguccuuuuc

SEQ ID NO: 7047 - RNA, 21 nt, Artificial Sequence
  Ebola virus siRNA sense strand
ggggucgucagguccuuuuca

SEQ ID NO: 7048 - RNA, 21 nt, Artificial Sequence
  Ebola virus siRNA sense strand
gggucgucagguccuuuucaa

SEQ ID NO: 7049 - RNA, 21 nt, Artificial Sequence
  Ebola virus siRNA sense strand
ggucgucagguccuuuucaau

SEQ ID NO: 7050 - RNA, 21 nt, Artificial Sequence
  Ebola virus siRNA sense strand
gucgucagguccuuuucaauc

SEQ ID NO: 7051 - RNA, 21 nt, Artificial Sequence
  Ebola virus siRNA sense strand
ucgucagguccuuuucaaucg

SEQ ID NO: 7052 - RNA, 21 nt, Artificial Sequence
  Ebola virus siRNA sense strand
cgucagguccuuuucaaucgu

SEQ ID NO: 7053 - RNA, 21 nt, Artificial Sequence
  Ebola virus siRNA sense strand
gucagguccuuuucaaucgug

SEQ ID NO: 7054 - RNA, 21 nt, Artificial Sequence
  Ebola virus siRNA sense strand
ucagguccuuuucaaucgugu

SEQ ID NO: 7055 - RNA, 21 nt, Artificial Sequence
  Ebola virus siRNA sense strand
cagguccuuuucaaucgugua

SEQ ID NO: 7056 - RNA, 21 nt, Artificial Sequence
  Ebola virus siRNA sense strand
agguccuuuucaaucguguaa

SEQ ID NO: 7057 - RNA, 21 nt, Artificial Sequence
  Ebola virus siRNA sense strand
gguccuuuucaaucguguaac

SEQ ID NO: 7058 - RNA, 21 nt, Artificial Sequence
  Ebola virus siRNA sense strand
guccuuuucaaucguguaacc

SEQ ID NO: 7059 - RNA, 21 nt, Artificial Sequence
  Ebola virus siRNA sense strand
uccuuuucaaucguguaacca

SEQ ID NO: 7060 - RNA, 21 nt, Artificial Sequence
  Ebola virus siRNA sense strand
ccuuuucaaucguguaaccaa

SEQ ID NO: 7061 - RNA, 21 nt, Artificial Sequence
  Ebola virus siRNA sense strand
cuuuucaaucguguaaccaaa

SEQ ID NO: 7062 - RNA, 21 nt, Artificial Sequence
  Ebola virus siRNA sense strand
uuuucaaucguguaaccaaaa

SEQ ID NO: 7063 - RNA, 21 nt, Artificial Sequence
  Ebola virus siRNA sense strand
uuucaaucguguaaccaaaau

SEQ ID NO: 7064 - RNA, 21 nt, Artificial Sequence
  Ebola virus siRNA sense strand
uucaaucguguaaccaaaaua

SEQ ID NO: 7065 - RNA, 21 nt, Artificial Sequence
  Ebola virus siRNA sense strand
ucaaucguguaaccaaaauaa

SEQ ID NO: 7066 - RNA, 21 nt, Artificial Sequence
  Ebola virus siRNA sense strand
caaucguguaaccaaaauaaa

SEQ ID NO: 7067 - RNA, 21 nt, Artificial Sequence
  Ebola virus siRNA sense strand
aaucguguaaccaaaauaaac

SEQ ID NO: 7068 - RNA, 21 nt, Artificial Sequence
  Ebola virus siRNA sense strand
aucguguaaccaaaauaaacu

SEQ ID NO: 7069 - RNA, 21 nt, Artificial Sequence
  Ebola virus siRNA sense strand
ucguguaaccaaaauaaacuc

SEQ ID NO: 7070 - RNA, 21 nt, Artificial Sequence
  Ebola virus siRNA sense strand
cguguaaccaaaauaaacucc

SEQ ID NO: 7071 - RNA, 21 nt, Artificial Sequence
  Ebola virus siRNA sense strand
guguaaccaaaauaaacucca

SEQ ID NO: 7072 - RNA, 21 nt, Artificial Sequence
  Ebola virus siRNA sense strand
uguaaccaaaauaaacuccac

SEQ ID NO: 7073 - RNA, 21 nt, Artificial Sequence
  Ebola virus siRNA sense strand
guaaccaaaauaaacuccacu

SEQ ID NO: 7074 - RNA, 21 nt, Artificial Sequence
  Ebola virus siRNA sense strand
uaaccaaaauaaacuccacua

SEQ ID NO: 7075 - RNA, 21 nt, Artificial Sequence
  Ebola virus siRNA sense strand
aaccaaaauaaacuccacuag

SEQ ID NO: 7076 - RNA, 21 nt, Artificial Sequence
  Ebola virus siRNA sense strand
accaaaauaaacuccacuaga

SEQ ID NO: 7077 - RNA, 21 nt, Artificial Sequence
  Ebola virus siRNA sense strand
ccaaaauaaacuccacuagaa

SEQ ID NO: 7078 - RNA, 21 nt, Artificial Sequence
  Ebola virus siRNA sense strand
caaaauaaacuccacuagaag

SEQ ID NO: 7079 - RNA, 21 nt, Artificial Sequence
  Ebola virus siRNA sense strand
aaaauaaacuccacuagaagg

SEQ ID NO: 7080 - RNA, 21 nt, Artificial Sequence
  Ebola virus siRNA sense strand
aaauaaacuccacuagaagga

SEQ ID NO: 7081 - RNA, 21 nt, Artificial Sequence
  Ebola virus siRNA sense strand
aauaaacuccacuagaaggau

SEQ ID NO: 7082 - RNA, 21 nt, Artificial Sequence
  Ebola virus siRNA sense strand
auaaacuccacuagaaggaua

SEQ ID NO: 7083 - RNA, 21 nt, Artificial Sequence
  Ebola virus siRNA sense strand
uaaacuccacuagaaggauau

SEQ ID NO: 7084 - RNA, 21 nt, Artificial Sequence
  Ebola virus siRNA sense strand
aaacuccacuagaaggauauu

SEQ ID NO: 7085 - RNA, 21 nt, Artificial Sequence
  Ebola virus siRNA sense strand
aacuccacuagaaggauauug

SEQ ID NO: 7086 - RNA, 21 nt, Artificial Sequence
  Ebola virus siRNA sense strand
acuccacuagaaggauauugu

SEQ ID NO: 7087 - RNA, 21 nt, Artificial Sequence
  Ebola virus siRNA sense strand
cuccacuagaaggauauugug

SEQ ID NO: 7088 - RNA, 21 nt, Artificial Sequence
  Ebola virus siRNA sense strand
uccacuagaaggauauugugg

SEQ ID NO: 7089 - RNA, 21 nt, Artificial Sequence
  Ebola virus siRNA sense strand
ccacuagaaggauauuguggg

SEQ ID NO: 7090 - RNA, 21 nt, Artificial Sequence
  Ebola virus siRNA sense strand
cacuagaaggauauugugggg

SEQ ID NO: 7091 - RNA, 21 nt, Artificial Sequence
  Ebola virus siRNA sense strand
acuagaaggauauuguggggc

SEQ ID NO: 7092 - RNA, 21 nt, Artificial Sequence
  Ebola virus siRNA sense strand
cuagaaggauauuguggggca

SEQ ID NO: 7093 - RNA, 21 nt, Artificial Sequence
  Ebola virus siRNA sense strand
uagaaggauauuguggggcaa

SEQ ID NO: 7094 - RNA, 21 nt, Artificial Sequence
  Ebola virus siRNA sense strand
agaaggauauuguggggcaac

SEQ ID NO: 7095 - RNA, 21 nt, Artificial Sequence
  Ebola virus siRNA sense strand
gaaggauauuguggggcaaca

SEQ ID NO: 7096 - RNA, 21 nt, Artificial Sequence
  Ebola virus siRNA sense strand
aaggauauuguggggcaacaa

SEQ ID NO: 7097 - RNA, 21 nt, Artificial Sequence
  Ebola virus siRNA sense strand
aggauauuguggggcaacaac

SEQ ID NO: 7098 - RNA, 21 nt, Artificial Sequence
  Ebola virus siRNA sense strand
ggauauuguggggcaacaaca

SEQ ID NO: 7099 - RNA, 21 nt, Artificial Sequence
  Ebola virus siRNA sense strand
gauauuguggggcaacaacac

SEQ ID NO: 7100 - RNA, 21 nt, Artificial Sequence
  Ebola virus siRNA sense strand
auauuguggggcaacaacaca

SEQ ID NO: 7101 - RNA, 21 nt, Artificial Sequence
  Ebola virus siRNA sense strand
uauuguggggcaacaacacaa

SEQ ID NO: 7102 - RNA, 21 nt, Artificial Sequence
  Ebola virus siRNA sense strand
auuguggggcaacaacacaau

SEQ ID NO: 7103 - RNA, 21 nt, Artificial Sequence
  Ebola virus siRNA sense strand
uuguggggcaacaacacaaug

SEQ ID NO: 7104 - RNA, 21 nt, Artificial Sequence
  Ebola virus siRNA sense strand
uguggggcaacaacacaaugg

SEQ ID NO: 7105 - RNA, 21 nt, Artificial Sequence
  Ebola virus siRNA sense strand
guggggcaacaacacaauggg

SEQ ID NO: 7106 - RNA, 21 nt, Artificial Sequence
  Ebola virus siRNA sense strand
uggggcaacaacacaaugggc

SEQ ID NO: 7107 - RNA, 21 nt, Artificial Sequence
  Ebola virus siRNA sense strand
ggggcaacaacacaaugggcg

SEQ ID NO: 7108 - RNA, 21 nt, Artificial Sequence
  Ebola virus siRNA sense strand
gggcaacaacacaaugggcgu

SEQ ID NO: 7109 - RNA, 21 nt, Artificial Sequence
  Ebola virus siRNA sense strand
ggcaacaacacaaugggcguu

SEQ ID NO: 7110 - RNA, 21 nt, Artificial Sequence
  Ebola virus siRNA sense strand
gcaacaacacaaugggcguua

SEQ ID NO: 7111 - RNA, 21 nt, Artificial Sequence
  Ebola virus siRNA sense strand
caacaacacaaugggcguuac

SEQ ID NO: 7112 - RNA, 21 nt, Artificial Sequence
  Ebola virus siRNA sense strand
aacaacacaaugggcguuaca

SEQ ID NO: 7113 - RNA, 21 nt, Artificial Sequence
  Ebola virus siRNA sense strand
acaacacaaugggcguuacag

SEQ ID NO: 7114 - RNA, 21 nt, Artificial Sequence
  Ebola virus siRNA sense strand
caacacaaugggcguuacagg

SEQ ID NO: 7115 - RNA, 21 nt, Artificial Sequence
  Ebola virus siRNA sense strand
aacacaaugggcguuacagga

SEQ ID NO: 7116 - RNA, 21 nt, Artificial Sequence
  Ebola virus siRNA sense strand
acacaaugggcguuacaggaa

SEQ ID NO: 7117 - RNA, 21 nt, Artificial Sequence
  Ebola virus siRNA sense strand
cacaaugggcguuacaggaau

SEQ ID NO: 7118 - RNA, 21 nt, Artificial Sequence
  Ebola virus siRNA sense strand
acaaugggcguuacaggaaua

SEQ ID NO: 7119 - RNA, 21 nt, Artificial Sequence
  Ebola virus siRNA sense strand
caaugggcguuacaggaauau

SEQ ID NO: 7120 - RNA, 21 nt, Artificial Sequence
  Ebola virus siRNA sense strand
aaugggcguuacaggaauauu

SEQ ID NO: 7121 - RNA, 21 nt, Artificial Sequence
  Ebola virus siRNA sense strand
augggcguuacaggaauauug

SEQ ID NO: 7122 - RNA, 21 nt, Artificial Sequence
  Ebola virus siRNA sense strand
ugggcguuacaggaauauugc

SEQ ID NO: 7123 - RNA, 21 nt, Artificial Sequence
  Ebola virus siRNA sense strand
gggcguuacaggaauauugca

SEQ ID NO: 7124 - RNA, 21 nt, Artificial Sequence
  Ebola virus siRNA sense strand
ggcguuacaggaauauugcag

SEQ ID NO: 7125 - RNA, 21 nt, Artificial Sequence
  Ebola virus siRNA sense strand
gcguuacaggaauauugcagu

SEQ ID NO: 7126 - RNA, 21 nt, Artificial Sequence
  Ebola virus siRNA sense strand
cguuacaggaauauugcaguu

SEQ ID NO: 7127 - RNA, 21 nt, Artificial Sequence
  Ebola virus siRNA sense strand
guuacaggaauauugcaguua

SEQ ID NO: 7128 - RNA, 21 nt, Artificial Sequence
  Ebola virus siRNA sense strand
uuacaggaauauugcaguuac

SEQ ID NO: 7129 - RNA, 21 nt, Artificial Sequence
  Ebola virus siRNA sense strand
uacaggaauauugcaguuacc

SEQ ID NO: 7130 - RNA, 21 nt, Artificial Sequence
  Ebola virus siRNA sense strand
acaggaauauugcaguuaccu

SEQ ID NO: 7131 - RNA, 21 nt, Artificial Sequence
  Ebola virus siRNA sense strand
caggaauauugcaguuaccuc

SEQ ID NO: 7132 - RNA, 21 nt, Artificial Sequence
  Ebola virus siRNA sense strand
aggaauauugcaguuaccucg

SEQ ID NO: 7133 - RNA, 21 nt, Artificial Sequence
  Ebola virus siRNA sense strand
ggaauauugcaguuaccucgu

SEQ ID NO: 7134 - RNA, 21 nt, Artificial Sequence
  Ebola virus siRNA sense strand
gaauauugcaguuaccucgug

SEQ ID NO: 7135 - RNA, 21 nt, Artificial Sequence
  Ebola virus siRNA sense strand
aauauugcaguuaccucguga

SEQ ID NO: 7136 - RNA, 21 nt, Artificial Sequence
  Ebola virus siRNA sense strand
auauugcaguuaccucgugau

SEQ ID NO: 7137 - RNA, 21 nt, Artificial Sequence
  Ebola virus siRNA sense strand
uauugcaguuaccucgugauc

SEQ ID NO: 7138 - RNA, 21 nt, Artificial Sequence
  Ebola virus siRNA sense strand
auugcaguuaccucgugaucg

SEQ ID NO: 7139 - RNA, 21 nt, Artificial Sequence
  Ebola virus siRNA sense strand
uugcaguuaccucgugaucga

SEQ ID NO: 7140 - RNA, 21 nt, Artificial Sequence
  Ebola virus siRNA sense strand
ugcaguuaccucgugaucgau

SEQ ID NO: 7141 - RNA, 21 nt, Artificial Sequence
  Ebola virus siRNA sense strand
gcaguuaccucgugaucgauu

SEQ ID NO: 7142 - RNA, 21 nt, Artificial Sequence
  Ebola virus siRNA sense strand
caguuaccucgugaucgauuc

SEQ ID NO: 7143 - RNA, 21 nt, Artificial Sequence
  Ebola virus siRNA sense strand
aguuaccucgugaucgauuca

SEQ ID NO: 7144 - RNA, 21 nt, Artificial Sequence
  Ebola virus siRNA sense strand
guuaccucgugaucgauucaa

SEQ ID NO: 7145 - RNA, 21 nt, Artificial Sequence
  Ebola virus siRNA sense strand
uuaccucgugaucgauucaag

SEQ ID NO: 7146 - RNA, 21 nt, Artificial Sequence
  Ebola virus siRNA sense strand
uaccucgugaucgauucaaga

SEQ ID NO: 7147 - RNA, 21 nt, Artificial Sequence
  Ebola virus siRNA sense strand
accucgugaucgauucaagag

SEQ ID NO: 7148 - RNA, 21 nt, Artificial Sequence
  Ebola virus siRNA sense strand
ccucgugaucgauucaagagg

SEQ ID NO: 7149 - RNA, 21 nt, Artificial Sequence
  Ebola virus siRNA sense strand
cucgugaucgauucaagagga

SEQ ID NO: 7150 - RNA, 21 nt, Artificial Sequence
  Ebola virus siRNA sense strand
ucgugaucgauucaagaggac

SEQ ID NO: 7151 - RNA, 21 nt, Artificial Sequence
  Ebola virus siRNA sense strand
cgugaucgauucaagaggaca

SEQ ID NO: 7152 - RNA, 21 nt, Artificial Sequence
  Ebola virus siRNA sense strand
gugaucgauucaagaggacau

SEQ ID NO: 7153 - RNA, 21 nt, Artificial Sequence
  Ebola virus siRNA sense strand
ugaucgauucaagaggacauc

SEQ ID NO: 7154 - RNA, 21 nt, Artificial Sequence
  Ebola virus siRNA sense strand
gaucgauucaagaggacauca

SEQ ID NO: 7155 - RNA, 21 nt, Artificial Sequence
  Ebola virus siRNA sense strand
aucgauucaagaggacaucau

SEQ ID NO: 7156 - RNA, 21 nt, Artificial Sequence
  Ebola virus siRNA sense strand
ucgauucaagaggacaucauu

SEQ ID NO: 7157 - RNA, 21 nt, Artificial Sequence
  Ebola virus siRNA sense strand
cgauucaagaggacaucauuc

SEQ ID NO: 7158 - RNA, 21 nt, Artificial Sequence
  Ebola virus siRNA sense strand
gauucaagaggacaucauucu

SEQ ID NO: 7159 - RNA, 21 nt, Artificial Sequence
  Ebola virus siRNA sense strand
auucaagaggacaucauucuu

SEQ ID NO: 7160 - RNA, 21 nt, Artificial Sequence
  Ebola virus siRNA sense strand
uucaagaggacaucauucuuu

SEQ ID NO: 7161 - RNA, 21 nt, Artificial Sequence
  Ebola virus siRNA sense strand
ucaagaggacaucauucuuuc

SEQ ID NO: 7162 - RNA, 21 nt, Artificial Sequence
  Ebola virus siRNA sense strand
caagaggacaucauucuuucu

SEQ ID NO: 7163 - RNA, 21 nt, Artificial Sequence
  Ebola virus siRNA sense strand
aagaggacaucauucuuucuu

SEQ ID NO: 7164 - RNA, 21 nt, Artificial Sequence
  Ebola virus siRNA sense strand
agaggacaucauucuuucuuu

SEQ ID NO: 7165 - RNA, 21 nt, Artificial Sequence
  Ebola virus siRNA sense strand
gaggacaucauucuuucuuug

SEQ ID NO: 7166 - RNA, 21 nt, Artificial Sequence
  Ebola virus siRNA sense strand
aggacaucauucuuucuuugg

SEQ ID NO: 7167 - RNA, 21 nt, Artificial Sequence
  Ebola virus siRNA sense strand
ggacaucauucuuucuuuggg

SEQ ID NO: 7168 - RNA, 21 nt, Artificial Sequence
  Ebola virus siRNA sense strand
gacaucauucuuucuuugggu

SEQ ID NO: 7169 - RNA, 21 nt, Artificial Sequence
  Ebola virus siRNA sense strand
acaucauucuuucuuugggua

SEQ ID NO: 7170 - RNA, 21 nt, Artificial Sequence
  Ebola virus siRNA sense strand
caucauucuuucuuuggguaa

SEQ ID NO: 7171 - RNA, 21 nt, Artificial Sequence
  Ebola virus siRNA sense strand
aucauucuuucuuuggguaau

SEQ ID NO: 7172 - RNA, 21 nt, Artificial Sequence
  Ebola virus siRNA sense strand
ucauucuuucuuuggguaauu

SEQ ID NO: 7173 - RNA, 21 nt, Artificial Sequence
  Ebola virus siRNA sense strand
cauucuuucuuuggguaauua

SEQ ID NO: 7174 - RNA, 21 nt, Artificial Sequence
  Ebola virus siRNA sense strand
auucuuucuuuggguaauuau

SEQ ID NO: 7175 - RNA, 21 nt, Artificial Sequence
  Ebola virus siRNA sense strand
uucuuucuuuggguaauuauc

SEQ ID NO: 7176 - RNA, 21 nt, Artificial Sequence
  Ebola virus siRNA sense strand
ucuuucuuuggguaauuaucc

SEQ ID NO: 7177 - RNA, 21 nt, Artificial Sequence
  Ebola virus siRNA sense strand
cuuucuuuggguaauuauccu

SEQ ID NO: 7178 - RNA, 21 nt, Artificial Sequence
  Ebola virus siRNA sense strand
uuucuuuggguaauuauccuu

SEQ ID NO: 7179 - RNA, 21 nt, Artificial Sequence
  Ebola virus siRNA sense strand
uucuuuggguaauuauccuuu

SEQ ID NO: 7180 - RNA, 21 nt, Artificial Sequence
  Ebola virus siRNA sense strand
ucuuuggguaauuauccuuuu

SEQ ID NO: 7181 - RNA, 21 nt, Artificial Sequence
  Ebola virus siRNA sense strand
cuuuggguaauuauccuuuuc

SEQ ID NO: 7182 - RNA, 21 nt, Artificial Sequence
  Ebola virus siRNA sense strand
uuuggguaauuauccuuuucc

SEQ ID NO: 7183 - RNA, 21 nt, Artificial Sequence
  Ebola virus siRNA sense strand
uuggguaauuauccuuuucca

SEQ ID NO: 7184 - RNA, 21 nt, Artificial Sequence
  Ebola virus siRNA sense strand
uggguaauuauccuuuuccaa

SEQ ID NO: 7185 - RNA, 21 nt, Artificial Sequence
  Ebola virus siRNA sense strand
ggguaauuauccuuuuccaaa

SEQ ID NO: 7186 - RNA, 21 nt, Artificial Sequence
  Ebola virus siRNA sense strand
gguaauuauccuuuuccaaag

SEQ ID NO: 7187 - RNA, 21 nt, Artificial Sequence
  Ebola virus siRNA sense strand
guaauuauccuuuuccaaaga

SEQ ID NO: 7188 - RNA, 21 nt, Artificial Sequence
  Ebola virus siRNA sense strand
uaauuauccuuuuccaaagaa

SEQ ID NO: 7189 - RNA, 21 nt, Artificial Sequence
  Ebola virus siRNA sense strand
aauuauccuuuuccaaagaac

SEQ ID NO: 7190 - RNA, 21 nt, Artificial Sequence
  Ebola virus siRNA sense strand
auuauccuuuuccaaagaaca

SEQ ID NO: 7191 - RNA, 21 nt, Artificial Sequence
  Ebola virus siRNA sense strand
uuauccuuuuccaaagaacau

SEQ ID NO: 7192 - RNA, 21 nt, Artificial Sequence
  Ebola virus siRNA sense strand
uauccuuuuccaaagaacauu

SEQ ID NO: 7193 - RNA, 21 nt, Artificial Sequence
  Ebola virus siRNA sense strand
auccuuuuccaaagaacauuu

SEQ ID NO: 7194 - RNA, 21 nt, Artificial Sequence
  Ebola virus siRNA sense strand
uccuuuuccaaagaacauuuu

SEQ ID NO: 7195 - RNA, 21 nt, Artificial Sequence
  Ebola virus siRNA sense strand
ccuuuuccaaagaacauuuuc

SEQ ID NO: 7196 - RNA, 21 nt, Artificial Sequence
  Ebola virus siRNA sense strand
cuuuuccaaagaacauuuucc

SEQ ID NO: 7197 - RNA, 21 nt, Artificial Sequence
  Ebola virus siRNA sense strand
uuuuccaaagaacauuuucca

SEQ ID NO: 7198 - RNA, 21 nt, Artificial Sequence
  Ebola virus siRNA sense strand
uuuccaaagaacauuuuccau

SEQ ID NO: 7199 - RNA, 21 nt, Artificial Sequence
  Ebola virus siRNA sense strand
uuccaaagaacauuuuccauc

SEQ ID NO: 7200 - RNA, 21 nt, Artificial Sequence
  Ebola virus siRNA sense strand
uccaaagaacauuuuccaucc

SEQ ID NO: 7201 - RNA, 21 nt, Artificial Sequence
  Ebola virus siRNA sense strand
ccaaagaacauuuuccauccc

SEQ ID NO: 7202 - RNA, 21 nt, Artificial Sequence
  Ebola virus siRNA sense strand
caaagaacauuuuccauccca

SEQ ID NO: 7203 - RNA, 21 nt, Artificial Sequence
  Ebola virus siRNA sense strand
aaagaacauuuuccaucccac

SEQ ID NO: 7204 - RNA, 21 nt, Artificial Sequence
  Ebola virus siRNA sense strand
aagaacauuuuccaucccacu

SEQ ID NO: 7205 - RNA, 21 nt, Artificial Sequence
  Ebola virus siRNA sense strand
agaacauuuuccaucccacuu

SEQ ID NO: 7206 - RNA, 21 nt, Artificial Sequence
  Ebola virus siRNA sense strand
gaacauuuuccaucccacuug

SEQ ID NO: 7207 - RNA, 21 nt, Artificial Sequence
  Ebola virus siRNA sense strand
aacauuuuccaucccacuugg

SEQ ID NO: 7208 - RNA, 21 nt, Artificial Sequence
  Ebola virus siRNA sense strand
acauuuuccaucccacuugga

SEQ ID NO: 7209 - RNA, 21 nt, Artificial Sequence
  Ebola virus siRNA sense strand
cauuuuccaucccacuuggag

SEQ ID NO: 7210 - RNA, 21 nt, Artificial Sequence
  Ebola virus siRNA sense strand
auuuuccaucccacuuggagu

SEQ ID NO: 7211 - RNA, 21 nt, Artificial Sequence
  Ebola virus siRNA sense strand
uuuuccaucccacuuggaguc

SEQ ID NO: 7212 - RNA, 21 nt, Artificial Sequence
  Ebola virus siRNA sense strand
uuuccaucccacuuggaguca

SEQ ID NO: 7213 - RNA, 21 nt, Artificial Sequence
  Ebola virus siRNA sense strand
uuccaucccacuuggagucau

SEQ ID NO: 7214 - RNA, 21 nt, Artificial Sequence
  Ebola virus siRNA sense strand
uccaucccacuuggagucauc

SEQ ID NO: 7215 - RNA, 21 nt, Artificial Sequence
  Ebola virus siRNA sense strand
ccaucccacuuggagucaucc

SEQ ID NO: 7216 - RNA, 21 nt, Artificial Sequence
  Ebola virus siRNA sense strand
caucccacuuggagucaucca

SEQ ID NO: 7217 - RNA, 21 nt, Artificial Sequence
  Ebola virus siRNA sense strand
aucccacuuggagucauccac

SEQ ID NO: 7218 - RNA, 21 nt, Artificial Sequence
  Ebola virus siRNA sense strand
ucccacuuggagucauccaca

SEQ ID NO: 7219 - RNA, 21 nt, Artificial Sequence
  Ebola virus siRNA sense strand
cccacuuggagucauccacaa

SEQ ID NO: 7220 - RNA, 21 nt, Artificial Sequence
  Ebola virus siRNA sense strand
ccacuuggagucauccacaau

SEQ ID NO: 7221 - RNA, 21 nt, Artificial Sequence
  Ebola virus siRNA sense strand
cacuuggagucauccacaaua

SEQ ID NO: 7222 - RNA, 21 nt, Artificial Sequence
  Ebola virus siRNA sense strand
acuuggagucauccacaauag

SEQ ID NO: 7223 - RNA, 21 nt, Artificial Sequence
  Ebola virus siRNA sense strand
cuuggagucauccacaauagc

SEQ ID NO: 7224 - RNA, 21 nt, Artificial Sequence
  Ebola virus siRNA sense strand
uuggagucauccacaauagca

SEQ ID NO: 7225 - RNA, 21 nt, Artificial Sequence
  Ebola virus siRNA sense strand
uggagucauccacaauagcac

SEQ ID NO: 7226 - RNA, 21 nt, Artificial Sequence
  Ebola virus siRNA sense strand
ggagucauccacaauagcaca

SEQ ID NO: 7227 - RNA, 21 nt, Artificial Sequence
  Ebola virus siRNA sense strand
gagucauccacaauagcacau

SEQ ID NO: 7228 - RNA, 21 nt, Artificial Sequence
  Ebola virus siRNA sense strand
agucauccacaauagcacauu

SEQ ID NO: 7229 - RNA, 21 nt, Artificial Sequence
  Ebola virus siRNA sense strand
gucauccacaauagcacauua

SEQ ID NO: 7230 - RNA, 21 nt, Artificial Sequence
  Ebola virus siRNA sense strand
ucauccacaauagcacauuac

SEQ ID NO: 7231 - RNA, 21 nt, Artificial Sequence
  Ebola virus siRNA sense strand
cauccacaauagcacauuaca

SEQ ID NO: 7232 - RNA, 21 nt, Artificial Sequence
  Ebola virus siRNA sense strand
auccacaauagcacauuacag

SEQ ID NO: 7233 - RNA, 21 nt, Artificial Sequence
  Ebola virus siRNA sense strand
uccacaauagcacauuacagg

SEQ ID NO: 7234 - RNA, 21 nt, Artificial Sequence
  Ebola virus siRNA sense strand
ccacaauagcacauuacaggu

SEQ ID NO: 7235 - RNA, 21 nt, Artificial Sequence
  Ebola virus siRNA sense strand
cacaauagcacauuacagguu

SEQ ID NO: 7236 - RNA, 21 nt, Artificial Sequence
  Ebola virus siRNA sense strand
acaauagcacauuacagguua

SEQ ID NO: 7237 - RNA, 21 nt, Artificial Sequence
  Ebola virus siRNA sense strand
caauagcacauuacagguuag

SEQ ID NO: 7238 - RNA, 21 nt, Artificial Sequence
  Ebola virus siRNA sense strand
aauagcacauuacagguuagu

SEQ ID NO: 7239 - RNA, 21 nt, Artificial Sequence
  Ebola virus siRNA sense strand
auagcacauuacagguuagug

SEQ ID NO: 7240 - RNA, 21 nt, Artificial Sequence
  Ebola virus siRNA sense strand
uagcacauuacagguuaguga

SEQ ID NO: 7241 - RNA, 21 nt, Artificial Sequence
  Ebola virus siRNA sense strand
agcacauuacagguuagugau

SEQ ID NO: 7242 - RNA, 21 nt, Artificial Sequence
  Ebola virus siRNA sense strand
gcacauuacagguuagugaug

SEQ ID NO: 7243 - RNA, 21 nt, Artificial Sequence
  Ebola virus siRNA sense strand
cacauuacagguuagugaugu

SEQ ID NO: 7244 - RNA, 21 nt, Artificial Sequence
  Ebola virus siRNA sense strand
acauuacagguuagugauguc

SEQ ID NO: 7245 - RNA, 21 nt, Artificial Sequence
  Ebola virus siRNA sense strand
cauuacagguuagugaugucg

SEQ ID NO: 7246 - RNA, 21 nt, Artificial Sequence
  Ebola virus siRNA sense strand
auuacagguuagugaugucga

SEQ ID NO: 7247 - RNA, 21 nt, Artificial Sequence
  Ebola virus siRNA sense strand
uuacagguuagugaugucgac

SEQ ID NO: 7248 - RNA, 21 nt, Artificial Sequence
  Ebola virus siRNA sense strand
uacagguuagugaugucgaca

SEQ ID NO: 7249 - RNA, 21 nt, Artificial Sequence
  Ebola virus siRNA sense strand
acagguuagugaugucgacaa

SEQ ID NO: 7250 - RNA, 21 nt, Artificial Sequence
  Ebola virus siRNA sense strand
cagguuagugaugucgacaaa

SEQ ID NO: 7251 - RNA, 21 nt, Artificial Sequence
  Ebola virus siRNA sense strand
agguuagugaugucgacaaac

SEQ ID NO: 7252 - RNA, 21 nt, Artificial Sequence
  Ebola virus siRNA sense strand
gguuagugaugucgacaaacu

SEQ ID NO: 7253 - RNA, 21 nt, Artificial Sequence
  Ebola virus siRNA sense strand
guuagugaugucgacaaacua

SEQ ID NO: 7254 - RNA, 21 nt, Artificial Sequence
  Ebola virus siRNA sense strand
uuagugaugucgacaaacuag

SEQ ID NO: 7255 - RNA, 21 nt, Artificial Sequence
  Ebola virus siRNA sense strand
uagugaugucgacaaacuagu

SEQ ID NO: 7256 - RNA, 21 nt, Artificial Sequence
  Ebola virus siRNA sense strand
agugaugucgacaaacuaguu

SEQ ID NO: 7257 - RNA, 21 nt, Artificial Sequence
  Ebola virus siRNA sense strand
gugaugucgacaaacuaguuu

SEQ ID NO: 7258 - RNA, 21 nt, Artificial Sequence
  Ebola virus siRNA sense strand
ugaugucgacaaacuaguuug

SEQ ID NO: 7259 - RNA, 21 nt, Artificial Sequence
  Ebola virus siRNA sense strand
gaugucgacaaacuaguuugu

SEQ ID NO: 7260 - RNA, 21 nt, Artificial Sequence
  Ebola virus siRNA sense strand
augucgacaaacuaguuuguc

SEQ ID NO: 7261 - RNA, 21 nt, Artificial Sequence
  Ebola virus siRNA sense strand
ugucgacaaacuaguuugucg

SEQ ID NO: 7262 - RNA, 21 nt, Artificial Sequence
  Ebola virus siRNA sense strand
gucgacaaacuaguuugucgu

SEQ ID NO: 7263 - RNA, 21 nt, Artificial Sequence
  Ebola virus siRNA sense strand
ucgacaaacuaguuugucgug

SEQ ID NO: 7264 - RNA, 21 nt, Artificial Sequence
  Ebola virus siRNA sense strand
cgacaaacuaguuugucguga

SEQ ID NO: 7265 - RNA, 21 nt, Artificial Sequence
  Ebola virus siRNA sense strand
gacaaacuaguuugucgugac

SEQ ID NO: 7266 - RNA, 21 nt, Artificial Sequence
  Ebola virus siRNA sense strand
acaaacuaguuugucgugaca

SEQ ID NO: 7267 - RNA, 21 nt, Artificial Sequence
  Ebola virus siRNA sense strand
caaacuaguuugucgugacaa

SEQ ID NO: 7268 - RNA, 21 nt, Artificial Sequence
  Ebola virus siRNA sense strand
aaacuaguuugucgugacaaa

SEQ ID NO: 7269 - RNA, 21 nt, Artificial Sequence
  Ebola virus siRNA sense strand
aacuaguuugucgugacaaac

SEQ ID NO: 7270 - RNA, 21 nt, Artificial Sequence
  Ebola virus siRNA sense strand
acuaguuugucgugacaaacu

SEQ ID NO: 7271 - RNA, 21 nt, Artificial Sequence
  Ebola virus siRNA sense strand
cuaguuugucgugacaaacug

SEQ ID NO: 7272 - RNA, 21 nt, Artificial Sequence
  Ebola virus siRNA sense strand
uaguuugucgugacaaacugu

SEQ ID NO: 7273 - RNA, 21 nt, Artificial Sequence
  Ebola virus siRNA sense strand
aguuugucgugacaaacuguc

SEQ ID NO: 7274 - RNA, 21 nt, Artificial Sequence
  Ebola virus siRNA sense strand
guuugucgugacaaacuguca

SEQ ID NO: 7275 - RNA, 21 nt, Artificial Sequence
  Ebola virus siRNA sense strand
uuugucgugacaaacugucau

SEQ ID NO: 7276 - RNA, 21 nt, Artificial Sequence
  Ebola virus siRNA sense strand
uugucgugacaaacugucauc

SEQ ID NO: 7277 - RNA, 21 nt, Artificial Sequence
  Ebola virus siRNA sense strand
ugucgugacaaacugucaucc

SEQ ID NO: 7278 - RNA, 21 nt, Artificial Sequence
  Ebola virus siRNA sense strand
gucgugacaaacugucaucca

SEQ ID NO: 7279 - RNA, 21 nt, Artificial Sequence
  Ebola virus siRNA sense strand
ucgugacaaacugucauccac

SEQ ID NO: 7280 - RNA, 21 nt, Artificial Sequence
  Ebola virus siRNA sense strand
cgugacaaacugucauccaca

SEQ ID NO: 7281 - RNA, 21 nt, Artificial Sequence
  Ebola virus siRNA sense strand
gugacaaacugucauccacaa

SEQ ID NO: 7282 - RNA, 21 nt, Artificial Sequence
  Ebola virus siRNA sense strand
ugacaaacugucauccacaaa

SEQ ID NO: 7283 - RNA, 21 nt, Artificial Sequence
  Ebola virus siRNA sense strand
gacaaacugucauccacaaau

SEQ ID NO: 7284 - RNA, 21 nt, Artificial Sequence
  Ebola virus siRNA sense strand
acaaacugucauccacaaauc

SEQ ID NO: 7285 - RNA, 21 nt, Artificial Sequence
  Ebola virus siRNA sense strand
caaacugucauccacaaauca

SEQ ID NO: 7286 - RNA, 21 nt, Artificial Sequence
  Ebola virus siRNA sense strand
aaacugucauccacaaaucaa

SEQ ID NO: 7287 - RNA, 21 nt, Artificial Sequence
  Ebola virus siRNA sense strand
aacugucauccacaaaucaau

SEQ ID NO: 7288 - RNA, 21 nt, Artificial Sequence
  Ebola virus siRNA sense strand
acugucauccacaaaucaauu

SEQ ID NO: 7289 - RNA, 21 nt, Artificial Sequence
  Ebola virus siRNA sense strand
cugucauccacaaaucaauug

SEQ ID NO: 7290 - RNA, 21 nt, Artificial Sequence
  Ebola virus siRNA sense strand
ugucauccacaaaucaauuga

SEQ ID NO: 7291 - RNA, 21 nt, Artificial Sequence
  Ebola virus siRNA sense strand
gucauccacaaaucaauugag

SEQ ID NO: 7292 - RNA, 21 nt, Artificial Sequence
  Ebola virus siRNA sense strand
ucauccacaaaucaauugaga

SEQ ID NO: 7293 - RNA, 21 nt, Artificial Sequence
  Ebola virus siRNA sense strand
cauccacaaaucaauugagau

SEQ ID NO: 7294 - RNA, 21 nt, Artificial Sequence
  Ebola virus siRNA sense strand
auccacaaaucaauugagauc

SEQ ID NO: 7295 - RNA, 21 nt, Artificial Sequence
  Ebola virus siRNA sense strand
uccacaaaucaauugagauca

SEQ ID NO: 7296 - RNA, 21 nt, Artificial Sequence
  Ebola virus siRNA sense strand
ccacaaaucaauugagaucag

SEQ ID NO: 7297 - RNA, 21 nt, Artificial Sequence
  Ebola virus siRNA sense strand
cacaaaucaauugagaucagu

SEQ ID NO: 7298 - RNA, 21 nt, Artificial Sequence
  Ebola virus siRNA sense strand
acaaaucaauugagaucaguu

SEQ ID NO: 7299 - RNA, 21 nt, Artificial Sequence
  Ebola virus siRNA sense strand
caaaucaauugagaucaguug

SEQ ID NO: 7300 - RNA, 21 nt, Artificial Sequence
  Ebola virus siRNA sense strand
aaaucaauugagaucaguugg

SEQ ID NO: 7301 - RNA, 21 nt, Artificial Sequence
  Ebola virus siRNA sense strand
aaucaauugagaucaguugga

SEQ ID NO: 7302 - RNA, 21 nt, Artificial Sequence
  Ebola virus siRNA sense strand
aucaauugagaucaguuggac

SEQ ID NO: 7303 - RNA, 21 nt, Artificial Sequence
  Ebola virus siRNA sense strand
ucaauugagaucaguuggacu

SEQ ID NO: 7304 - RNA, 21 nt, Artificial Sequence
  Ebola virus siRNA sense strand
caauugagaucaguuggacug

SEQ ID NO: 7305 - RNA, 21 nt, Artificial Sequence
  Ebola virus siRNA sense strand
aauugagaucaguuggacuga

SEQ ID NO: 7306 - RNA, 21 nt, Artificial Sequence
  Ebola virus siRNA sense strand
auugagaucaguuggacugaa

SEQ ID NO: 7307 - RNA, 21 nt, Artificial Sequence
  Ebola virus siRNA sense strand
uugagaucaguuggacugaau

SEQ ID NO: 7308 - RNA, 21 nt, Artificial Sequence
  Ebola virus siRNA sense strand
ugagaucaguuggacugaauc

SEQ ID NO: 7309 - RNA, 21 nt, Artificial Sequence
  Ebola virus siRNA sense strand
gagaucaguuggacugaaucu

SEQ ID NO: 7310 - RNA, 21 nt, Artificial Sequence
  Ebola virus siRNA sense strand
agaucaguuggacugaaucuc

SEQ ID NO: 7311 - RNA, 21 nt, Artificial Sequence
  Ebola virus siRNA sense strand
gaucaguuggacugaaucucg

SEQ ID NO: 7312 - RNA, 21 nt, Artificial Sequence
  Ebola virus siRNA sense strand
aucaguuggacugaaucucga

SEQ ID NO: 7313 - RNA, 21 nt, Artificial Sequence
  Ebola virus siRNA sense strand
ucaguuggacugaaucucgaa

SEQ ID NO: 7314 - RNA, 21 nt, Artificial Sequence
  Ebola virus siRNA sense strand
caguuggacugaaucucgaag

SEQ ID NO: 7315 - RNA, 21 nt, Artificial Sequence
  Ebola virus siRNA sense strand
aguuggacugaaucucgaagg

SEQ ID NO: 7316 - RNA, 21 nt, Artificial Sequence
  Ebola virus siRNA sense strand
guuggacugaaucucgaaggg

SEQ ID NO: 7317 - RNA, 21 nt, Artificial Sequence
  Ebola virus siRNA sense strand
uuggacugaaucucgaaggga

SEQ ID NO: 7318 - RNA, 21 nt, Artificial Sequence
  Ebola virus siRNA sense strand
uggacugaaucucgaagggaa

SEQ ID NO: 7319 - RNA, 21 nt, Artificial Sequence
  Ebola virus siRNA sense strand
ggacugaaucucgaagggaau

SEQ ID NO: 7320 - RNA, 21 nt, Artificial Sequence
  Ebola virus siRNA sense strand
gacugaaucucgaagggaaug

SEQ ID NO: 7321 - RNA, 21 nt, Artificial Sequence
  Ebola virus siRNA sense strand
acugaaucucgaagggaaugg

SEQ ID NO: 7322 - RNA, 21 nt, Artificial Sequence
  Ebola virus siRNA sense strand
cugaaucucgaagggaaugga

SEQ ID NO: 7323 - RNA, 21 nt, Artificial Sequence
  Ebola virus siRNA sense strand
ugaaucucgaagggaauggag

SEQ ID NO: 7324 - RNA, 21 nt, Artificial Sequence
  Ebola virus siRNA sense strand
gaaucucgaagggaauggagu

SEQ ID NO: 7325 - RNA, 21 nt, Artificial Sequence
  Ebola virus siRNA sense strand
aaucucgaagggaauggagug

SEQ ID NO: 7326 - RNA, 21 nt, Artificial Sequence
  Ebola virus siRNA sense strand
aucucgaagggaauggagugg

SEQ ID NO: 7327 - RNA, 21 nt, Artificial Sequence
  Ebola virus siRNA sense strand
ucucgaagggaauggaguggc

SEQ ID NO: 7328 - RNA, 21 nt, Artificial Sequence
  Ebola virus siRNA sense strand
cucgaagggaauggaguggca

SEQ ID NO: 7329 - RNA, 21 nt, Artificial Sequence
  Ebola virus siRNA sense strand
ucgaagggaauggaguggcaa

SEQ ID NO: 7330 - RNA, 21 nt, Artificial Sequence
  Ebola virus siRNA sense strand
cgaagggaauggaguggcaac

SEQ ID NO: 7331 - RNA, 21 nt, Artificial Sequence
  Ebola virus siRNA sense strand
gaagggaauggaguggcaacu

SEQ ID NO: 7332 - RNA, 21 nt, Artificial Sequence
  Ebola virus siRNA sense strand
aagggaauggaguggcaacug

SEQ ID NO: 7333 - RNA, 21 nt, Artificial Sequence
  Ebola virus siRNA sense strand
agggaauggaguggcaacuga

SEQ ID NO: 7334 - RNA, 21 nt, Artificial Sequence
  Ebola virus siRNA sense strand
gggaauggaguggcaacugac

SEQ ID NO: 7335 - RNA, 21 nt, Artificial Sequence
  Ebola virus siRNA sense strand
ggaauggaguggcaacugacg

SEQ ID NO: 7336 - RNA, 21 nt, Artificial Sequence
  Ebola virus siRNA sense strand
gaauggaguggcaacugacgu

SEQ ID NO: 7337 - RNA, 21 nt, Artificial Sequence
  Ebola virus siRNA sense strand
aauggaguggcaacugacgug

SEQ ID NO: 7338 - RNA, 21 nt, Artificial Sequence
  Ebola virus siRNA sense strand
auggaguggcaacugacgugc

SEQ ID NO: 7339 - RNA, 21 nt, Artificial Sequence
  Ebola virus siRNA sense strand
uggaguggcaacugacgugcc

SEQ ID NO: 7340 - RNA, 21 nt, Artificial Sequence
  Ebola virus siRNA sense strand
ggaguggcaacugacgugcca

SEQ ID NO: 7341 - RNA, 21 nt, Artificial Sequence
  Ebola virus siRNA sense strand
gaguggcaacugacgugccau

SEQ ID NO: 7342 - RNA, 21 nt, Artificial Sequence
  Ebola virus siRNA sense strand
aguggcaacugacgugccauc

SEQ ID NO: 7343 - RNA, 21 nt, Artificial Sequence
  Ebola virus siRNA sense strand
guggcaacugacgugccaucu

SEQ ID NO: 7344 - RNA, 21 nt, Artificial Sequence
  Ebola virus siRNA sense strand
uggcaacugacgugccaucug

SEQ ID NO: 7345 - RNA, 21 nt, Artificial Sequence
  Ebola virus siRNA sense strand
ggcaacugacgugccaucugc

SEQ ID NO: 7346 - RNA, 21 nt, Artificial Sequence
  Ebola virus siRNA sense strand
gcaacugacgugccaucugca

SEQ ID NO: 7347 - RNA, 21 nt, Artificial Sequence
  Ebola virus siRNA sense strand
caacugacgugccaucugcaa

SEQ ID NO: 7348 - RNA, 21 nt, Artificial Sequence
  Ebola virus siRNA sense strand
aacugacgugccaucugcaac

SEQ ID NO: 7349 - RNA, 21 nt, Artificial Sequence
  Ebola virus siRNA sense strand
acugacgugccaucugcaacu

SEQ ID NO: 7350 - RNA, 21 nt, Artificial Sequence
  Ebola virus siRNA sense strand
cugacgugccaucugcaacua

SEQ ID NO: 7351 - RNA, 21 nt, Artificial Sequence
  Ebola virus siRNA sense strand
ugacgugccaucugcaacuaa

SEQ ID NO: 7352 - RNA, 21 nt, Artificial Sequence
  Ebola virus siRNA sense strand
gacgugccaucugcaacuaaa

SEQ ID NO: 7353 - RNA, 21 nt, Artificial Sequence
  Ebola virus siRNA sense strand
acgugccaucugcaacuaaaa

SEQ ID NO: 7354 - RNA, 21 nt, Artificial Sequence
  Ebola virus siRNA sense strand
cgugccaucugcaacuaaaag

SEQ ID NO: 7355 - RNA, 21 nt, Artificial Sequence
  Ebola virus siRNA sense strand
gugccaucugcaacuaaaaga

SEQ ID NO: 7356 - RNA, 21 nt, Artificial Sequence
  Ebola virus siRNA sense strand
ugccaucugcaacuaaaagau

SEQ ID NO: 7357 - RNA, 21 nt, Artificial Sequence
  Ebola virus siRNA sense strand
gccaucugcaacuaaaagaug

SEQ ID NO: 7358 - RNA, 21 nt, Artificial Sequence
  Ebola virus siRNA sense strand
ccaucugcaacuaaaagaugg

SEQ ID NO: 7359 - RNA, 21 nt, Artificial Sequence
  Ebola virus siRNA sense strand
caucugcaacuaaaagauggg

SEQ ID NO: 7360 - RNA, 21 nt, Artificial Sequence
  Ebola virus siRNA sense strand
aucugcaacuaaaagaugggg

SEQ ID NO: 7361 - RNA, 21 nt, Artificial Sequence
  Ebola virus siRNA sense strand
ucugcaacuaaaagauggggc

SEQ ID NO: 7362 - RNA, 21 nt, Artificial Sequence
  Ebola virus siRNA sense strand
cugcaacuaaaagauggggcu

SEQ ID NO: 7363 - RNA, 21 nt, Artificial Sequence
  Ebola virus siRNA sense strand
ugcaacuaaaagauggggcuu

SEQ ID NO: 7364 - RNA, 21 nt, Artificial Sequence
  Ebola virus siRNA sense strand
gcaacuaaaagauggggcuuc

SEQ ID NO: 7365 - RNA, 21 nt, Artificial Sequence
  Ebola virus siRNA sense strand
caacuaaaagauggggcuuca

SEQ ID NO: 7366 - RNA, 21 nt, Artificial Sequence
  Ebola virus siRNA sense strand
aacuaaaagauggggcuucag

SEQ ID NO: 7367 - RNA, 21 nt, Artificial Sequence
  Ebola virus siRNA sense strand
acuaaaagauggggcuucagg

SEQ ID NO: 7368 - RNA, 21 nt, Artificial Sequence
  Ebola virus siRNA sense strand
cuaaaagauggggcuucaggu

SEQ ID NO: 7369 - RNA, 21 nt, Artificial Sequence
  Ebola virus siRNA sense strand
uaaaagauggggcuucagguc

SEQ ID NO: 7370 - RNA, 21 nt, Artificial Sequence
  Ebola virus siRNA sense strand
aaaagauggggcuucaggucc

SEQ ID NO: 7371 - RNA, 21 nt, Artificial Sequence
  Ebola virus siRNA sense strand
aaagauggggcuucagguccg

SEQ ID NO: 7372 - RNA, 21 nt, Artificial Sequence
  Ebola virus siRNA sense strand
aagauggggcuucagguccgg

SEQ ID NO: 7373 - RNA, 21 nt, Artificial Sequence
  Ebola virus siRNA sense strand
agauggggcuucagguccggu

SEQ ID NO: 7374 - RNA, 21 nt, Artificial Sequence
  Ebola virus siRNA sense strand
gauggggcuucagguccggug

SEQ ID NO: 7375 - RNA, 21 nt, Artificial Sequence
  Ebola virus siRNA sense strand
auggggcuucagguccggugu

SEQ ID NO: 7376 - RNA, 21 nt, Artificial Sequence
  Ebola virus siRNA sense strand
uggggcuucagguccgguguc

SEQ ID NO: 7377 - RNA, 21 nt, Artificial Sequence
  Ebola virus siRNA sense strand
ggggcuucagguccggugucc

SEQ ID NO: 7378 - RNA, 21 nt, Artificial Sequence
  Ebola virus siRNA sense strand
gggcuucagguccgguguccc

SEQ ID NO: 7379 - RNA, 21 nt, Artificial Sequence
  Ebola virus siRNA sense strand
ggcuucagguccgguguccca

SEQ ID NO: 7380 - RNA, 21 nt, Artificial Sequence
  Ebola virus siRNA sense strand
gcuucagguccggugucccac

SEQ ID NO: 7381 - RNA, 21 nt, Artificial Sequence
  Ebola virus siRNA sense strand
cuucagguccggugucccacc

SEQ ID NO: 7382 - RNA, 21 nt, Artificial Sequence
  Ebola virus siRNA sense strand
uucagguccggugucccacca

SEQ ID NO: 7383 - RNA, 21 nt, Artificial Sequence
  Ebola virus siRNA sense strand
ucagguccggugucccaccaa

SEQ ID NO: 7384 - RNA, 21 nt, Artificial Sequence
  Ebola virus siRNA sense strand
cagguccggugucccaccaaa

SEQ ID NO: 7385 - RNA, 21 nt, Artificial Sequence
  Ebola virus siRNA sense strand
agguccggugucccaccaaag

SEQ ID NO: 7386 - RNA, 21 nt, Artificial Sequence
  Ebola virus siRNA sense strand
gguccggugucccaccaaagg

SEQ ID NO: 7387 - RNA, 21 nt, Artificial Sequence
  Ebola virus siRNA sense strand
guccggugucccaccaaaggu

SEQ ID NO: 7388 - RNA, 21 nt, Artificial Sequence
  Ebola virus siRNA sense strand
uccggugucccaccaaaggug

SEQ ID NO: 7389 - RNA, 21 nt, Artificial Sequence
  Ebola virus siRNA sense strand
ccggugucccaccaaaggugg

SEQ ID NO: 7390 - RNA, 21 nt, Artificial Sequence
  Ebola virus siRNA sense strand
cggugucccaccaaagguggu

SEQ ID NO: 7391 - RNA, 21 nt, Artificial Sequence
  Ebola virus siRNA sense strand
ggugucccaccaaaggugguc

SEQ ID NO: 7392 - RNA, 21 nt, Artificial Sequence
  Ebola virus siRNA sense strand
gugucccaccaaaggugguca

SEQ ID NO: 7393 - RNA, 21 nt, Artificial Sequence
  Ebola virus siRNA sense strand
ugucccaccaaagguggucaa

SEQ ID NO: 7394 - RNA, 21 nt, Artificial Sequence
  Ebola virus siRNA sense strand
gucccaccaaagguggucaau

SEQ ID NO: 7395 - RNA, 21 nt, Artificial Sequence
  Ebola virus siRNA sense strand
ucccaccaaagguggucaauu

SEQ ID NO: 7396 - RNA, 21 nt, Artificial Sequence
  Ebola virus siRNA sense strand
cccaccaaagguggucaauua

SEQ ID NO: 7397 - RNA, 21 nt, Artificial Sequence
  Ebola virus siRNA sense strand
ccaccaaagguggucaauuau

SEQ ID NO: 7398 - RNA, 21 nt, Artificial Sequence
  Ebola virus siRNA sense strand
caccaaagguggucaauuaug

SEQ ID NO: 7399 - RNA, 21 nt, Artificial Sequence
  Ebola virus siRNA sense strand
accaaagguggucaauuauga

SEQ ID NO: 7400 - RNA, 21 nt, Artificial Sequence
  Ebola virus siRNA sense strand
ccaaagguggucaauuaugaa

SEQ ID NO: 7401 - RNA, 21 nt, Artificial Sequence
  Ebola virus siRNA sense strand
caaagguggucaauuaugaag

SEQ ID NO: 7402 - RNA, 21 nt, Artificial Sequence
  Ebola virus siRNA sense strand
aaagguggucaauuaugaagc

SEQ ID NO: 7403 - RNA, 21 nt, Artificial Sequence
  Ebola virus siRNA sense strand
aagguggucaauuaugaagcu

SEQ ID NO: 7404 - RNA, 21 nt, Artificial Sequence
  Ebola virus siRNA sense strand
agguggucaauuaugaagcug

SEQ ID NO: 7405 - RNA, 21 nt, Artificial Sequence
  Ebola virus siRNA sense strand
gguggucaauuaugaagcugg

SEQ ID NO: 7406 - RNA, 21 nt, Artificial Sequence
  Ebola virus siRNA sense strand
guggucaauuaugaagcuggu

SEQ ID NO: 7407 - RNA, 21 nt, Artificial Sequence
  Ebola virus siRNA sense strand
uggucaauuaugaagcuggug

SEQ ID NO: 7408 - RNA, 21 nt, Artificial Sequence
  Ebola virus siRNA sense strand
ggucaauuaugaagcugguga

SEQ ID NO: 7409 - RNA, 21 nt, Artificial Sequence
  Ebola virus siRNA sense strand
gucaauuaugaagcuggugaa

SEQ ID NO: 7410 - RNA, 21 nt, Artificial Sequence
  Ebola virus siRNA sense strand
ucaauuaugaagcuggugaau

SEQ ID NO: 7411 - RNA, 21 nt, Artificial Sequence
  Ebola virus siRNA sense strand
caauuaugaagcuggugaaug

SEQ ID NO: 7412 - RNA, 21 nt, Artificial Sequence
  Ebola virus siRNA sense strand
aauuaugaagcuggugaaugg

SEQ ID NO: 7413 - RNA, 21 nt, Artificial Sequence
  Ebola virus siRNA sense strand
auuaugaagcuggugaauggg

SEQ ID NO: 7414 - RNA, 21 nt, Artificial Sequence
  Ebola virus siRNA sense strand
uuaugaagcuggugaaugggc

SEQ ID NO: 7415 - RNA, 21 nt, Artificial Sequence
  Ebola virus siRNA sense strand
uaugaagcuggugaaugggcu

SEQ ID NO: 7416 - RNA, 21 nt, Artificial Sequence
  Ebola virus siRNA sense strand
augaagcuggugaaugggcug

SEQ ID NO: 7417 - RNA, 21 nt, Artificial Sequence
  Ebola virus siRNA sense strand
ugaagcuggugaaugggcuga

SEQ ID NO: 7418 - RNA, 21 nt, Artificial Sequence
  Ebola virus siRNA sense strand
gaagcuggugaaugggcugaa

SEQ ID NO: 7419 - RNA, 21 nt, Artificial Sequence
  Ebola virus siRNA sense strand
aagcuggugaaugggcugaaa

SEQ ID NO: 7420 - RNA, 21 nt, Artificial Sequence
  Ebola virus siRNA sense strand
agcuggugaaugggcugaaaa

SEQ ID NO: 7421 - RNA, 21 nt, Artificial Sequence
  Ebola virus siRNA sense strand
gcuggugaaugggcugaaaac

SEQ ID NO: 7422 - RNA, 21 nt, Artificial Sequence
  Ebola virus siRNA sense strand
cuggugaaugggcugaaaacu

SEQ ID NO: 7423 - RNA, 21 nt, Artificial Sequence
  Ebola virus siRNA sense strand
uggugaaugggcugaaaacug

SEQ ID NO: 7424 - RNA, 21 nt, Artificial Sequence
  Ebola virus siRNA sense strand
ggugaaugggcugaaaacugc

SEQ ID NO: 7425 - RNA, 21 nt, Artificial Sequence
  Ebola virus siRNA sense strand
gugaaugggcugaaaacugcu

SEQ ID NO: 7426 - RNA, 21 nt, Artificial Sequence
  Ebola virus siRNA sense strand
ugaaugggcugaaaacugcua

SEQ ID NO: 7427 - RNA, 21 nt, Artificial Sequence
  Ebola virus siRNA sense strand
gaaugggcugaaaacugcuac

SEQ ID NO: 7428 - RNA, 21 nt, Artificial Sequence
  Ebola virus siRNA sense strand
aaugggcugaaaacugcuaca

SEQ ID NO: 7429 - RNA, 21 nt, Artificial Sequence
  Ebola virus siRNA sense strand
augggcugaaaacugcuacaa

SEQ ID NO: 7430 - RNA, 21 nt, Artificial Sequence
  Ebola virus siRNA sense strand
ugggcugaaaacugcuacaau

SEQ ID NO: 7431 - RNA, 21 nt, Artificial Sequence
  Ebola virus siRNA sense strand
gggcugaaaacugcuacaauc

SEQ ID NO: 7432 - RNA, 21 nt, Artificial Sequence
  Ebola virus siRNA sense strand
ggcugaaaacugcuacaaucu

SEQ ID NO: 7433 - RNA, 21 nt, Artificial Sequence
  Ebola virus siRNA sense strand
gcugaaaacugcuacaaucuu

SEQ ID NO: 7434 - RNA, 21 nt, Artificial Sequence
  Ebola virus siRNA sense strand
cugaaaacugcuacaaucuug

SEQ ID NO: 7435 - RNA, 21 nt, Artificial Sequence
  Ebola virus siRNA sense strand
ugaaaacugcuacaaucuuga

SEQ ID NO: 7436 - RNA, 21 nt, Artificial Sequence
  Ebola virus siRNA sense strand
gaaaacugcuacaaucuugaa

SEQ ID NO: 7437 - RNA, 21 nt, Artificial Sequence
  Ebola virus siRNA sense strand
aaaacugcuacaaucuugaaa

SEQ ID NO: 7438 - RNA, 21 nt, Artificial Sequence
  Ebola virus siRNA sense strand
aaacugcuacaaucuugaaau

SEQ ID NO: 7439 - RNA, 21 nt, Artificial Sequence
  Ebola virus siRNA sense strand
aacugcuacaaucuugaaauc

SEQ ID NO: 7440 - RNA, 21 nt, Artificial Sequence
  Ebola virus siRNA sense strand
acugcuacaaucuugaaauca

SEQ ID NO: 7441 - RNA, 21 nt, Artificial Sequence
  Ebola virus siRNA sense strand
cugcuacaaucuugaaaucaa

SEQ ID NO: 7442 - RNA, 21 nt, Artificial Sequence
  Ebola virus siRNA sense strand
ugcuacaaucuugaaaucaaa

SEQ ID NO: 7443 - RNA, 21 nt, Artificial Sequence
  Ebola virus siRNA sense strand
gcuacaaucuugaaaucaaaa

SEQ ID NO: 7444 - RNA, 21 nt, Artificial Sequence
  Ebola virus siRNA sense strand
cuacaaucuugaaaucaaaaa

SEQ ID NO: 7445 - RNA, 21 nt, Artificial Sequence
  Ebola virus siRNA sense strand
uacaaucuugaaaucaaaaaa

SEQ ID NO: 7446 - RNA, 21 nt, Artificial Sequence
  Ebola virus siRNA sense strand
acaaucuugaaaucaaaaaac

SEQ ID NO: 7447 - RNA, 21 nt, Artificial Sequence
  Ebola virus siRNA sense strand
caaucuugaaaucaaaaaacc

SEQ ID NO: 7448 - RNA, 21 nt, Artificial Sequence
  Ebola virus siRNA sense strand
aaucuugaaaucaaaaaaccu

SEQ ID NO: 7449 - RNA, 21 nt, Artificial Sequence
  Ebola virus siRNA sense strand
aucuugaaaucaaaaaaccug

SEQ ID NO: 7450 - RNA, 21 nt, Artificial Sequence
  Ebola virus siRNA sense strand
ucuugaaaucaaaaaaccuga

SEQ ID NO: 7451 - RNA, 21 nt, Artificial Sequence
  Ebola virus siRNA sense strand
cuugaaaucaaaaaaccugac

SEQ ID NO: 7452 - RNA, 21 nt, Artificial Sequence
  Ebola virus siRNA sense strand
uugaaaucaaaaaaccugacg

SEQ ID NO: 7453 - RNA, 21 nt, Artificial Sequence
  Ebola virus siRNA sense strand
ugaaaucaaaaaaccugacgg

SEQ ID NO: 7454 - RNA, 21 nt, Artificial Sequence
  Ebola virus siRNA sense strand
gaaaucaaaaaaccugacggg

SEQ ID NO: 7455 - RNA, 21 nt, Artificial Sequence
  Ebola virus siRNA sense strand
aaaucaaaaaaccugacggga

SEQ ID NO: 7456 - RNA, 21 nt, Artificial Sequence
  Ebola virus siRNA sense strand
aaucaaaaaaccugacgggag

SEQ ID NO: 7457 - RNA, 21 nt, Artificial Sequence
  Ebola virus siRNA sense strand
aucaaaaaaccugacgggagu

SEQ ID NO: 7458 - RNA, 21 nt, Artificial Sequence
  Ebola virus siRNA sense strand
ucaaaaaaccugacgggagug

SEQ ID NO: 7459 - RNA, 21 nt, Artificial Sequence
  Ebola virus siRNA sense strand
caaaaaaccugacgggaguga

SEQ ID NO: 7460 - RNA, 21 nt, Artificial Sequence
  Ebola virus siRNA sense strand
aaaaaaccugacgggagugag

SEQ ID NO: 7461 - RNA, 21 nt, Artificial Sequence
  Ebola virus siRNA sense strand
aaaaaccugacgggagugagu

SEQ ID NO: 7462 - RNA, 21 nt, Artificial Sequence
  Ebola virus siRNA sense strand
aaaaccugacgggagugagug

SEQ ID NO: 7463 - RNA, 21 nt, Artificial Sequence
  Ebola virus siRNA sense strand
aaaccugacgggagugagugu

SEQ ID NO: 7464 - RNA, 21 nt, Artificial Sequence
  Ebola virus siRNA sense strand
aaccugacgggagugaguguc

SEQ ID NO: 7465 - RNA, 21 nt, Artificial Sequence
  Ebola virus siRNA sense strand
accugacgggagugagugucu

SEQ ID NO: 7466 - RNA, 21 nt, Artificial Sequence
  Ebola virus siRNA sense strand
ccugacgggagugagugucua

SEQ ID NO: 7467 - RNA, 21 nt, Artificial Sequence
  Ebola virus siRNA sense strand
cugacgggagugagugucuac

SEQ ID NO: 7468 - RNA, 21 nt, Artificial Sequence
  Ebola virus siRNA sense strand
ugacgggagugagugucuacc

SEQ ID NO: 7469 - RNA, 21 nt, Artificial Sequence
  Ebola virus siRNA sense strand
gacgggagugagugucuacca

SEQ ID NO: 7470 - RNA, 21 nt, Artificial Sequence
  Ebola virus siRNA sense strand
acgggagugagugucuaccag

SEQ ID NO: 7471 - RNA, 21 nt, Artificial Sequence
  Ebola virus siRNA sense strand
cgggagugagugucuaccagc

SEQ ID NO: 7472 - RNA, 21 nt, Artificial Sequence
  Ebola virus siRNA sense strand
gggagugagugucuaccagca

SEQ ID NO: 7473 - RNA, 21 nt, Artificial Sequence
  Ebola virus siRNA sense strand
ggagugagugucuaccagcag

SEQ ID NO: 7474 - RNA, 21 nt, Artificial Sequence
  Ebola virus siRNA sense strand
gagugagugucuaccagcagc

SEQ ID NO: 7475 - RNA, 21 nt, Artificial Sequence
  Ebola virus siRNA sense strand
agugagugucuaccagcagcg

SEQ ID NO: 7476 - RNA, 21 nt, Artificial Sequence
  Ebola virus siRNA sense strand
gugagugucuaccagcagcgc

SEQ ID NO: 7477 - RNA, 21 nt, Artificial Sequence
  Ebola virus siRNA sense strand
ugagugucuaccagcagcgcc

SEQ ID NO: 7478 - RNA, 21 nt, Artificial Sequence
  Ebola virus siRNA sense strand
gagugucuaccagcagcgcca

SEQ ID NO: 7479 - RNA, 21 nt, Artificial Sequence
  Ebola virus siRNA sense strand
agugucuaccagcagcgccag

SEQ ID NO: 7480 - RNA, 21 nt, Artificial Sequence
  Ebola virus siRNA sense strand
gugucuaccagcagcgccaga

SEQ ID NO: 7481 - RNA, 21 nt, Artificial Sequence
  Ebola virus siRNA sense strand
ugucuaccagcagcgccagac

SEQ ID NO: 7482 - RNA, 21 nt, Artificial Sequence
  Ebola virus siRNA sense strand
gucuaccagcagcgccagacg

SEQ ID NO: 7483 - RNA, 21 nt, Artificial Sequence
  Ebola virus siRNA sense strand
ucuaccagcagcgccagacgg

SEQ ID NO: 7484 - RNA, 21 nt, Artificial Sequence
  Ebola virus siRNA sense strand
cuaccagcagcgccagacggg

SEQ ID NO: 7485 - RNA, 21 nt, Artificial Sequence
  Ebola virus siRNA sense strand
uaccagcagcgccagacggga

SEQ ID NO: 7486 - RNA, 21 nt, Artificial Sequence
  Ebola virus siRNA sense strand
accagcagcgccagacgggau

SEQ ID NO: 7487 - RNA, 21 nt, Artificial Sequence
  Ebola virus siRNA sense strand
ccagcagcgccagacgggauu

SEQ ID NO: 7488 - RNA, 21 nt, Artificial Sequence
  Ebola virus siRNA sense strand
cagcagcgccagacgggauuc

SEQ ID NO: 7489 - RNA, 21 nt, Artificial Sequence
  Ebola virus siRNA sense strand
agcagcgccagacgggauucg

SEQ ID NO: 7490 - RNA, 21 nt, Artificial Sequence
  Ebola virus siRNA sense strand
gcagcgccagacgggauucgg

SEQ ID NO: 7491 - RNA, 21 nt, Artificial Sequence
  Ebola virus siRNA sense strand
cagcgccagacgggauucggg

SEQ ID NO: 7492 - RNA, 21 nt, Artificial Sequence
  Ebola virus siRNA sense strand
agcgccagacgggauucgggg

SEQ ID NO: 7493 - RNA, 21 nt, Artificial Sequence
  Ebola virus siRNA sense strand
gcgccagacgggauucggggc

SEQ ID NO: 7494 - RNA, 21 nt, Artificial Sequence
  Ebola virus siRNA sense strand
cgccagacgggauucggggcu

SEQ ID NO: 7495 - RNA, 21 nt, Artificial Sequence
  Ebola virus siRNA sense strand
gccagacgggauucggggcuu

SEQ ID NO: 7496 - RNA, 21 nt, Artificial Sequence
  Ebola virus siRNA sense strand
ccagacgggauucggggcuuc

SEQ ID NO: 7497 - RNA, 21 nt, Artificial Sequence
  Ebola virus siRNA sense strand
cagacgggauucggggcuucc

SEQ ID NO: 7498 - RNA, 21 nt, Artificial Sequence
  Ebola virus siRNA sense strand
agacgggauucggggcuuccc

SEQ ID NO: 7499 - RNA, 21 nt, Artificial Sequence
  Ebola virus siRNA sense strand
gacgggauucggggcuucccc

SEQ ID NO: 7500 - RNA, 21 nt, Artificial Sequence
  Ebola virus siRNA sense strand
acgggauucggggcuuccccc

SEQ ID NO: 7501 - RNA, 21 nt, Artificial Sequence
  Ebola virus siRNA sense strand
cgggauucggggcuucccccg

SEQ ID NO: 7502 - RNA, 21 nt, Artificial Sequence
  Ebola virus siRNA sense strand
gggauucggggcuucccccgg

SEQ ID NO: 7503 - RNA, 21 nt, Artificial Sequence
  Ebola virus siRNA sense strand
ggauucggggcuucccccggu

SEQ ID NO: 7504 - RNA, 21 nt, Artificial Sequence
  Ebola virus siRNA sense strand
gauucggggcuucccccggug

SEQ ID NO: 7505 - RNA, 21 nt, Artificial Sequence
  Ebola virus siRNA sense strand
auucggggcuucccccggugc

SEQ ID NO: 7506 - RNA, 21 nt, Artificial Sequence
  Ebola virus siRNA sense strand
uucggggcuucccccggugcc

SEQ ID NO: 7507 - RNA, 21 nt, Artificial Sequence
  Ebola virus siRNA sense strand
ucggggcuucccccggugccg

SEQ ID NO: 7508 - RNA, 21 nt, Artificial Sequence
  Ebola virus siRNA sense strand
cggggcuucccccggugccgg

SEQ ID NO: 7509 - RNA, 21 nt, Artificial Sequence
  Ebola virus siRNA sense strand
ggggcuucccccggugccggu

SEQ ID NO: 7510 - RNA, 21 nt, Artificial Sequence
  Ebola virus siRNA sense strand
gggcuucccccggugccggua

SEQ ID NO: 7511 - RNA, 21 nt, Artificial Sequence
  Ebola virus siRNA sense strand
ggcuucccccggugccgguau

SEQ ID NO: 7512 - RNA, 21 nt, Artificial Sequence
  Ebola virus siRNA sense strand
gcuucccccggugccgguaug

SEQ ID NO: 7513 - RNA, 21 nt, Artificial Sequence
  Ebola virus siRNA sense strand
cuucccccggugccgguaugu

SEQ ID NO: 7514 - RNA, 21 nt, Artificial Sequence
  Ebola virus siRNA sense strand
uucccccggugccgguaugug

SEQ ID NO: 7515 - RNA, 21 nt, Artificial Sequence
  Ebola virus siRNA sense strand
ucccccggugccgguaugugc

SEQ ID NO: 7516 - RNA, 21 nt, Artificial Sequence
  Ebola virus siRNA sense strand
cccccggugccgguaugugca

SEQ ID NO: 7517 - RNA, 21 nt, Artificial Sequence
  Ebola virus siRNA sense strand
ccccggugccgguaugugcac

SEQ ID NO: 7518 - RNA, 21 nt, Artificial Sequence
  Ebola virus siRNA sense strand
cccggugccgguaugugcaca

SEQ ID NO: 7519 - RNA, 21 nt, Artificial Sequence
  Ebola virus siRNA sense strand
ccggugccgguaugugcacaa

SEQ ID NO: 7520 - RNA, 21 nt, Artificial Sequence
  Ebola virus siRNA sense strand
cggugccgguaugugcacaaa

SEQ ID NO: 7521 - RNA, 21 nt, Artificial Sequence
  Ebola virus siRNA sense strand
ggugccgguaugugcacaaag

SEQ ID NO: 7522 - RNA, 21 nt, Artificial Sequence
  Ebola virus siRNA sense strand
gugccgguaugugcacaaagu

SEQ ID NO: 7523 - RNA, 21 nt, Artificial Sequence
  Ebola virus siRNA sense strand
ugccgguaugugcacaaagua

SEQ ID NO: 7524 - RNA, 21 nt, Artificial Sequence
  Ebola virus siRNA sense strand
gccgguaugugcacaaaguau

SEQ ID NO: 7525 - RNA, 21 nt, Artificial Sequence
  Ebola virus siRNA sense strand
ccgguaugugcacaaaguauc

SEQ ID NO: 7526 - RNA, 21 nt, Artificial Sequence
  Ebola virus siRNA sense strand
cgguaugugcacaaaguauca

SEQ ID NO: 7527 - RNA, 21 nt, Artificial Sequence
  Ebola virus siRNA sense strand
gguaugugcacaaaguaucag

SEQ ID NO: 7528 - RNA, 21 nt, Artificial Sequence
  Ebola virus siRNA sense strand
guaugugcacaaaguaucagg

SEQ ID NO: 7529 - RNA, 21 nt, Artificial Sequence
  Ebola virus siRNA sense strand
uaugugcacaaaguaucagga

SEQ ID NO: 7530 - RNA, 21 nt, Artificial Sequence
  Ebola virus siRNA sense strand
augugcacaaaguaucaggaa

SEQ ID NO: 7531 - RNA, 21 nt, Artificial Sequence
  Ebola virus siRNA sense strand
ugugcacaaaguaucaggaac

SEQ ID NO: 7532 - RNA, 21 nt, Artificial Sequence
  Ebola virus siRNA sense strand
gugcacaaaguaucaggaacg

SEQ ID NO: 7533 - RNA, 21 nt, Artificial Sequence
  Ebola virus siRNA sense strand
ugcacaaaguaucaggaacgg

SEQ ID NO: 7534 - RNA, 21 nt, Artificial Sequence
  Ebola virus siRNA sense strand
gcacaaaguaucaggaacggg

SEQ ID NO: 7535 - RNA, 21 nt, Artificial Sequence
  Ebola virus siRNA sense strand
cacaaaguaucaggaacggga

SEQ ID NO: 7536 - RNA, 21 nt, Artificial Sequence
  Ebola virus siRNA sense strand
acaaaguaucaggaacgggac

SEQ ID NO: 7537 - RNA, 21 nt, Artificial Sequence
  Ebola virus siRNA sense strand
caaaguaucaggaacgggacc

SEQ ID NO: 7538 - RNA, 21 nt, Artificial Sequence
  Ebola virus siRNA sense strand
aaaguaucaggaacgggaccg

SEQ ID NO: 7539 - RNA, 21 nt, Artificial Sequence
  Ebola virus siRNA sense strand
aaguaucaggaacgggaccgu

SEQ ID NO: 7540 - RNA, 21 nt, Artificial Sequence
  Ebola virus siRNA sense strand
aguaucaggaacgggaccgug

SEQ ID NO: 7541 - RNA, 21 nt, Artificial Sequence
  Ebola virus siRNA sense strand
guaucaggaacgggaccgugu

SEQ ID NO: 7542 - RNA, 21 nt, Artificial Sequence
  Ebola virus siRNA sense strand
uaucaggaacgggaccgugug

SEQ ID NO: 7543 - RNA, 21 nt, Artificial Sequence
  Ebola virus siRNA sense strand
aucaggaacgggaccgugugc

SEQ ID NO: 7544 - RNA, 21 nt, Artificial Sequence
  Ebola virus siRNA sense strand
ucaggaacgggaccgugugcc

SEQ ID NO: 7545 - RNA, 21 nt, Artificial Sequence
  Ebola virus siRNA sense strand
caggaacgggaccgugugccg

SEQ ID NO: 7546 - RNA, 21 nt, Artificial Sequence
  Ebola virus siRNA sense strand
aggaacgggaccgugugccgg

SEQ ID NO: 7547 - RNA, 21 nt, Artificial Sequence
  Ebola virus siRNA sense strand
ggaacgggaccgugugccgga

SEQ ID NO: 7548 - RNA, 21 nt, Artificial Sequence
  Ebola virus siRNA sense strand
gaacgggaccgugugccggag

SEQ ID NO: 7549 - RNA, 21 nt, Artificial Sequence
  Ebola virus siRNA sense strand
aacgggaccgugugccggaga

SEQ ID NO: 7550 - RNA, 21 nt, Artificial Sequence
  Ebola virus siRNA sense strand
acgggaccgugugccggagac

SEQ ID NO: 7551 - RNA, 21 nt, Artificial Sequence
  Ebola virus siRNA sense strand
cgggaccgugugccggagacu

SEQ ID NO: 7552 - RNA, 21 nt, Artificial Sequence
  Ebola virus siRNA sense strand
gggaccgugugccggagacuu

SEQ ID NO: 7553 - RNA, 21 nt, Artificial Sequence
  Ebola virus siRNA sense strand
ggaccgugugccggagacuuu

SEQ ID NO: 7554 - RNA, 21 nt, Artificial Sequence
  Ebola virus siRNA sense strand
gaccgugugccggagacuuug

SEQ ID NO: 7555 - RNA, 21 nt, Artificial Sequence
  Ebola virus siRNA sense strand
accgugugccggagacuuugc

SEQ ID NO: 7556 - RNA, 21 nt, Artificial Sequence
  Ebola virus siRNA sense strand
ccgugugccggagacuuugcc

SEQ ID NO: 7557 - RNA, 21 nt, Artificial Sequence
  Ebola virus siRNA sense strand
cgugugccggagacuuugccu

SEQ ID NO: 7558 - RNA, 21 nt, Artificial Sequence
  Ebola virus siRNA sense strand
gugugccggagacuuugccuu

SEQ ID NO: 7559 - RNA, 21 nt, Artificial Sequence
  Ebola virus siRNA sense strand
ugugccggagacuuugccuuc

SEQ ID NO: 7560 - RNA, 21 nt, Artificial Sequence
  Ebola virus siRNA sense strand
gugccggagacuuugccuucc

SEQ ID NO: 7561 - RNA, 21 nt, Artificial Sequence
  Ebola virus siRNA sense strand
ugccggagacuuugccuucca

SEQ ID NO: 7562 - RNA, 21 nt, Artificial Sequence
  Ebola virus siRNA sense strand
gccggagacuuugccuuccau

SEQ ID NO: 7563 - RNA, 21 nt, Artificial Sequence
  Ebola virus siRNA sense strand
ccggagacuuugccuuccaua

SEQ ID NO: 7564 - RNA, 21 nt, Artificial Sequence
  Ebola virus siRNA sense strand
cggagacuuugccuuccauaa

SEQ ID NO: 7565 - RNA, 21 nt, Artificial Sequence
  Ebola virus siRNA sense strand
ggagacuuugccuuccauaaa

SEQ ID NO: 7566 - RNA, 21 nt, Artificial Sequence
  Ebola virus siRNA sense strand
gagacuuugccuuccauaaag

SEQ ID NO: 7567 - RNA, 21 nt, Artificial Sequence
  Ebola virus siRNA sense strand
agacuuugccuuccauaaaga

SEQ ID NO: 7568 - RNA, 21 nt, Artificial Sequence
  Ebola virus siRNA sense strand
gacuuugccuuccauaaagag

SEQ ID NO: 7569 - RNA, 21 nt, Artificial Sequence
  Ebola virus siRNA sense strand
acuuugccuuccauaaagagg

SEQ ID NO: 7570 - RNA, 21 nt, Artificial Sequence
  Ebola virus siRNA sense strand
cuuugccuuccauaaagaggg

SEQ ID NO: 7571 - RNA, 21 nt, Artificial Sequence
  Ebola virus siRNA sense strand
uuugccuuccauaaagagggu

SEQ ID NO: 7572 - RNA, 21 nt, Artificial Sequence
  Ebola virus siRNA sense strand
uugccuuccauaaagagggug

SEQ ID NO: 7573 - RNA, 21 nt, Artificial Sequence
  Ebola virus siRNA sense strand
ugccuuccauaaagagggugc

SEQ ID NO: 7574 - RNA, 21 nt, Artificial Sequence
  Ebola virus siRNA sense strand
gccuuccauaaagagggugcu

SEQ ID NO: 7575 - RNA, 21 nt, Artificial Sequence
  Ebola virus siRNA sense strand
ccuuccauaaagagggugcuu

SEQ ID NO: 7576 - RNA, 21 nt, Artificial Sequence
  Ebola virus siRNA sense strand
cuuccauaaagagggugcuuu

SEQ ID NO: 7577 - RNA, 21 nt, Artificial Sequence
  Ebola virus siRNA sense strand
uuccauaaagagggugcuuuc

SEQ ID NO: 7578 - RNA, 21 nt, Artificial Sequence
  Ebola virus siRNA sense strand
uccauaaagagggugcuuucu

SEQ ID NO: 7579 - RNA, 21 nt, Artificial Sequence
  Ebola virus siRNA sense strand
ccauaaagagggugcuuucuu

SEQ ID NO: 7580 - RNA, 21 nt, Artificial Sequence
  Ebola virus siRNA sense strand
cauaaagagggugcuuucuuc

SEQ ID NO: 7581 - RNA, 21 nt, Artificial Sequence
  Ebola virus siRNA sense strand
auaaagagggugcuuucuucc

SEQ ID NO: 7582 - RNA, 21 nt, Artificial Sequence
  Ebola virus siRNA sense strand
uaaagagggugcuuucuuccu

SEQ ID NO: 7583 - RNA, 21 nt, Artificial Sequence
  Ebola virus siRNA sense strand
aaagagggugcuuucuuccug

SEQ ID NO: 7584 - RNA, 21 nt, Artificial Sequence
  Ebola virus siRNA sense strand
aagagggugcuuucuuccugu

SEQ ID NO: 7585 - RNA, 21 nt, Artificial Sequence
  Ebola virus siRNA sense strand
agagggugcuuucuuccugua

SEQ ID NO: 7586 - RNA, 21 nt, Artificial Sequence
  Ebola virus siRNA sense strand
gagggugcuuucuuccuguau

SEQ ID NO: 7587 - RNA, 21 nt, Artificial Sequence
  Ebola virus siRNA sense strand
agggugcuuucuuccuguaug

SEQ ID NO: 7588 - RNA, 21 nt, Artificial Sequence
  Ebola virus siRNA sense strand
gggugcuuucuuccuguauga

SEQ ID NO: 7589 - RNA, 21 nt, Artificial Sequence
  Ebola virus siRNA sense strand
ggugcuuucuuccuguaugau

SEQ ID NO: 7590 - RNA, 21 nt, Artificial Sequence
  Ebola virus siRNA sense strand
gugcuuucuuccuguaugauc

SEQ ID NO: 7591 - RNA, 21 nt, Artificial Sequence
  Ebola virus siRNA sense strand
ugcuuucuuccuguaugaucg

SEQ ID NO: 7592 - RNA, 21 nt, Artificial Sequence
  Ebola virus siRNA sense strand
gcuuucuuccuguaugaucga

SEQ ID NO: 7593 - RNA, 21 nt, Artificial Sequence
  Ebola virus siRNA sense strand
cuuucuuccuguaugaucgac

SEQ ID NO: 7594 - RNA, 21 nt, Artificial Sequence
  Ebola virus siRNA sense strand
uuucuuccuguaugaucgacu

SEQ ID NO: 7595 - RNA, 21 nt, Artificial Sequence
  Ebola virus siRNA sense strand
uucuuccuguaugaucgacuu

SEQ ID NO: 7596 - RNA, 21 nt, Artificial Sequence
  Ebola virus siRNA sense strand
ucuuccuguaugaucgacuug

SEQ ID NO: 7597 - RNA, 21 nt, Artificial Sequence
  Ebola virus siRNA sense strand
cuuccuguaugaucgacuugc

SEQ ID NO: 7598 - RNA, 21 nt, Artificial Sequence
  Ebola virus siRNA sense strand
uuccuguaugaucgacuugcu

SEQ ID NO: 7599 - RNA, 21 nt, Artificial Sequence
  Ebola virus siRNA sense strand
uccuguaugaucgacuugcuu

SEQ ID NO: 7600 - RNA, 21 nt, Artificial Sequence
  Ebola virus siRNA sense strand
ccuguaugaucgacuugcuuc

SEQ ID NO: 7601 - RNA, 21 nt, Artificial Sequence
  Ebola virus siRNA sense strand
cuguaugaucgacuugcuucc

SEQ ID NO: 7602 - RNA, 21 nt, Artificial Sequence
  Ebola virus siRNA sense strand
uguaugaucgacuugcuucca

SEQ ID NO: 7603 - RNA, 21 nt, Artificial Sequence
  Ebola virus siRNA sense strand
guaugaucgacuugcuuccac

SEQ ID NO: 7604 - RNA, 21 nt, Artificial Sequence
  Ebola virus siRNA sense strand
uaugaucgacuugcuuccaca

SEQ ID NO: 7605 - RNA, 21 nt, Artificial Sequence
  Ebola virus siRNA sense strand
augaucgacuugcuuccacag

SEQ ID NO: 7606 - RNA, 21 nt, Artificial Sequence
  Ebola virus siRNA sense strand
ugaucgacuugcuuccacagu

SEQ ID NO: 7607 - RNA, 21 nt, Artificial Sequence
  Ebola virus siRNA sense strand
gaucgacuugcuuccacaguu

SEQ ID NO: 7608 - RNA, 21 nt, Artificial Sequence
  Ebola virus siRNA sense strand
aucgacuugcuuccacaguua

SEQ ID NO: 7609 - RNA, 21 nt, Artificial Sequence
  Ebola virus siRNA sense strand
ucgacuugcuuccacaguuau

SEQ ID NO: 7610 - RNA, 21 nt, Artificial Sequence
  Ebola virus siRNA sense strand
cgacuugcuuccacaguuauc

SEQ ID NO: 7611 - RNA, 21 nt, Artificial Sequence
  Ebola virus siRNA sense strand
gacuugcuuccacaguuaucu

SEQ ID NO: 7612 - RNA, 21 nt, Artificial Sequence
  Ebola virus siRNA sense strand
acuugcuuccacaguuaucua

SEQ ID NO: 7613 - RNA, 21 nt, Artificial Sequence
  Ebola virus siRNA sense strand
cuugcuuccacaguuaucuac

SEQ ID NO: 7614 - RNA, 21 nt, Artificial Sequence
  Ebola virus siRNA sense strand
uugcuuccacaguuaucuacc

SEQ ID NO: 7615 - RNA, 21 nt, Artificial Sequence
  Ebola virus siRNA sense strand
ugcuuccacaguuaucuaccg

SEQ ID NO: 7616 - RNA, 21 nt, Artificial Sequence
  Ebola virus siRNA sense strand
gcuuccacaguuaucuaccga

SEQ ID NO: 7617 - RNA, 21 nt, Artificial Sequence
  Ebola virus siRNA sense strand
cuuccacaguuaucuaccgag

SEQ ID NO: 7618 - RNA, 21 nt, Artificial Sequence
  Ebola virus siRNA sense strand
uuccacaguuaucuaccgagg

SEQ ID NO: 7619 - RNA, 21 nt, Artificial Sequence
  Ebola virus siRNA sense strand
uccacaguuaucuaccgagga

SEQ ID NO: 7620 - RNA, 21 nt, Artificial Sequence
  Ebola virus siRNA sense strand
ccacaguuaucuaccgaggaa

SEQ ID NO: 7621 - RNA, 21 nt, Artificial Sequence
  Ebola virus siRNA sense strand
cacaguuaucuaccgaggaac

SEQ ID NO: 7622 - RNA, 21 nt, Artificial Sequence
  Ebola virus siRNA sense strand
acaguuaucuaccgaggaacg

SEQ ID NO: 7623 - RNA, 21 nt, Artificial Sequence
  Ebola virus siRNA sense strand
caguuaucuaccgaggaacga

SEQ ID NO: 7624 - RNA, 21 nt, Artificial Sequence
  Ebola virus siRNA sense strand
aguuaucuaccgaggaacgac

SEQ ID NO: 7625 - RNA, 21 nt, Artificial Sequence
  Ebola virus siRNA sense strand
guuaucuaccgaggaacgacu

SEQ ID NO: 7626 - RNA, 21 nt, Artificial Sequence
  Ebola virus siRNA sense strand
uuaucuaccgaggaacgacuu

SEQ ID NO: 7627 - RNA, 21 nt, Artificial Sequence
  Ebola virus siRNA sense strand
uaucuaccgaggaacgacuuu

SEQ ID NO: 7628 - RNA, 21 nt, Artificial Sequence
  Ebola virus siRNA sense strand
aucuaccgaggaacgacuuuc

SEQ ID NO: 7629 - RNA, 21 nt, Artificial Sequence
  Ebola virus siRNA sense strand
ucuaccgaggaacgacuuucg

SEQ ID NO: 7630 - RNA, 21 nt, Artificial Sequence
  Ebola virus siRNA sense strand
cuaccgaggaacgacuuucgc

SEQ ID NO: 7631 - RNA, 21 nt, Artificial Sequence
  Ebola virus siRNA sense strand
uaccgaggaacgacuuucgcu

SEQ ID NO: 7632 - RNA, 21 nt, Artificial Sequence
  Ebola virus siRNA sense strand
accgaggaacgacuuucgcug

SEQ ID NO: 7633 - RNA, 21 nt, Artificial Sequence
  Ebola virus siRNA sense strand
ccgaggaacgacuuucgcuga

SEQ ID NO: 7634 - RNA, 21 nt, Artificial Sequence
  Ebola virus siRNA sense strand
cgaggaacgacuuucgcugaa

SEQ ID NO: 7635 - RNA, 21 nt, Artificial Sequence
  Ebola virus siRNA sense strand
gaggaacgacuuucgcugaag

SEQ ID NO: 7636 - RNA, 21 nt, Artificial Sequence
  Ebola virus siRNA sense strand
aggaacgacuuucgcugaagg

SEQ ID NO: 7637 - RNA, 21 nt, Artificial Sequence
  Ebola virus siRNA sense strand
ggaacgacuuucgcugaaggu

SEQ ID NO: 7638 - RNA, 21 nt, Artificial Sequence
  Ebola virus siRNA sense strand
gaacgacuuucgcugaaggug

SEQ ID NO: 7639 - RNA, 21 nt, Artificial Sequence
  Ebola virus siRNA sense strand
aacgacuuucgcugaaggugu

SEQ ID NO: 7640 - RNA, 21 nt, Artificial Sequence
  Ebola virus siRNA sense strand
acgacuuucgcugaagguguc

SEQ ID NO: 7641 - RNA, 21 nt, Artificial Sequence
  Ebola virus siRNA sense strand
cgacuuucgcugaaggugucg

SEQ ID NO: 7642 - RNA, 21 nt, Artificial Sequence
  Ebola virus siRNA sense strand
gacuuucgcugaaggugucgu

SEQ ID NO: 7643 - RNA, 21 nt, Artificial Sequence
  Ebola virus siRNA sense strand
acuuucgcugaaggugucguu

SEQ ID NO: 7644 - RNA, 21 nt, Artificial Sequence
  Ebola virus siRNA sense strand
cuuucgcugaaggugucguug

SEQ ID NO: 7645 - RNA, 21 nt, Artificial Sequence
  Ebola virus siRNA sense strand
uuucgcugaaggugucguugc

SEQ ID NO: 7646 - RNA, 21 nt, Artificial Sequence
  Ebola virus siRNA sense strand
uucgcugaaggugucguugca

SEQ ID NO: 7647 - RNA, 21 nt, Artificial Sequence
  Ebola virus siRNA sense strand
ucgcugaaggugucguugcau

SEQ ID NO: 7648 - RNA, 21 nt, Artificial Sequence
  Ebola virus siRNA sense strand
cgcugaaggugucguugcauu

SEQ ID NO: 7649 - RNA, 21 nt, Artificial Sequence
  Ebola virus siRNA sense strand
gcugaaggugucguugcauuu

SEQ ID NO: 7650 - RNA, 21 nt, Artificial Sequence
  Ebola virus siRNA sense strand
cugaaggugucguugcauuuc

SEQ ID NO: 7651 - RNA, 21 nt, Artificial Sequence
  Ebola virus siRNA sense strand
ugaaggugucguugcauuucu

SEQ ID NO: 7652 - RNA, 21 nt, Artificial Sequence
  Ebola virus siRNA sense strand
gaaggugucguugcauuucug

SEQ ID NO: 7653 - RNA, 21 nt, Artificial Sequence
  Ebola virus siRNA sense strand
aaggugucguugcauuucuga

SEQ ID NO: 7654 - RNA, 21 nt, Artificial Sequence
  Ebola virus siRNA sense strand
aggugucguugcauuucugau

SEQ ID NO: 7655 - RNA, 21 nt, Artificial Sequence
  Ebola virus siRNA sense strand
ggugucguugcauuucugaua

SEQ ID NO: 7656 - RNA, 21 nt, Artificial Sequence
  Ebola virus siRNA sense strand
gugucguugcauuucugauac

SEQ ID NO: 7657 - RNA, 21 nt, Artificial Sequence
  Ebola virus siRNA sense strand
ugucguugcauuucugauacu

SEQ ID NO: 7658 - RNA, 21 nt, Artificial Sequence
  Ebola virus siRNA sense strand
gucguugcauuucugauacug

SEQ ID NO: 7659 - RNA, 21 nt, Artificial Sequence
  Ebola virus siRNA sense strand
ucguugcauuucugauacugc

SEQ ID NO: 7660 - RNA, 21 nt, Artificial Sequence
  Ebola virus siRNA sense strand
cguugcauuucugauacugcc

SEQ ID NO: 7661 - RNA, 21 nt, Artificial Sequence
  Ebola virus siRNA sense strand
guugcauuucugauacugccc

SEQ ID NO: 7662 - RNA, 21 nt, Artificial Sequence
  Ebola virus siRNA sense strand
uugcauuucugauacugcccc

SEQ ID NO: 7663 - RNA, 21 nt, Artificial Sequence
  Ebola virus siRNA sense strand
ugcauuucugauacugcccca

SEQ ID NO: 7664 - RNA, 21 nt, Artificial Sequence
  Ebola virus siRNA sense strand
gcauuucugauacugccccaa

SEQ ID NO: 7665 - RNA, 21 nt, Artificial Sequence
  Ebola virus siRNA sense strand
cauuucugauacugccccaag

SEQ ID NO: 7666 - RNA, 21 nt, Artificial Sequence
  Ebola virus siRNA sense strand
auuucugauacugccccaagc

SEQ ID NO: 7667 - RNA, 21 nt, Artificial Sequence
  Ebola virus siRNA sense strand
uuucugauacugccccaagcu

SEQ ID NO: 7668 - RNA, 21 nt, Artificial Sequence
  Ebola virus siRNA sense strand
uucugauacugccccaagcua

SEQ ID NO: 7669 - RNA, 21 nt, Artificial Sequence
  Ebola virus siRNA sense strand
ucugauacugccccaagcuaa

SEQ ID NO: 7670 - RNA, 21 nt, Artificial Sequence
  Ebola virus siRNA sense strand
cugauacugccccaagcuaag

SEQ ID NO: 7671 - RNA, 21 nt, Artificial Sequence
  Ebola virus siRNA sense strand
ugauacugccccaagcuaaga

SEQ ID NO: 7672 - RNA, 21 nt, Artificial Sequence
  Ebola virus siRNA sense strand
gauacugccccaagcuaagaa

SEQ ID NO: 7673 - RNA, 21 nt, Artificial Sequence
  Ebola virus siRNA sense strand
auacugccccaagcuaagaag

SEQ ID NO: 7674 - RNA, 21 nt, Artificial Sequence
  Ebola virus siRNA sense strand
uacugccccaagcuaagaagg

SEQ ID NO: 7675 - RNA, 21 nt, Artificial Sequence
  Ebola virus siRNA sense strand
acugccccaagcuaagaagga

SEQ ID NO: 7676 - RNA, 21 nt, Artificial Sequence
  Ebola virus siRNA sense strand
cugccccaagcuaagaaggac

SEQ ID NO: 7677 - RNA, 21 nt, Artificial Sequence
  Ebola virus siRNA sense strand
ugccccaagcuaagaaggacu

SEQ ID NO: 7678 - RNA, 21 nt, Artificial Sequence
  Ebola virus siRNA sense strand
gccccaagcuaagaaggacuu

SEQ ID NO: 7679 - RNA, 21 nt, Artificial Sequence
  Ebola virus siRNA sense strand
ccccaagcuaagaaggacuuc

SEQ ID NO: 7680 - RNA, 21 nt, Artificial Sequence
  Ebola virus siRNA sense strand
cccaagcuaagaaggacuucu

SEQ ID NO: 7681 - RNA, 21 nt, Artificial Sequence
  Ebola virus siRNA sense strand
ccaagcuaagaaggacuucuu

SEQ ID NO: 7682 - RNA, 21 nt, Artificial Sequence
  Ebola virus siRNA sense strand
caagcuaagaaggacuucuuc

SEQ ID NO: 7683 - RNA, 21 nt, Artificial Sequence
  Ebola virus siRNA sense strand
aagcuaagaaggacuucuuca

SEQ ID NO: 7684 - RNA, 21 nt, Artificial Sequence
  Ebola virus siRNA sense strand
agcuaagaaggacuucuucag

SEQ ID NO: 7685 - RNA, 21 nt, Artificial Sequence
  Ebola virus siRNA sense strand
gcuaagaaggacuucuucagc

SEQ ID NO: 7686 - RNA, 21 nt, Artificial Sequence
  Ebola virus siRNA sense strand
cuaagaaggacuucuucagcu

SEQ ID NO: 7687 - RNA, 21 nt, Artificial Sequence
  Ebola virus siRNA sense strand
uaagaaggacuucuucagcuc

SEQ ID NO: 7688 - RNA, 21 nt, Artificial Sequence
  Ebola virus siRNA sense strand
aagaaggacuucuucagcuca

SEQ ID NO: 7689 - RNA, 21 nt, Artificial Sequence
  Ebola virus siRNA sense strand
agaaggacuucuucagcucac

SEQ ID NO: 7690 - RNA, 21 nt, Artificial Sequence
  Ebola virus siRNA sense strand
gaaggacuucuucagcucaca

SEQ ID NO: 7691 - RNA, 21 nt, Artificial Sequence
  Ebola virus siRNA sense strand
aaggacuucuucagcucacac

SEQ ID NO: 7692 - RNA, 21 nt, Artificial Sequence
  Ebola virus siRNA sense strand
aggacuucuucagcucacacc

SEQ ID NO: 7693 - RNA, 21 nt, Artificial Sequence
  Ebola virus siRNA sense strand
ggacuucuucagcucacaccc

SEQ ID NO: 7694 - RNA, 21 nt, Artificial Sequence
  Ebola virus siRNA sense strand
gacuucuucagcucacacccc

SEQ ID NO: 7695 - RNA, 21 nt, Artificial Sequence
  Ebola virus siRNA sense strand
acuucuucagcucacaccccu

SEQ ID NO: 7696 - RNA, 21 nt, Artificial Sequence
  Ebola virus siRNA sense strand
cuucuucagcucacaccccuu

SEQ ID NO: 7697 - RNA, 21 nt, Artificial Sequence
  Ebola virus siRNA sense strand
uucuucagcucacaccccuug

SEQ ID NO: 7698 - RNA, 21 nt, Artificial Sequence
  Ebola virus siRNA sense strand
ucuucagcucacaccccuuga

SEQ ID NO: 7699 - RNA, 21 nt, Artificial Sequence
  Ebola virus siRNA sense strand
cuucagcucacaccccuugag

SEQ ID NO: 7700 - RNA, 21 nt, Artificial Sequence
  Ebola virus siRNA sense strand
uucagcucacaccccuugaga

SEQ ID NO: 7701 - RNA, 21 nt, Artificial Sequence
  Ebola virus siRNA sense strand
ucagcucacaccccuugagag

SEQ ID NO: 7702 - RNA, 21 nt, Artificial Sequence
  Ebola virus siRNA sense strand
cagcucacaccccuugagaga

SEQ ID NO: 7703 - RNA, 21 nt, Artificial Sequence
  Ebola virus siRNA sense strand
agcucacaccccuugagagag

SEQ ID NO: 7704 - RNA, 21 nt, Artificial Sequence
  Ebola virus siRNA sense strand
gcucacaccccuugagagagc

SEQ ID NO: 7705 - RNA, 21 nt, Artificial Sequence
  Ebola virus siRNA sense strand
cucacaccccuugagagagcc

SEQ ID NO: 7706 - RNA, 21 nt, Artificial Sequence
  Ebola virus siRNA sense strand
ucacaccccuugagagagccg

SEQ ID NO: 7707 - RNA, 21 nt, Artificial Sequence
  Ebola virus siRNA sense strand
cacaccccuugagagagccgg

SEQ ID NO: 7708 - RNA, 21 nt, Artificial Sequence
  Ebola virus siRNA sense strand
acaccccuugagagagccggu

SEQ ID NO: 7709 - RNA, 21 nt, Artificial Sequence
  Ebola virus siRNA sense strand
caccccuugagagagccgguc

SEQ ID NO: 7710 - RNA, 21 nt, Artificial Sequence
  Ebola virus siRNA sense strand
accccuugagagagccgguca

SEQ ID NO: 7711 - RNA, 21 nt, Artificial Sequence
  Ebola virus siRNA sense strand
ccccuugagagagccggucaa

SEQ ID NO: 7712 - RNA, 21 nt, Artificial Sequence
  Ebola virus siRNA sense strand
cccuugagagagccggucaau

SEQ ID NO: 7713 - RNA, 21 nt, Artificial Sequence
  Ebola virus siRNA sense strand
ccuugagagagccggucaaug

SEQ ID NO: 7714 - RNA, 21 nt, Artificial Sequence
  Ebola virus siRNA sense strand
cuugagagagccggucaaugc

SEQ ID NO: 7715 - RNA, 21 nt, Artificial Sequence
  Ebola virus siRNA sense strand
uugagagagccggucaaugca

SEQ ID NO: 7716 - RNA, 21 nt, Artificial Sequence
  Ebola virus siRNA sense strand
ugagagagccggucaaugcaa

SEQ ID NO: 7717 - RNA, 21 nt, Artificial Sequence
  Ebola virus siRNA sense strand
gagagagccggucaaugcaac

SEQ ID NO: 7718 - RNA, 21 nt, Artificial Sequence
  Ebola virus siRNA sense strand
agagagccggucaaugcaacg

SEQ ID NO: 7719 - RNA, 21 nt, Artificial Sequence
  Ebola virus siRNA sense strand
gagagccggucaaugcaacgg

SEQ ID NO: 7720 - RNA, 21 nt, Artificial Sequence
  Ebola virus siRNA sense strand
agagccggucaaugcaacgga

SEQ ID NO: 7721 - RNA, 21 nt, Artificial Sequence
  Ebola virus siRNA sense strand
gagccggucaaugcaacggag

SEQ ID NO: 7722 - RNA, 21 nt, Artificial Sequence
  Ebola virus siRNA sense strand
agccggucaaugcaacggagg

SEQ ID NO: 7723 - RNA, 21 nt, Artificial Sequence
  Ebola virus siRNA sense strand
gccggucaaugcaacggagga

SEQ ID NO: 7724 - RNA, 21 nt, Artificial Sequence
  Ebola virus siRNA sense strand
ccggucaaugcaacggaggac

SEQ ID NO: 7725 - RNA, 21 nt, Artificial Sequence
  Ebola virus siRNA sense strand
cggucaaugcaacggaggacc

SEQ ID NO: 7726 - RNA, 21 nt, Artificial Sequence
  Ebola virus siRNA sense strand
ggucaaugcaacggaggaccc

SEQ ID NO: 7727 - RNA, 21 nt, Artificial Sequence
  Ebola virus siRNA sense strand
gucaaugcaacggaggacccg

SEQ ID NO: 7728 - RNA, 21 nt, Artificial Sequence
  Ebola virus siRNA sense strand
ucaaugcaacggaggacccgu

SEQ ID NO: 7729 - RNA, 21 nt, Artificial Sequence
  Ebola virus siRNA sense strand
caaugcaacggaggacccguc

SEQ ID NO: 7730 - RNA, 21 nt, Artificial Sequence
  Ebola virus siRNA sense strand
aaugcaacggaggacccgucu

SEQ ID NO: 7731 - RNA, 21 nt, Artificial Sequence
  Ebola virus siRNA sense strand
augcaacggaggacccgucua

SEQ ID NO: 7732 - RNA, 21 nt, Artificial Sequence
  Ebola virus siRNA sense strand
ugcaacggaggacccgucuag

SEQ ID NO: 7733 - RNA, 21 nt, Artificial Sequence
  Ebola virus siRNA sense strand
gcaacggaggacccgucuagu

SEQ ID NO: 7734 - RNA, 21 nt, Artificial Sequence
  Ebola virus siRNA sense strand
caacggaggacccgucuagug

SEQ ID NO: 7735 - RNA, 21 nt, Artificial Sequence
  Ebola virus siRNA sense strand
aacggaggacccgucuagugg

SEQ ID NO: 7736 - RNA, 21 nt, Artificial Sequence
  Ebola virus siRNA sense strand
acggaggacccgucuaguggc

SEQ ID NO: 7737 - RNA, 21 nt, Artificial Sequence
  Ebola virus siRNA sense strand
cggaggacccgucuaguggcu

SEQ ID NO: 7738 - RNA, 21 nt, Artificial Sequence
  Ebola virus siRNA sense strand
ggaggacccgucuaguggcua

SEQ ID NO: 7739 - RNA, 21 nt, Artificial Sequence
  Ebola virus siRNA sense strand
gaggacccgucuaguggcuac

SEQ ID NO: 7740 - RNA, 21 nt, Artificial Sequence
  Ebola virus siRNA sense strand
aggacccgucuaguggcuacu

SEQ ID NO: 7741 - RNA, 21 nt, Artificial Sequence
  Ebola virus siRNA sense strand
ggacccgucuaguggcuacua

SEQ ID NO: 7742 - RNA, 21 nt, Artificial Sequence
  Ebola virus siRNA sense strand
gacccgucuaguggcuacuau

SEQ ID NO: 7743 - RNA, 21 nt, Artificial Sequence
  Ebola virus siRNA sense strand
acccgucuaguggcuacuauu

SEQ ID NO: 7744 - RNA, 21 nt, Artificial Sequence
  Ebola virus siRNA sense strand
cccgucuaguggcuacuauuc

SEQ ID NO: 7745 - RNA, 21 nt, Artificial Sequence
  Ebola virus siRNA sense strand
ccgucuaguggcuacuauucu

SEQ ID NO: 7746 - RNA, 21 nt, Artificial Sequence
  Ebola virus siRNA sense strand
cgucuaguggcuacuauucua

SEQ ID NO: 7747 - RNA, 21 nt, Artificial Sequence
  Ebola virus siRNA sense strand
gucuaguggcuacuauucuac

SEQ ID NO: 7748 - RNA, 21 nt, Artificial Sequence
  Ebola virus siRNA sense strand
ucuaguggcuacuauucuacc

SEQ ID NO: 7749 - RNA, 21 nt, Artificial Sequence
  Ebola virus siRNA sense strand
cuaguggcuacuauucuacca

SEQ ID NO: 7750 - RNA, 21 nt, Artificial Sequence
  Ebola virus siRNA sense strand
uaguggcuacuauucuaccac

SEQ ID NO: 7751 - RNA, 21 nt, Artificial Sequence
  Ebola virus siRNA sense strand
aguggcuacuauucuaccaca

SEQ ID NO: 7752 - RNA, 21 nt, Artificial Sequence
  Ebola virus siRNA sense strand
guggcuacuauucuaccacaa

SEQ ID NO: 7753 - RNA, 21 nt, Artificial Sequence
  Ebola virus siRNA sense strand
uggcuacuauucuaccacaau

SEQ ID NO: 7754 - RNA, 21 nt, Artificial Sequence
  Ebola virus siRNA sense strand
ggcuacuauucuaccacaauu

SEQ ID NO: 7755 - RNA, 21 nt, Artificial Sequence
  Ebola virus siRNA sense strand
gcuacuauucuaccacaauua

SEQ ID NO: 7756 - RNA, 21 nt, Artificial Sequence
  Ebola virus siRNA sense strand
cuacuauucuaccacaauuag

SEQ ID NO: 7757 - RNA, 21 nt, Artificial Sequence
  Ebola virus siRNA sense strand
uacuauucuaccacaauuaga

SEQ ID NO: 7758 - RNA, 21 nt, Artificial Sequence
  Ebola virus siRNA sense strand
acuauucuaccacaauuagau

SEQ ID NO: 7759 - RNA, 21 nt, Artificial Sequence
  Ebola virus siRNA sense strand
cuauucuaccacaauuagaua

SEQ ID NO: 7760 - RNA, 21 nt, Artificial Sequence
  Ebola virus siRNA sense strand
uauucuaccacaauuagauau

SEQ ID NO: 7761 - RNA, 21 nt, Artificial Sequence
  Ebola virus siRNA sense strand
auucuaccacaauuagauauc

SEQ ID NO: 7762 - RNA, 21 nt, Artificial Sequence
  Ebola virus siRNA sense strand
uucuaccacaauuagauauca

SEQ ID NO: 7763 - RNA, 21 nt, Artificial Sequence
  Ebola virus siRNA sense strand
ucuaccacaauuagauaucag

SEQ ID NO: 7764 - RNA, 21 nt, Artificial Sequence
  Ebola virus siRNA sense strand
cuaccacaauuagauaucagg

SEQ ID NO: 7765 - RNA, 21 nt, Artificial Sequence
  Ebola virus siRNA sense strand
uaccacaauuagauaucaggc

SEQ ID NO: 7766 - RNA, 21 nt, Artificial Sequence
  Ebola virus siRNA sense strand
accacaauuagauaucaggcu

SEQ ID NO: 7767 - RNA, 21 nt, Artificial Sequence
  Ebola virus siRNA sense strand
ccacaauuagauaucaggcua

SEQ ID NO: 7768 - RNA, 21 nt, Artificial Sequence
  Ebola virus siRNA sense strand
cacaauuagauaucaggcuac

SEQ ID NO: 7769 - RNA, 21 nt, Artificial Sequence
  Ebola virus siRNA sense strand
acaauuagauaucaggcuacc

SEQ ID NO: 7770 - RNA, 21 nt, Artificial Sequence
  Ebola virus siRNA sense strand
caauuagauaucaggcuaccg

SEQ ID NO: 7771 - RNA, 21 nt, Artificial Sequence
  Ebola virus siRNA sense strand
aauuagauaucaggcuaccgg

SEQ ID NO: 7772 - RNA, 21 nt, Artificial Sequence
  Ebola virus siRNA sense strand
auuagauaucaggcuaccggu

SEQ ID NO: 7773 - RNA, 21 nt, Artificial Sequence
  Ebola virus siRNA sense strand
uuagauaucaggcuaccgguu

SEQ ID NO: 7774 - RNA, 21 nt, Artificial Sequence
  Ebola virus siRNA sense strand
uagauaucaggcuaccgguuu

SEQ ID NO: 7775 - RNA, 21 nt, Artificial Sequence
  Ebola virus siRNA sense strand
agauaucaggcuaccgguuuu

SEQ ID NO: 7776 - RNA, 21 nt, Artificial Sequence
  Ebola virus siRNA sense strand
gauaucaggcuaccgguuuug

SEQ ID NO: 7777 - RNA, 21 nt, Artificial Sequence
  Ebola virus siRNA sense strand
auaucaggcuaccgguuuugg

SEQ ID NO: 7778 - RNA, 21 nt, Artificial Sequence
  Ebola virus siRNA sense strand
uaucaggcuaccgguuuugga

SEQ ID NO: 7779 - RNA, 21 nt, Artificial Sequence
  Ebola virus siRNA sense strand
aucaggcuaccgguuuuggaa

SEQ ID NO: 7780 - RNA, 21 nt, Artificial Sequence
  Ebola virus siRNA sense strand
ucaggcuaccgguuuuggaac

SEQ ID NO: 7781 - RNA, 21 nt, Artificial Sequence
  Ebola virus siRNA sense strand
caggcuaccgguuuuggaacc

SEQ ID NO: 7782 - RNA, 21 nt, Artificial Sequence
  Ebola virus siRNA sense strand
aggcuaccgguuuuggaacca

SEQ ID NO: 7783 - RNA, 21 nt, Artificial Sequence
  Ebola virus siRNA sense strand
ggcuaccgguuuuggaaccaa

SEQ ID NO: 7784 - RNA, 21 nt, Artificial Sequence
  Ebola virus siRNA sense strand
gcuaccgguuuuggaaccaau

SEQ ID NO: 7785 - RNA, 21 nt, Artificial Sequence
  Ebola virus siRNA sense strand
cuaccgguuuuggaaccaaug

SEQ ID NO: 7786 - RNA, 21 nt, Artificial Sequence
  Ebola virus siRNA sense strand
uaccgguuuuggaaccaauga

SEQ ID NO: 7787 - RNA, 21 nt, Artificial Sequence
  Ebola virus siRNA sense strand
accgguuuuggaaccaaugag

SEQ ID NO: 7788 - RNA, 21 nt, Artificial Sequence
  Ebola virus siRNA sense strand
ccgguuuuggaaccaaugaga

SEQ ID NO: 7789 - RNA, 21 nt, Artificial Sequence
  Ebola virus siRNA sense strand
cgguuuuggaaccaaugagac

SEQ ID NO: 7790 - RNA, 21 nt, Artificial Sequence
  Ebola virus siRNA sense strand
gguuuuggaaccaaugagaca

SEQ ID NO: 7791 - RNA, 21 nt, Artificial Sequence
  Ebola virus siRNA sense strand
guuuuggaaccaaugagacag

SEQ ID NO: 7792 - RNA, 21 nt, Artificial Sequence
  Ebola virus siRNA sense strand
uuuuggaaccaaugagacaga

SEQ ID NO: 7793 - RNA, 21 nt, Artificial Sequence
  Ebola virus siRNA sense strand
uuuggaaccaaugagacagag

SEQ ID NO: 7794 - RNA, 21 nt, Artificial Sequence
  Ebola virus siRNA sense strand
uuggaaccaaugagacagagu

SEQ ID NO: 7795 - RNA, 21 nt, Artificial Sequence
  Ebola virus siRNA sense strand
uggaaccaaugagacagagua

SEQ ID NO: 7796 - RNA, 21 nt, Artificial Sequence
  Ebola virus siRNA sense strand
ggaaccaaugagacagaguac

SEQ ID NO: 7797 - RNA, 21 nt, Artificial Sequence
  Ebola virus siRNA sense strand
gaaccaaugagacagaguacu

SEQ ID NO: 7798 - RNA, 21 nt, Artificial Sequence
  Ebola virus siRNA sense strand
aaccaaugagacagaguacuu

SEQ ID NO: 7799 - RNA, 21 nt, Artificial Sequence
  Ebola virus siRNA sense strand
accaaugagacagaguacuug

SEQ ID NO: 7800 - RNA, 21 nt, Artificial Sequence
  Ebola virus siRNA sense strand
ccaaugagacagaguacuugu

SEQ ID NO: 7801 - RNA, 21 nt, Artificial Sequence
  Ebola virus siRNA sense strand
caaugagacagaguacuuguu

SEQ ID NO: 7802 - RNA, 21 nt, Artificial Sequence
  Ebola virus siRNA sense strand
aaugagacagaguacuuguuc

SEQ ID NO: 7803 - RNA, 21 nt, Artificial Sequence
  Ebola virus siRNA sense strand
augagacagaguacuuguucg

SEQ ID NO: 7804 - RNA, 21 nt, Artificial Sequence
  Ebola virus siRNA sense strand
ugagacagaguacuuguucga

SEQ ID NO: 7805 - RNA, 21 nt, Artificial Sequence
  Ebola virus siRNA sense strand
gagacagaguacuuguucgag

SEQ ID NO: 7806 - RNA, 21 nt, Artificial Sequence
  Ebola virus siRNA sense strand
agacagaguacuuguucgagg

SEQ ID NO: 7807 - RNA, 21 nt, Artificial Sequence
  Ebola virus siRNA sense strand
gacagaguacuuguucgaggu

SEQ ID NO: 7808 - RNA, 21 nt, Artificial Sequence
  Ebola virus siRNA sense strand
acagaguacuuguucgagguu

SEQ ID NO: 7809 - RNA, 21 nt, Artificial Sequence
  Ebola virus siRNA sense strand
cagaguacuuguucgagguug

SEQ ID NO: 7810 - RNA, 21 nt, Artificial Sequence
  Ebola virus siRNA sense strand
agaguacuuguucgagguuga

SEQ ID NO: 7811 - RNA, 21 nt, Artificial Sequence
  Ebola virus siRNA sense strand
gaguacuuguucgagguugac

SEQ ID NO: 7812 - RNA, 21 nt, Artificial Sequence
  Ebola virus siRNA sense strand
aguacuuguucgagguugaca

SEQ ID NO: 7813 - RNA, 21 nt, Artificial Sequence
  Ebola virus siRNA sense strand
guacuuguucgagguugacaa

SEQ ID NO: 7814 - RNA, 21 nt, Artificial Sequence
  Ebola virus siRNA sense strand
uacuuguucgagguugacaau

SEQ ID NO: 7815 - RNA, 21 nt, Artificial Sequence
  Ebola virus siRNA sense strand
acuuguucgagguugacaauu

SEQ ID NO: 7816 - RNA, 21 nt, Artificial Sequence
  Ebola virus siRNA sense strand
cuuguucgagguugacaauuu

SEQ ID NO: 7817 - RNA, 21 nt, Artificial Sequence
  Ebola virus siRNA sense strand
uuguucgagguugacaauuug

SEQ ID NO: 7818 - RNA, 21 nt, Artificial Sequence
  Ebola virus siRNA sense strand
uguucgagguugacaauuuga

SEQ ID NO: 7819 - RNA, 21 nt, Artificial Sequence
  Ebola virus siRNA sense strand
guucgagguugacaauuugac

SEQ ID NO: 7820 - RNA, 21 nt, Artificial Sequence
  Ebola virus siRNA sense strand
uucgagguugacaauuugacc

SEQ ID NO: 7821 - RNA, 21 nt, Artificial Sequence
  Ebola virus siRNA sense strand
ucgagguugacaauuugaccu

SEQ ID NO: 7822 - RNA, 21 nt, Artificial Sequence
  Ebola virus siRNA sense strand
cgagguugacaauuugaccua

SEQ ID NO: 7823 - RNA, 21 nt, Artificial Sequence
  Ebola virus siRNA sense strand
gagguugacaauuugaccuac

SEQ ID NO: 7824 - RNA, 21 nt, Artificial Sequence
  Ebola virus siRNA sense strand
agguugacaauuugaccuacg

SEQ ID NO: 7825 - RNA, 21 nt, Artificial Sequence
  Ebola virus siRNA sense strand
gguugacaauuugaccuacgu

SEQ ID NO: 7826 - RNA, 21 nt, Artificial Sequence
  Ebola virus siRNA sense strand
guugacaauuugaccuacguc

SEQ ID NO: 7827 - RNA, 21 nt, Artificial Sequence
  Ebola virus siRNA sense strand
uugacaauuugaccuacgucc

SEQ ID NO: 7828 - RNA, 21 nt, Artificial Sequence
  Ebola virus siRNA sense strand
ugacaauuugaccuacgucca

SEQ ID NO: 7829 - RNA, 21 nt, Artificial Sequence
  Ebola virus siRNA sense strand
gacaauuugaccuacguccaa

SEQ ID NO: 7830 - RNA, 21 nt, Artificial Sequence
  Ebola virus siRNA sense strand
acaauuugaccuacguccaac

SEQ ID NO: 7831 - RNA, 21 nt, Artificial Sequence
  Ebola virus siRNA sense strand
caauuugaccuacguccaacu

SEQ ID NO: 7832 - RNA, 21 nt, Artificial Sequence
  Ebola virus siRNA sense strand
aauuugaccuacguccaacuu

SEQ ID NO: 7833 - RNA, 21 nt, Artificial Sequence
  Ebola virus siRNA sense strand
auuugaccuacguccaacuug

SEQ ID NO: 7834 - RNA, 21 nt, Artificial Sequence
  Ebola virus siRNA sense strand
uuugaccuacguccaacuuga

SEQ ID NO: 7835 - RNA, 21 nt, Artificial Sequence
  Ebola virus siRNA sense strand
uugaccuacguccaacuugaa

SEQ ID NO: 7836 - RNA, 21 nt, Artificial Sequence
  Ebola virus siRNA sense strand
ugaccuacguccaacuugaau

SEQ ID NO: 7837 - RNA, 21 nt, Artificial Sequence
  Ebola virus siRNA sense strand
gaccuacguccaacuugaauc

SEQ ID NO: 7838 - RNA, 21 nt, Artificial Sequence
  Ebola virus siRNA sense strand
accuacguccaacuugaauca

SEQ ID NO: 7839 - RNA, 21 nt, Artificial Sequence
  Ebola virus siRNA sense strand
ccuacguccaacuugaaucaa

SEQ ID NO: 7840 - RNA, 21 nt, Artificial Sequence
  Ebola virus siRNA sense strand
cuacguccaacuugaaucaag

SEQ ID NO: 7841 - RNA, 21 nt, Artificial Sequence
  Ebola virus siRNA sense strand
uacguccaacuugaaucaaga

SEQ ID NO: 7842 - RNA, 21 nt, Artificial Sequence
  Ebola virus siRNA sense strand
acguccaacuugaaucaagau

SEQ ID NO: 7843 - RNA, 21 nt, Artificial Sequence
  Ebola virus siRNA sense strand
cguccaacuugaaucaagauu

SEQ ID NO: 7844 - RNA, 21 nt, Artificial Sequence
  Ebola virus siRNA sense strand
guccaacuugaaucaagauuc

SEQ ID NO: 7845 - RNA, 21 nt, Artificial Sequence
  Ebola virus siRNA sense strand
uccaacuugaaucaagauuca

SEQ ID NO: 7846 - RNA, 21 nt, Artificial Sequence
  Ebola virus siRNA sense strand
ccaacuugaaucaagauucac

SEQ ID NO: 7847 - RNA, 21 nt, Artificial Sequence
  Ebola virus siRNA sense strand
caacuugaaucaagauucaca

SEQ ID NO: 7848 - RNA, 21 nt, Artificial Sequence
  Ebola virus siRNA sense strand
aacuugaaucaagauucacac

SEQ ID NO: 7849 - RNA, 21 nt, Artificial Sequence
  Ebola virus siRNA sense strand
acuugaaucaagauucacacc

SEQ ID NO: 7850 - RNA, 21 nt, Artificial Sequence
  Ebola virus siRNA sense strand
cuugaaucaagauucacacca

SEQ ID NO: 7851 - RNA, 21 nt, Artificial Sequence
  Ebola virus siRNA sense strand
uugaaucaagauucacaccac

SEQ ID NO: 7852 - RNA, 21 nt, Artificial Sequence
  Ebola virus siRNA sense strand
ugaaucaagauucacaccaca

SEQ ID NO: 7853 - RNA, 21 nt, Artificial Sequence
  Ebola virus siRNA sense strand
gaaucaagauucacaccacag

SEQ ID NO: 7854 - RNA, 21 nt, Artificial Sequence
  Ebola virus siRNA sense strand
aaucaagauucacaccacagu

SEQ ID NO: 7855 - RNA, 21 nt, Artificial Sequence
  Ebola virus siRNA sense strand
aucaagauucacaccacaguu

SEQ ID NO: 7856 - RNA, 21 nt, Artificial Sequence
  Ebola virus siRNA sense strand
ucaagauucacaccacaguuu

SEQ ID NO: 7857 - RNA, 21 nt, Artificial Sequence
  Ebola virus siRNA sense strand
caagauucacaccacaguuuc

SEQ ID NO: 7858 - RNA, 21 nt, Artificial Sequence
  Ebola virus siRNA sense strand
aagauucacaccacaguuucu

SEQ ID NO: 7859 - RNA, 21 nt, Artificial Sequence
  Ebola virus siRNA sense strand
agauucacaccacaguuucug

SEQ ID NO: 7860 - RNA, 21 nt, Artificial Sequence
  Ebola virus siRNA sense strand
gauucacaccacaguuucugc

SEQ ID NO: 7861 - RNA, 21 nt, Artificial Sequence
  Ebola virus siRNA sense strand
auucacaccacaguuucugcu

SEQ ID NO: 7862 - RNA, 21 nt, Artificial Sequence
  Ebola virus siRNA sense strand
uucacaccacaguuucugcuc

SEQ ID NO: 7863 - RNA, 21 nt, Artificial Sequence
  Ebola virus siRNA sense strand
ucacaccacaguuucugcucc

SEQ ID NO: 7864 - RNA, 21 nt, Artificial Sequence
  Ebola virus siRNA sense strand
cacaccacaguuucugcucca

SEQ ID NO: 7865 - RNA, 21 nt, Artificial Sequence
  Ebola virus siRNA sense strand
acaccacaguuucugcuccag

SEQ ID NO: 7866 - RNA, 21 nt, Artificial Sequence
  Ebola virus siRNA sense strand
caccacaguuucugcuccagc

SEQ ID NO: 7867 - RNA, 21 nt, Artificial Sequence
  Ebola virus siRNA sense strand
accacaguuucugcuccagcu

SEQ ID NO: 7868 - RNA, 21 nt, Artificial Sequence
  Ebola virus siRNA sense strand
ccacaguuucugcuccagcug

SEQ ID NO: 7869 - RNA, 21 nt, Artificial Sequence
  Ebola virus siRNA sense strand
cacaguuucugcuccagcuga

SEQ ID NO: 7870 - RNA, 21 nt, Artificial Sequence
  Ebola virus siRNA sense strand
acaguuucugcuccagcugaa

SEQ ID NO: 7871 - RNA, 21 nt, Artificial Sequence
  Ebola virus siRNA sense strand
caguuucugcuccagcugaau

SEQ ID NO: 7872 - RNA, 21 nt, Artificial Sequence
  Ebola virus siRNA sense strand
aguuucugcuccagcugaaug

SEQ ID NO: 7873 - RNA, 21 nt, Artificial Sequence
  Ebola virus siRNA sense strand
guuucugcuccagcugaauga

SEQ ID NO: 7874 - RNA, 21 nt, Artificial Sequence
  Ebola virus siRNA sense strand
uuucugcuccagcugaaugag

SEQ ID NO: 7875 - RNA, 21 nt, Artificial Sequence
  Ebola virus siRNA sense strand
uucugcuccagcugaaugaga

SEQ ID NO: 7876 - RNA, 21 nt, Artificial Sequence
  Ebola virus siRNA sense strand
ucugcuccagcugaaugagac

SEQ ID NO: 7877 - RNA, 21 nt, Artificial Sequence
  Ebola virus siRNA sense strand
cugcuccagcugaaugagaca

SEQ ID NO: 7878 - RNA, 21 nt, Artificial Sequence
  Ebola virus siRNA sense strand
ugcuccagcugaaugagacaa

SEQ ID NO: 7879 - RNA, 21 nt, Artificial Sequence
  Ebola virus siRNA sense strand
gcuccagcugaaugagacaau

SEQ ID NO: 7880 - RNA, 21 nt, Artificial Sequence
  Ebola virus siRNA sense strand
cuccagcugaaugagacaaua

SEQ ID NO: 7881 - RNA, 21 nt, Artificial Sequence
  Ebola virus siRNA sense strand
uccagcugaaugagacaauau

SEQ ID NO: 7882 - RNA, 21 nt, Artificial Sequence
  Ebola virus siRNA sense strand
ccagcugaaugagacaauaua

SEQ ID NO: 7883 - RNA, 21 nt, Artificial Sequence
  Ebola virus siRNA sense strand
cagcugaaugagacaauauau

SEQ ID NO: 7884 - RNA, 21 nt, Artificial Sequence
  Ebola virus siRNA sense strand
agcugaaugagacaauauaua

SEQ ID NO: 7885 - RNA, 21 nt, Artificial Sequence
  Ebola virus siRNA sense strand
gcugaaugagacaauauauac

SEQ ID NO: 7886 - RNA, 21 nt, Artificial Sequence
  Ebola virus siRNA sense strand
cugaaugagacaauauauaca

SEQ ID NO: 7887 - RNA, 21 nt, Artificial Sequence
  Ebola virus siRNA sense strand
ugaaugagacaauauauacaa

SEQ ID NO: 7888 - RNA, 21 nt, Artificial Sequence
  Ebola virus siRNA sense strand
gaaugagacaauauauacaag

SEQ ID NO: 7889 - RNA, 21 nt, Artificial Sequence
  Ebola virus siRNA sense strand
aaugagacaauauauacaagu

SEQ ID NO: 7890 - RNA, 21 nt, Artificial Sequence
  Ebola virus siRNA sense strand
augagacaauauauacaagug

SEQ ID NO: 7891 - RNA, 21 nt, Artificial Sequence
  Ebola virus siRNA sense strand
ugagacaauauauacaagugg

SEQ ID NO: 7892 - RNA, 21 nt, Artificial Sequence
  Ebola virus siRNA sense strand
gagacaauauauacaaguggg

SEQ ID NO: 7893 - RNA, 21 nt, Artificial Sequence
  Ebola virus siRNA sense strand
agacaauauauacaaguggga

SEQ ID NO: 7894 - RNA, 21 nt, Artificial Sequence
  Ebola virus siRNA sense strand
gacaauauauacaagugggaa

SEQ ID NO: 7895 - RNA, 21 nt, Artificial Sequence
  Ebola virus siRNA sense strand
acaauauauacaagugggaaa

SEQ ID NO: 7896 - RNA, 21 nt, Artificial Sequence
  Ebola virus siRNA sense strand
caauauauacaagugggaaaa

SEQ ID NO: 7897 - RNA, 21 nt, Artificial Sequence
  Ebola virus siRNA sense strand
aauauauacaagugggaaaag

SEQ ID NO: 7898 - RNA, 21 nt, Artificial Sequence
  Ebola virus siRNA sense strand
auauauacaagugggaaaagg

SEQ ID NO: 7899 - RNA, 21 nt, Artificial Sequence
  Ebola virus siRNA sense strand
uauauacaagugggaaaagga

SEQ ID NO: 7900 - RNA, 21 nt, Artificial Sequence
  Ebola virus siRNA sense strand
auauacaagugggaaaaggag

SEQ ID NO: 7901 - RNA, 21 nt, Artificial Sequence
  Ebola virus siRNA sense strand
uauacaagugggaaaaggagc

SEQ ID NO: 7902 - RNA, 21 nt, Artificial Sequence
  Ebola virus siRNA sense strand
auacaagugggaaaaggagca

SEQ ID NO: 7903 - RNA, 21 nt, Artificial Sequence
  Ebola virus siRNA sense strand
uacaagugggaaaaggagcaa

SEQ ID NO: 7904 - RNA, 21 nt, Artificial Sequence
  Ebola virus siRNA sense strand
acaagugggaaaaggagcaau

SEQ ID NO: 7905 - RNA, 21 nt, Artificial Sequence
  Ebola virus siRNA sense strand
caagugggaaaaggagcaaua

SEQ ID NO: 7906 - RNA, 21 nt, Artificial Sequence
  Ebola virus siRNA sense strand
aagugggaaaaggagcaauac

SEQ ID NO: 7907 - RNA, 21 nt, Artificial Sequence
  Ebola virus siRNA sense strand
agugggaaaaggagcaauacc

SEQ ID NO: 7908 - RNA, 21 nt, Artificial Sequence
  Ebola virus siRNA sense strand
gugggaaaaggagcaauacca

SEQ ID NO: 7909 - RNA, 21 nt, Artificial Sequence
  Ebola virus siRNA sense strand
ugggaaaaggagcaauaccac

SEQ ID NO: 7910 - RNA, 21 nt, Artificial Sequence
  Ebola virus siRNA sense strand
gggaaaaggagcaauaccacg

SEQ ID NO: 7911 - RNA, 21 nt, Artificial Sequence
  Ebola virus siRNA sense strand
ggaaaaggagcaauaccacgg

SEQ ID NO: 7912 - RNA, 21 nt, Artificial Sequence
  Ebola virus siRNA sense strand
gaaaaggagcaauaccacggg

SEQ ID NO: 7913 - RNA, 21 nt, Artificial Sequence
  Ebola virus siRNA sense strand
aaaaggagcaauaccacggga

SEQ ID NO: 7914 - RNA, 21 nt, Artificial Sequence
  Ebola virus siRNA sense strand
aaaggagcaauaccacgggaa

SEQ ID NO: 7915 - RNA, 21 nt, Artificial Sequence
  Ebola virus siRNA sense strand
aaggagcaauaccacgggaaa

SEQ ID NO: 7916 - RNA, 21 nt, Artificial Sequence
  Ebola virus siRNA sense strand
aggagcaauaccacgggaaaa

SEQ ID NO: 7917 - RNA, 21 nt, Artificial Sequence
  Ebola virus siRNA sense strand
ggagcaauaccacgggaaaac

SEQ ID NO: 7918 - RNA, 21 nt, Artificial Sequence
  Ebola virus siRNA sense strand
gagcaauaccacgggaaaacu

SEQ ID NO: 7919 - RNA, 21 nt, Artificial Sequence
  Ebola virus siRNA sense strand
agcaauaccacgggaaaacua

SEQ ID NO: 7920 - RNA, 21 nt, Artificial Sequence
  Ebola virus siRNA sense strand
gcaauaccacgggaaaacuaa

SEQ ID NO: 7921 - RNA, 21 nt, Artificial Sequence
  Ebola virus siRNA sense strand
caauaccacgggaaaacuaau

SEQ ID NO: 7922 - RNA, 21 nt, Artificial Sequence
  Ebola virus siRNA sense strand
aauaccacgggaaaacuaauu

SEQ ID NO: 7923 - RNA, 21 nt, Artificial Sequence
  Ebola virus siRNA sense strand
auaccacgggaaaacuaauuu

SEQ ID NO: 7924 - RNA, 21 nt, Artificial Sequence
  Ebola virus siRNA sense strand
uaccacgggaaaacuaauuug

SEQ ID NO: 7925 - RNA, 21 nt, Artificial Sequence
  Ebola virus siRNA sense strand
accacgggaaaacuaauuugg

SEQ ID NO: 7926 - RNA, 21 nt, Artificial Sequence
  Ebola virus siRNA sense strand
ccacgggaaaacuaauuugga

SEQ ID NO: 7927 - RNA, 21 nt, Artificial Sequence
  Ebola virus siRNA sense strand
cacgggaaaacuaauuuggaa

SEQ ID NO: 7928 - RNA, 21 nt, Artificial Sequence
  Ebola virus siRNA sense strand
acgggaaaacuaauuuggaag

SEQ ID NO: 7929 - RNA, 21 nt, Artificial Sequence
  Ebola virus siRNA sense strand
cgggaaaacuaauuuggaagg

SEQ ID NO: 7930 - RNA, 21 nt, Artificial Sequence
  Ebola virus siRNA sense strand
gggaaaacuaauuuggaaggu

SEQ ID NO: 7931 - RNA, 21 nt, Artificial Sequence
  Ebola virus siRNA sense strand
ggaaaacuaauuuggaagguc

SEQ ID NO: 7932 - RNA, 21 nt, Artificial Sequence
  Ebola virus siRNA sense strand
gaaaacuaauuuggaagguca

SEQ ID NO: 7933 - RNA, 21 nt, Artificial Sequence
  Ebola virus siRNA sense strand
aaaacuaauuuggaaggucaa

SEQ ID NO: 7934 - RNA, 21 nt, Artificial Sequence
  Ebola virus siRNA sense strand
aaacuaauuuggaaggucaac

SEQ ID NO: 7935 - RNA, 21 nt, Artificial Sequence
  Ebola virus siRNA sense strand
aacuaauuuggaaggucaacc

SEQ ID NO: 7936 - RNA, 21 nt, Artificial Sequence
  Ebola virus siRNA sense strand
acuaauuuggaaggucaaccc

SEQ ID NO: 7937 - RNA, 21 nt, Artificial Sequence
  Ebola virus siRNA sense strand
cuaauuuggaaggucaacccc

SEQ ID NO: 7938 - RNA, 21 nt, Artificial Sequence
  Ebola virus siRNA sense strand
uaauuuggaaggucaaccccg

SEQ ID NO: 7939 - RNA, 21 nt, Artificial Sequence
  Ebola virus siRNA sense strand
aauuuggaaggucaaccccga

SEQ ID NO: 7940 - RNA, 21 nt, Artificial Sequence
  Ebola virus siRNA sense strand
auuuggaaggucaaccccgaa

SEQ ID NO: 7941 - RNA, 21 nt, Artificial Sequence
  Ebola virus siRNA sense strand
uuuggaaggucaaccccgaaa

SEQ ID NO: 7942 - RNA, 21 nt, Artificial Sequence
  Ebola virus siRNA sense strand
uuggaaggucaaccccgaaau

SEQ ID NO: 7943 - RNA, 21 nt, Artificial Sequence
  Ebola virus siRNA sense strand
uggaaggucaaccccgaaauu

SEQ ID NO: 7944 - RNA, 21 nt, Artificial Sequence
  Ebola virus siRNA sense strand
ggaaggucaaccccgaaauug

SEQ ID NO: 7945 - RNA, 21 nt, Artificial Sequence
  Ebola virus siRNA sense strand
gaaggucaaccccgaaauuga

SEQ ID NO: 7946 - RNA, 21 nt, Artificial Sequence
  Ebola virus siRNA sense strand
aaggucaaccccgaaauugau

SEQ ID NO: 7947 - RNA, 21 nt, Artificial Sequence
  Ebola virus siRNA sense strand
aggucaaccccgaaauugaua

SEQ ID NO: 7948 - RNA, 21 nt, Artificial Sequence
  Ebola virus siRNA sense strand
ggucaaccccgaaauugauac

SEQ ID NO: 7949 - RNA, 21 nt, Artificial Sequence
  Ebola virus siRNA sense strand
gucaaccccgaaauugauaca

SEQ ID NO: 7950 - RNA, 21 nt, Artificial Sequence
  Ebola virus siRNA sense strand
ucaaccccgaaauugauacaa

SEQ ID NO: 7951 - RNA, 21 nt, Artificial Sequence
  Ebola virus siRNA sense strand
caaccccgaaauugauacaac

SEQ ID NO: 7952 - RNA, 21 nt, Artificial Sequence
  Ebola virus siRNA sense strand
aaccccgaaauugauacaaca

SEQ ID NO: 7953 - RNA, 21 nt, Artificial Sequence
  Ebola virus siRNA sense strand
accccgaaauugauacaacaa

SEQ ID NO: 7954 - RNA, 21 nt, Artificial Sequence
  Ebola virus siRNA sense strand
ccccgaaauugauacaacaau

SEQ ID NO: 7955 - RNA, 21 nt, Artificial Sequence
  Ebola virus siRNA sense strand
cccgaaauugauacaacaauc

SEQ ID NO: 7956 - RNA, 21 nt, Artificial Sequence
  Ebola virus siRNA sense strand
ccgaaauugauacaacaaucg

SEQ ID NO: 7957 - RNA, 21 nt, Artificial Sequence
  Ebola virus siRNA sense strand
cgaaauugauacaacaaucgg

SEQ ID NO: 7958 - RNA, 21 nt, Artificial Sequence
  Ebola virus siRNA sense strand
gaaauugauacaacaaucggg

SEQ ID NO: 7959 - RNA, 21 nt, Artificial Sequence
  Ebola virus siRNA sense strand
aaauugauacaacaaucgggg

SEQ ID NO: 7960 - RNA, 21 nt, Artificial Sequence
  Ebola virus siRNA sense strand
aauugauacaacaaucgggga

SEQ ID NO: 7961 - RNA, 21 nt, Artificial Sequence
  Ebola virus siRNA sense strand
auugauacaacaaucggggag

SEQ ID NO: 7962 - RNA, 21 nt, Artificial Sequence
  Ebola virus siRNA sense strand
uugauacaacaaucggggagu

SEQ ID NO: 7963 - RNA, 21 nt, Artificial Sequence
  Ebola virus siRNA sense strand
ugauacaacaaucggggagug

SEQ ID NO: 7964 - RNA, 21 nt, Artificial Sequence
  Ebola virus siRNA sense strand
gauacaacaaucggggagugg

SEQ ID NO: 7965 - RNA, 21 nt, Artificial Sequence
  Ebola virus siRNA sense strand
auacaacaaucggggaguggg

SEQ ID NO: 7966 - RNA, 21 nt, Artificial Sequence
  Ebola virus siRNA sense strand
uacaacaaucggggagugggc

SEQ ID NO: 7967 - RNA, 21 nt, Artificial Sequence
  Ebola virus siRNA sense strand
acaacaaucggggagugggcc

SEQ ID NO: 7968 - RNA, 21 nt, Artificial Sequence
  Ebola virus siRNA sense strand
caacaaucggggagugggccu

SEQ ID NO: 7969 - RNA, 21 nt, Artificial Sequence
  Ebola virus siRNA sense strand
aacaaucggggagugggccuu

SEQ ID NO: 7970 - RNA, 21 nt, Artificial Sequence
  Ebola virus siRNA sense strand
acaaucggggagugggccuuc

SEQ ID NO: 7971 - RNA, 21 nt, Artificial Sequence
  Ebola virus siRNA sense strand
caaucggggagugggccuucu

SEQ ID NO: 7972 - RNA, 21 nt, Artificial Sequence
  Ebola virus siRNA sense strand
aaucggggagugggccuucug

SEQ ID NO: 7973 - RNA, 21 nt, Artificial Sequence
  Ebola virus siRNA sense strand
aucggggagugggccuucugg

SEQ ID NO: 7974 - RNA, 21 nt, Artificial Sequence
  Ebola virus siRNA sense strand
ucggggagugggccuucuggg

SEQ ID NO: 7975 - RNA, 21 nt, Artificial Sequence
  Ebola virus siRNA sense strand
cggggagugggccuucuggga

SEQ ID NO: 7976 - RNA, 21 nt, Artificial Sequence
  Ebola virus siRNA sense strand
ggggagugggccuucugggaa

SEQ ID NO: 7977 - RNA, 21 nt, Artificial Sequence
  Ebola virus siRNA sense strand
gggagugggccuucugggaaa

SEQ ID NO: 7978 - RNA, 21 nt, Artificial Sequence
  Ebola virus siRNA sense strand
ggagugggccuucugggaaac

SEQ ID NO: 7979 - RNA, 21 nt, Artificial Sequence
  Ebola virus siRNA sense strand
gagugggccuucugggaaacu

SEQ ID NO: 7980 - RNA, 21 nt, Artificial Sequence
  Ebola virus siRNA sense strand
agugggccuucugggaaacua

SEQ ID NO: 7981 - RNA, 21 nt, Artificial Sequence
  Ebola virus siRNA sense strand
gugggccuucugggaaacuaa

SEQ ID NO: 7982 - RNA, 21 nt, Artificial Sequence
  Ebola virus siRNA sense strand
ugggccuucugggaaacuaaa

SEQ ID NO: 7983 - RNA, 21 nt, Artificial Sequence
  Ebola virus siRNA sense strand
gggccuucugggaaacuaaaa

SEQ ID NO: 7984 - RNA, 21 nt, Artificial Sequence
  Ebola virus siRNA sense strand
ggccuucugggaaacuaaaaa

SEQ ID NO: 7985 - RNA, 21 nt, Artificial Sequence
  Ebola virus siRNA sense strand
gccuucugggaaacuaaaaaa

SEQ ID NO: 7986 - RNA, 21 nt, Artificial Sequence
  Ebola virus siRNA sense strand
ccuucugggaaacuaaaaaaa

SEQ ID NO: 7987 - RNA, 21 nt, Artificial Sequence
  Ebola virus siRNA sense strand
cuucugggaaacuaaaaaaac

SEQ ID NO: 7988 - RNA, 21 nt, Artificial Sequence
  Ebola virus siRNA sense strand
uucugggaaacuaaaaaaacc

SEQ ID NO: 7989 - RNA, 21 nt, Artificial Sequence
  Ebola virus siRNA sense strand
ucugggaaacuaaaaaaaccu

SEQ ID NO: 7990 - RNA, 21 nt, Artificial Sequence
  Ebola virus siRNA sense strand
cugggaaacuaaaaaaaccuc

SEQ ID NO: 7991 - RNA, 21 nt, Artificial Sequence
  Ebola virus siRNA sense strand
ugggaaacuaaaaaaaccuca

SEQ ID NO: 7992 - RNA, 21 nt, Artificial Sequence
  Ebola virus siRNA sense strand
gggaaacuaaaaaaaccucac

SEQ ID NO: 7993 - RNA, 21 nt, Artificial Sequence
  Ebola virus siRNA sense strand
ggaaacuaaaaaaaccucacu

SEQ ID NO: 7994 - RNA, 21 nt, Artificial Sequence
  Ebola virus siRNA sense strand
gaaacuaaaaaaaccucacua

SEQ ID NO: 7995 - RNA, 21 nt, Artificial Sequence
  Ebola virus siRNA sense strand
aaacuaaaaaaaccucacuag

SEQ ID NO: 7996 - RNA, 21 nt, Artificial Sequence
  Ebola virus siRNA sense strand
aacuaaaaaaaccucacuaga

SEQ ID NO: 7997 - RNA, 21 nt, Artificial Sequence
  Ebola virus siRNA sense strand
acuaaaaaaaccucacuagaa

SEQ ID NO: 7998 - RNA, 21 nt, Artificial Sequence
  Ebola virus siRNA sense strand
cuaaaaaaaccucacuagaaa

SEQ ID NO: 7999 - RNA, 21 nt, Artificial Sequence
  Ebola virus siRNA sense strand
uaaaaaaaccucacuagaaaa

SEQ ID NO: 8000 - RNA, 21 nt, Artificial Sequence
  Ebola virus siRNA sense strand
aaaaaaaccucacuagaaaaa

SEQ ID NO: 8001 - RNA, 21 nt, Artificial Sequence
  Ebola virus siRNA sense strand
aaaaaaccucacuagaaaaau

SEQ ID NO: 8002 - RNA, 21 nt, Artificial Sequence
  Ebola virus siRNA sense strand
aaaaaccucacuagaaaaauu

SEQ ID NO: 8003 - RNA, 21 nt, Artificial Sequence
  Ebola virus siRNA sense strand
aaaaccucacuagaaaaauuc

SEQ ID NO: 8004 - RNA, 21 nt, Artificial Sequence
  Ebola virus siRNA sense strand
aaaccucacuagaaaaauucg

SEQ ID NO: 8005 - RNA, 21 nt, Artificial Sequence
  Ebola virus siRNA sense strand
aaccucacuagaaaaauucgc

SEQ ID NO: 8006 - RNA, 21 nt, Artificial Sequence
  Ebola virus siRNA sense strand
accucacuagaaaaauucgca

SEQ ID NO: 8007 - RNA, 21 nt, Artificial Sequence
  Ebola virus siRNA sense strand
ccucacuagaaaaauucgcag

SEQ ID NO: 8008 - RNA, 21 nt, Artificial Sequence
  Ebola virus siRNA sense strand
cucacuagaaaaauucgcagu

SEQ ID NO: 8009 - RNA, 21 nt, Artificial Sequence
  Ebola virus siRNA sense strand
ucacuagaaaaauucgcagug

SEQ ID NO: 8010 - RNA, 21 nt, Artificial Sequence
  Ebola virus siRNA sense strand
cacuagaaaaauucgcaguga

SEQ ID NO: 8011 - RNA, 21 nt, Artificial Sequence
  Ebola virus siRNA sense strand
acuagaaaaauucgcagugaa

SEQ ID NO: 8012 - RNA, 21 nt, Artificial Sequence
  Ebola virus siRNA sense strand
cuagaaaaauucgcagugaag

SEQ ID NO: 8013 - RNA, 21 nt, Artificial Sequence
  Ebola virus siRNA sense strand
uagaaaaauucgcagugaaga

SEQ ID NO: 8014 - RNA, 21 nt, Artificial Sequence
  Ebola virus siRNA sense strand
agaaaaauucgcagugaagag

SEQ ID NO: 8015 - RNA, 21 nt, Artificial Sequence
  Ebola virus siRNA sense strand
gaaaaauucgcagugaagagu

SEQ ID NO: 8016 - RNA, 21 nt, Artificial Sequence
  Ebola virus siRNA sense strand
aaaaauucgcagugaagaguu

SEQ ID NO: 8017 - RNA, 21 nt, Artificial Sequence
  Ebola virus siRNA sense strand
aaaauucgcagugaagaguug

SEQ ID NO: 8018 - RNA, 21 nt, Artificial Sequence
  Ebola virus siRNA sense strand
aaauucgcagugaagaguugu

SEQ ID NO: 8019 - RNA, 21 nt, Artificial Sequence
  Ebola virus siRNA sense strand
aauucgcagugaagaguuguc

SEQ ID NO: 8020 - RNA, 21 nt, Artificial Sequence
  Ebola virus siRNA sense strand
auucgcagugaagaguugucu

SEQ ID NO: 8021 - RNA, 21 nt, Artificial Sequence
  Ebola virus siRNA sense strand
uucgcagugaagaguugucuu

SEQ ID NO: 8022 - RNA, 21 nt, Artificial Sequence
  Ebola virus siRNA sense strand
ucgcagugaagaguugucuuu

SEQ ID NO: 8023 - RNA, 21 nt, Artificial Sequence
  Ebola virus siRNA sense strand
cgcagugaagaguugucuuuc

SEQ ID NO: 8024 - RNA, 21 nt, Artificial Sequence
  Ebola virus siRNA sense strand
gcagugaagaguugucuuuca

SEQ ID NO: 8025 - RNA, 21 nt, Artificial Sequence
  Ebola virus siRNA sense strand
cagugaagaguugucuuucac

SEQ ID NO: 8026 - RNA, 21 nt, Artificial Sequence
  Ebola virus siRNA sense strand
agugaagaguugucuuucaca

SEQ ID NO: 8027 - RNA, 21 nt, Artificial Sequence
  Ebola virus siRNA sense strand
gugaagaguugucuuucacag

SEQ ID NO: 8028 - RNA, 21 nt, Artificial Sequence
  Ebola virus siRNA sense strand
ugaagaguugucuuucacagu

SEQ ID NO: 8029 - RNA, 21 nt, Artificial Sequence
  Ebola virus siRNA sense strand
gaagaguugucuuucacaguu

SEQ ID NO: 8030 - RNA, 21 nt, Artificial Sequence
  Ebola virus siRNA sense strand
aagaguugucuuucacaguug

SEQ ID NO: 8031 - RNA, 21 nt, Artificial Sequence
  Ebola virus siRNA sense strand
agaguugucuuucacaguugu

SEQ ID NO: 8032 - RNA, 21 nt, Artificial Sequence
  Ebola virus siRNA sense strand
gaguugucuuucacaguugua

SEQ ID NO: 8033 - RNA, 21 nt, Artificial Sequence
  Ebola virus siRNA sense strand
aguugucuuucacaguuguau

SEQ ID NO: 8034 - RNA, 21 nt, Artificial Sequence
  Ebola virus siRNA sense strand
guugucuuucacaguuguauc

SEQ ID NO: 8035 - RNA, 21 nt, Artificial Sequence
  Ebola virus siRNA sense strand
uugucuuucacaguuguauca

SEQ ID NO: 8036 - RNA, 21 nt, Artificial Sequence
  Ebola virus siRNA sense strand
ugucuuucacaguuguaucaa

SEQ ID NO: 8037 - RNA, 21 nt, Artificial Sequence
  Ebola virus siRNA sense strand
gucuuucacaguuguaucaaa

SEQ ID NO: 8038 - RNA, 21 nt, Artificial Sequence
  Ebola virus siRNA sense strand
ucuuucacaguuguaucaaac

SEQ ID NO: 8039 - RNA, 21 nt, Artificial Sequence
  Ebola virus siRNA sense strand
cuuucacaguuguaucaaacg

SEQ ID NO: 8040 - RNA, 21 nt, Artificial Sequence
  Ebola virus siRNA sense strand
uuucacaguuguaucaaacgg

SEQ ID NO: 8041 - RNA, 21 nt, Artificial Sequence
  Ebola virus siRNA sense strand
uucacaguuguaucaaacgga

SEQ ID NO: 8042 - RNA, 21 nt, Artificial Sequence
  Ebola virus siRNA sense strand
ucacaguuguaucaaacggag

SEQ ID NO: 8043 - RNA, 21 nt, Artificial Sequence
  Ebola virus siRNA sense strand
cacaguuguaucaaacggagc

SEQ ID NO: 8044 - RNA, 21 nt, Artificial Sequence
  Ebola virus siRNA sense strand
acaguuguaucaaacggagcc

SEQ ID NO: 8045 - RNA, 21 nt, Artificial Sequence
  Ebola virus siRNA sense strand
caguuguaucaaacggagcca

SEQ ID NO: 8046 - RNA, 21 nt, Artificial Sequence
  Ebola virus siRNA sense strand
aguuguaucaaacggagccaa

SEQ ID NO: 8047 - RNA, 21 nt, Artificial Sequence
  Ebola virus siRNA sense strand
guuguaucaaacggagccaaa

SEQ ID NO: 8048 - RNA, 21 nt, Artificial Sequence
  Ebola virus siRNA sense strand
uuguaucaaacggagccaaaa

SEQ ID NO: 8049 - RNA, 21 nt, Artificial Sequence
  Ebola virus siRNA sense strand
uguaucaaacggagccaaaaa

SEQ ID NO: 8050 - RNA, 21 nt, Artificial Sequence
  Ebola virus siRNA sense strand
guaucaaacggagccaaaaac

SEQ ID NO: 8051 - RNA, 21 nt, Artificial Sequence
  Ebola virus siRNA sense strand
uaucaaacggagccaaaaaca

SEQ ID NO: 8052 - RNA, 21 nt, Artificial Sequence
  Ebola virus siRNA sense strand
aucaaacggagccaaaaacau

SEQ ID NO: 8053 - RNA, 21 nt, Artificial Sequence
  Ebola virus siRNA sense strand
ucaaacggagccaaaaacauc

SEQ ID NO: 8054 - RNA, 21 nt, Artificial Sequence
  Ebola virus siRNA sense strand
caaacggagccaaaaacauca

SEQ ID NO: 8055 - RNA, 21 nt, Artificial Sequence
  Ebola virus siRNA sense strand
aaacggagccaaaaacaucag

SEQ ID NO: 8056 - RNA, 21 nt, Artificial Sequence
  Ebola virus siRNA sense strand
aacggagccaaaaacaucagu

SEQ ID NO: 8057 - RNA, 21 nt, Artificial Sequence
  Ebola virus siRNA sense strand
acggagccaaaaacaucagug

SEQ ID NO: 8058 - RNA, 21 nt, Artificial Sequence
  Ebola virus siRNA sense strand
cggagccaaaaacaucagugg

SEQ ID NO: 8059 - RNA, 21 nt, Artificial Sequence
  Ebola virus siRNA sense strand
ggagccaaaaacaucaguggu

SEQ ID NO: 8060 - RNA, 21 nt, Artificial Sequence
  Ebola virus siRNA sense strand
gagccaaaaacaucagugguc

SEQ ID NO: 8061 - RNA, 21 nt, Artificial Sequence
  Ebola virus siRNA sense strand
agccaaaaacaucagugguca

SEQ ID NO: 8062 - RNA, 21 nt, Artificial Sequence
  Ebola virus siRNA sense strand
gccaaaaacaucaguggucag

SEQ ID NO: 8063 - RNA, 21 nt, Artificial Sequence
  Ebola virus siRNA sense strand
ccaaaaacaucaguggucaga

SEQ ID NO: 8064 - RNA, 21 nt, Artificial Sequence
  Ebola virus siRNA sense strand
caaaaacaucaguggucagag

SEQ ID NO: 8065 - RNA, 21 nt, Artificial Sequence
  Ebola virus siRNA sense strand
aaaaacaucaguggucagagu

SEQ ID NO: 8066 - RNA, 21 nt, Artificial Sequence
  Ebola virus siRNA sense strand
aaaacaucaguggucagaguc

SEQ ID NO: 8067 - RNA, 21 nt, Artificial Sequence
  Ebola virus siRNA sense strand
aaacaucaguggucagagucc

SEQ ID NO: 8068 - RNA, 21 nt, Artificial Sequence
  Ebola virus siRNA sense strand
aacaucaguggucagaguccg

SEQ ID NO: 8069 - RNA, 21 nt, Artificial Sequence
  Ebola virus siRNA sense strand
acaucaguggucagaguccgg

SEQ ID NO: 8070 - RNA, 21 nt, Artificial Sequence
  Ebola virus siRNA sense strand
caucaguggucagaguccggc

SEQ ID NO: 8071 - RNA, 21 nt, Artificial Sequence
  Ebola virus siRNA sense strand
aucaguggucagaguccggcg

SEQ ID NO: 8072 - RNA, 21 nt, Artificial Sequence
  Ebola virus siRNA sense strand
ucaguggucagaguccggcgc

SEQ ID NO: 8073 - RNA, 21 nt, Artificial Sequence
  Ebola virus siRNA sense strand
caguggucagaguccggcgcg

SEQ ID NO: 8074 - RNA, 21 nt, Artificial Sequence
  Ebola virus siRNA sense strand
aguggucagaguccggcgcga

SEQ ID NO: 8075 - RNA, 21 nt, Artificial Sequence
  Ebola virus siRNA sense strand
guggucagaguccggcgcgaa

SEQ ID NO: 8076 - RNA, 21 nt, Artificial Sequence
  Ebola virus siRNA sense strand
uggucagaguccggcgcgaac

SEQ ID NO: 8077 - RNA, 21 nt, Artificial Sequence
  Ebola virus siRNA sense strand
ggucagaguccggcgcgaacu

SEQ ID NO: 8078 - RNA, 21 nt, Artificial Sequence
  Ebola virus siRNA sense strand
gucagaguccggcgcgaacuu

SEQ ID NO: 8079 - RNA, 21 nt, Artificial Sequence
  Ebola virus siRNA sense strand
ucagaguccggcgcgaacuuc

SEQ ID NO: 8080 - RNA, 21 nt, Artificial Sequence
  Ebola virus siRNA sense strand
cagaguccggcgcgaacuucu

SEQ ID NO: 8081 - RNA, 21 nt, Artificial Sequence
  Ebola virus siRNA sense strand
agaguccggcgcgaacuucuu

SEQ ID NO: 8082 - RNA, 21 nt, Artificial Sequence
  Ebola virus siRNA sense strand
gaguccggcgcgaacuucuuc

SEQ ID NO: 8083 - RNA, 21 nt, Artificial Sequence
  Ebola virus siRNA sense strand
aguccggcgcgaacuucuucc

SEQ ID NO: 8084 - RNA, 21 nt, Artificial Sequence
  Ebola virus siRNA sense strand
guccggcgcgaacuucuuccg

SEQ ID NO: 8085 - RNA, 21 nt, Artificial Sequence
  Ebola virus siRNA sense strand
uccggcgcgaacuucuuccga

SEQ ID NO: 8086 - RNA, 21 nt, Artificial Sequence
  Ebola virus siRNA sense strand
ccggcgcgaacuucuuccgac

SEQ ID NO: 8087 - RNA, 21 nt, Artificial Sequence
  Ebola virus siRNA sense strand
cggcgcgaacuucuuccgacc

SEQ ID NO: 8088 - RNA, 21 nt, Artificial Sequence
  Ebola virus siRNA sense strand
ggcgcgaacuucuuccgaccc

SEQ ID NO: 8089 - RNA, 21 nt, Artificial Sequence
  Ebola virus siRNA sense strand
gcgcgaacuucuuccgaccca

SEQ ID NO: 8090 - RNA, 21 nt, Artificial Sequence
  Ebola virus siRNA sense strand
cgcgaacuucuuccgacccag

SEQ ID NO: 8091 - RNA, 21 nt, Artificial Sequence
  Ebola virus siRNA sense strand
gcgaacuucuuccgacccagg

SEQ ID NO: 8092 - RNA, 21 nt, Artificial Sequence
  Ebola virus siRNA sense strand
cgaacuucuuccgacccaggg

SEQ ID NO: 8093 - RNA, 21 nt, Artificial Sequence
  Ebola virus siRNA sense strand
gaacuucuuccgacccaggga

SEQ ID NO: 8094 - RNA, 21 nt, Artificial Sequence
  Ebola virus siRNA sense strand
aacuucuuccgacccagggac

SEQ ID NO: 8095 - RNA, 21 nt, Artificial Sequence
  Ebola virus siRNA sense strand
acuucuuccgacccagggacc

SEQ ID NO: 8096 - RNA, 21 nt, Artificial Sequence
  Ebola virus siRNA sense strand
cuucuuccgacccagggacca

SEQ ID NO: 8097 - RNA, 21 nt, Artificial Sequence
  Ebola virus siRNA sense strand
uucuuccgacccagggaccaa

SEQ ID NO: 8098 - RNA, 21 nt, Artificial Sequence
  Ebola virus siRNA sense strand
ucuuccgacccagggaccaac

SEQ ID NO: 8099 - RNA, 21 nt, Artificial Sequence
  Ebola virus siRNA sense strand
cuuccgacccagggaccaaca

SEQ ID NO: 8100 - RNA, 21 nt, Artificial Sequence
  Ebola virus siRNA sense strand
uuccgacccagggaccaacac

SEQ ID NO: 8101 - RNA, 21 nt, Artificial Sequence
  Ebola virus siRNA sense strand
uccgacccagggaccaacaca

SEQ ID NO: 8102 - RNA, 21 nt, Artificial Sequence
  Ebola virus siRNA sense strand
ccgacccagggaccaacacaa

SEQ ID NO: 8103 - RNA, 21 nt, Artificial Sequence
  Ebola virus siRNA sense strand
cgacccagggaccaacacaac

SEQ ID NO: 8104 - RNA, 21 nt, Artificial Sequence
  Ebola virus siRNA sense strand
gacccagggaccaacacaaca

SEQ ID NO: 8105 - RNA, 21 nt, Artificial Sequence
  Ebola virus siRNA sense strand
acccagggaccaacacaacaa

SEQ ID NO: 8106 - RNA, 21 nt, Artificial Sequence
  Ebola virus siRNA sense strand
cccagggaccaacacaacaac

SEQ ID NO: 8107 - RNA, 21 nt, Artificial Sequence
  Ebola virus siRNA sense strand
ccagggaccaacacaacaacu

SEQ ID NO: 8108 - RNA, 21 nt, Artificial Sequence
  Ebola virus siRNA sense strand
cagggaccaacacaacaacug

SEQ ID NO: 8109 - RNA, 21 nt, Artificial Sequence
  Ebola virus siRNA sense strand
agggaccaacacaacaacuga

SEQ ID NO: 8110 - RNA, 21 nt, Artificial Sequence
  Ebola virus siRNA sense strand
gggaccaacacaacaacugaa

SEQ ID NO: 8111 - RNA, 21 nt, Artificial Sequence
  Ebola virus siRNA sense strand
ggaccaacacaacaacugaag

SEQ ID NO: 8112 - RNA, 21 nt, Artificial Sequence
  Ebola virus siRNA sense strand
gaccaacacaacaacugaaga

SEQ ID NO: 8113 - RNA, 21 nt, Artificial Sequence
  Ebola virus siRNA sense strand
accaacacaacaacugaagac

SEQ ID NO: 8114 - RNA, 21 nt, Artificial Sequence
  Ebola virus siRNA sense strand
ccaacacaacaacugaagacc

SEQ ID NO: 8115 - RNA, 21 nt, Artificial Sequence
  Ebola virus siRNA sense strand
caacacaacaacugaagacca

SEQ ID NO: 8116 - RNA, 21 nt, Artificial Sequence
  Ebola virus siRNA sense strand
aacacaacaacugaagaccac

SEQ ID NO: 8117 - RNA, 21 nt, Artificial Sequence
  Ebola virus siRNA sense strand
acacaacaacugaagaccaca

SEQ ID NO: 8118 - RNA, 21 nt, Artificial Sequence
  Ebola virus siRNA sense strand
cacaacaacugaagaccacaa

SEQ ID NO: 8119 - RNA, 21 nt, Artificial Sequence
  Ebola virus siRNA sense strand
acaacaacugaagaccacaaa

SEQ ID NO: 8120 - RNA, 21 nt, Artificial Sequence
  Ebola virus siRNA sense strand
caacaacugaagaccacaaaa

SEQ ID NO: 8121 - RNA, 21 nt, Artificial Sequence
  Ebola virus siRNA sense strand
aacaacugaagaccacaaaau

SEQ ID NO: 8122 - RNA, 21 nt, Artificial Sequence
  Ebola virus siRNA sense strand
acaacugaagaccacaaaauc

SEQ ID NO: 8123 - RNA, 21 nt, Artificial Sequence
  Ebola virus siRNA sense strand
caacugaagaccacaaaauca

SEQ ID NO: 8124 - RNA, 21 nt, Artificial Sequence
  Ebola virus siRNA sense strand
aacugaagaccacaaaaucau

SEQ ID NO: 8125 - RNA, 21 nt, Artificial Sequence
  Ebola virus siRNA sense strand
acugaagaccacaaaaucaug

SEQ ID NO: 8126 - RNA, 21 nt, Artificial Sequence
  Ebola virus siRNA sense strand
cugaagaccacaaaaucaugg

SEQ ID NO: 8127 - RNA, 21 nt, Artificial Sequence
  Ebola virus siRNA sense strand
ugaagaccacaaaaucauggc

SEQ ID NO: 8128 - RNA, 21 nt, Artificial Sequence
  Ebola virus siRNA sense strand
gaagaccacaaaaucauggcu

SEQ ID NO: 8129 - RNA, 21 nt, Artificial Sequence
  Ebola virus siRNA sense strand
aagaccacaaaaucauggcuu

SEQ ID NO: 8130 - RNA, 21 nt, Artificial Sequence
  Ebola virus siRNA sense strand
agaccacaaaaucauggcuuc

SEQ ID NO: 8131 - RNA, 21 nt, Artificial Sequence
  Ebola virus siRNA sense strand
gaccacaaaaucauggcuuca

SEQ ID NO: 8132 - RNA, 21 nt, Artificial Sequence
  Ebola virus siRNA sense strand
accacaaaaucauggcuucag

SEQ ID NO: 8133 - RNA, 21 nt, Artificial Sequence
  Ebola virus siRNA sense strand
ccacaaaaucauggcuucaga

SEQ ID NO: 8134 - RNA, 21 nt, Artificial Sequence
  Ebola virus siRNA sense strand
cacaaaaucauggcuucagaa

SEQ ID NO: 8135 - RNA, 21 nt, Artificial Sequence
  Ebola virus siRNA sense strand
acaaaaucauggcuucagaaa

SEQ ID NO: 8136 - RNA, 21 nt, Artificial Sequence
  Ebola virus siRNA sense strand
caaaaucauggcuucagaaaa

SEQ ID NO: 8137 - RNA, 21 nt, Artificial Sequence
  Ebola virus siRNA sense strand
aaaaucauggcuucagaaaau

SEQ ID NO: 8138 - RNA, 21 nt, Artificial Sequence
  Ebola virus siRNA sense strand
aaaucauggcuucagaaaauu

SEQ ID NO: 8139 - RNA, 21 nt, Artificial Sequence
  Ebola virus siRNA sense strand
aaucauggcuucagaaaauuc

SEQ ID NO: 8140 - RNA, 21 nt, Artificial Sequence
  Ebola virus siRNA sense strand
aucauggcuucagaaaauucc

SEQ ID NO: 8141 - RNA, 21 nt, Artificial Sequence
  Ebola virus siRNA sense strand
ucauggcuucagaaaauuccu

SEQ ID NO: 8142 - RNA, 21 nt, Artificial Sequence
  Ebola virus siRNA sense strand
cauggcuucagaaaauuccuc

SEQ ID NO: 8143 - RNA, 21 nt, Artificial Sequence
  Ebola virus siRNA sense strand
auggcuucagaaaauuccucu

SEQ ID NO: 8144 - RNA, 21 nt, Artificial Sequence
  Ebola virus siRNA sense strand
uggcuucagaaaauuccucug

SEQ ID NO: 8145 - RNA, 21 nt, Artificial Sequence
  Ebola virus siRNA sense strand
ggcuucagaaaauuccucugc

SEQ ID NO: 8146 - RNA, 21 nt, Artificial Sequence
  Ebola virus siRNA sense strand
gcuucagaaaauuccucugca

SEQ ID NO: 8147 - RNA, 21 nt, Artificial Sequence
  Ebola virus siRNA sense strand
cuucagaaaauuccucugcaa

SEQ ID NO: 8148 - RNA, 21 nt, Artificial Sequence
  Ebola virus siRNA sense strand
uucagaaaauuccucugcaau

SEQ ID NO: 8149 - RNA, 21 nt, Artificial Sequence
  Ebola virus siRNA sense strand
ucagaaaauuccucugcaaug

SEQ ID NO: 8150 - RNA, 21 nt, Artificial Sequence
  Ebola virus siRNA sense strand
cagaaaauuccucugcaaugg

SEQ ID NO: 8151 - RNA, 21 nt, Artificial Sequence
  Ebola virus siRNA sense strand
agaaaauuccucugcaauggu

SEQ ID NO: 8152 - RNA, 21 nt, Artificial Sequence
  Ebola virus siRNA sense strand
gaaaauuccucugcaaugguu

SEQ ID NO: 8153 - RNA, 21 nt, Artificial Sequence
  Ebola virus siRNA sense strand
aaaauuccucugcaaugguuc

SEQ ID NO: 8154 - RNA, 21 nt, Artificial Sequence
  Ebola virus siRNA sense strand
aaauuccucugcaaugguuca

SEQ ID NO: 8155 - RNA, 21 nt, Artificial Sequence
  Ebola virus siRNA sense strand
aauuccucugcaaugguucaa

SEQ ID NO: 8156 - RNA, 21 nt, Artificial Sequence
  Ebola virus siRNA sense strand
auuccucugcaaugguucaag

SEQ ID NO: 8157 - RNA, 21 nt, Artificial Sequence
  Ebola virus siRNA sense strand
uuccucugcaaugguucaagu

SEQ ID NO: 8158 - RNA, 21 nt, Artificial Sequence
  Ebola virus siRNA sense strand
uccucugcaaugguucaagug

SEQ ID NO: 8159 - RNA, 21 nt, Artificial Sequence
  Ebola virus siRNA sense strand
ccucugcaaugguucaagugc

SEQ ID NO: 8160 - RNA, 21 nt, Artificial Sequence
  Ebola virus siRNA sense strand
cucugcaaugguucaagugca

SEQ ID NO: 8161 - RNA, 21 nt, Artificial Sequence
  Ebola virus siRNA sense strand
ucugcaaugguucaagugcac

SEQ ID NO: 8162 - RNA, 21 nt, Artificial Sequence
  Ebola virus siRNA sense strand
cugcaaugguucaagugcaca

SEQ ID NO: 8163 - RNA, 21 nt, Artificial Sequence
  Ebola virus siRNA sense strand
ugcaaugguucaagugcacag

SEQ ID NO: 8164 - RNA, 21 nt, Artificial Sequence
  Ebola virus siRNA sense strand
gcaaugguucaagugcacagu

SEQ ID NO: 8165 - RNA, 21 nt, Artificial Sequence
  Ebola virus siRNA sense strand
caaugguucaagugcacaguc

SEQ ID NO: 8166 - RNA, 21 nt, Artificial Sequence
  Ebola virus siRNA sense strand
aaugguucaagugcacaguca

SEQ ID NO: 8167 - RNA, 21 nt, Artificial Sequence
  Ebola virus siRNA sense strand
augguucaagugcacagucaa

SEQ ID NO: 8168 - RNA, 21 nt, Artificial Sequence
  Ebola virus siRNA sense strand
ugguucaagugcacagucaag

SEQ ID NO: 8169 - RNA, 21 nt, Artificial Sequence
  Ebola virus siRNA sense strand
gguucaagugcacagucaagg

SEQ ID NO: 8170 - RNA, 21 nt, Artificial Sequence
  Ebola virus siRNA sense strand
guucaagugcacagucaagga

SEQ ID NO: 8171 - RNA, 21 nt, Artificial Sequence
  Ebola virus siRNA sense strand
uucaagugcacagucaaggaa

SEQ ID NO: 8172 - RNA, 21 nt, Artificial Sequence
  Ebola virus siRNA sense strand
ucaagugcacagucaaggaag

SEQ ID NO: 8173 - RNA, 21 nt, Artificial Sequence
  Ebola virus siRNA sense strand
caagugcacagucaaggaagg

SEQ ID NO: 8174 - RNA, 21 nt, Artificial Sequence
  Ebola virus siRNA sense strand
aagugcacagucaaggaaggg

SEQ ID NO: 8175 - RNA, 21 nt, Artificial Sequence
  Ebola virus siRNA sense strand
agugcacagucaaggaaggga

SEQ ID NO: 8176 - RNA, 21 nt, Artificial Sequence
  Ebola virus siRNA sense strand
gugcacagucaaggaagggaa

SEQ ID NO: 8177 - RNA, 21 nt, Artificial Sequence
  Ebola virus siRNA sense strand
ugcacagucaaggaagggaag

SEQ ID NO: 8178 - RNA, 21 nt, Artificial Sequence
  Ebola virus siRNA sense strand
gcacagucaaggaagggaagc

SEQ ID NO: 8179 - RNA, 21 nt, Artificial Sequence
  Ebola virus siRNA sense strand
cacagucaaggaagggaagcu

SEQ ID NO: 8180 - RNA, 21 nt, Artificial Sequence
  Ebola virus siRNA sense strand
acagucaaggaagggaagcug

SEQ ID NO: 8181 - RNA, 21 nt, Artificial Sequence
  Ebola virus siRNA sense strand
cagucaaggaagggaagcugc

SEQ ID NO: 8182 - RNA, 21 nt, Artificial Sequence
  Ebola virus siRNA sense strand
agucaaggaagggaagcugca

SEQ ID NO: 8183 - RNA, 21 nt, Artificial Sequence
  Ebola virus siRNA sense strand
gucaaggaagggaagcugcag

SEQ ID NO: 8184 - RNA, 21 nt, Artificial Sequence
  Ebola virus siRNA sense strand
ucaaggaagggaagcugcagu

SEQ ID NO: 8185 - RNA, 21 nt, Artificial Sequence
  Ebola virus siRNA sense strand
caaggaagggaagcugcagug

SEQ ID NO: 8186 - RNA, 21 nt, Artificial Sequence
  Ebola virus siRNA sense strand
aaggaagggaagcugcagugu

SEQ ID NO: 8187 - RNA, 21 nt, Artificial Sequence
  Ebola virus siRNA sense strand
aggaagggaagcugcaguguc

SEQ ID NO: 8188 - RNA, 21 nt, Artificial Sequence
  Ebola virus siRNA sense strand
ggaagggaagcugcagugucg

SEQ ID NO: 8189 - RNA, 21 nt, Artificial Sequence
  Ebola virus siRNA sense strand
gaagggaagcugcagugucgc

SEQ ID NO: 8190 - RNA, 21 nt, Artificial Sequence
  Ebola virus siRNA sense strand
aagggaagcugcagugucgca

SEQ ID NO: 8191 - RNA, 21 nt, Artificial Sequence
  Ebola virus siRNA sense strand
agggaagcugcagugucgcau

SEQ ID NO: 8192 - RNA, 21 nt, Artificial Sequence
  Ebola virus siRNA sense strand
gggaagcugcagugucgcauc

SEQ ID NO: 8193 - RNA, 21 nt, Artificial Sequence
  Ebola virus siRNA sense strand
ggaagcugcagugucgcaucu

SEQ ID NO: 8194 - RNA, 21 nt, Artificial Sequence
  Ebola virus siRNA sense strand
gaagcugcagugucgcaucua

SEQ ID NO: 8195 - RNA, 21 nt, Artificial Sequence
  Ebola virus siRNA sense strand
aagcugcagugucgcaucuaa

SEQ ID NO: 8196 - RNA, 21 nt, Artificial Sequence
  Ebola virus siRNA sense strand
agcugcagugucgcaucuaac

SEQ ID NO: 8197 - RNA, 21 nt, Artificial Sequence
  Ebola virus siRNA sense strand
gcugcagugucgcaucuaaca

SEQ ID NO: 8198 - RNA, 21 nt, Artificial Sequence
  Ebola virus siRNA sense strand
cugcagugucgcaucuaacaa

SEQ ID NO: 8199 - RNA, 21 nt, Artificial Sequence
  Ebola virus siRNA sense strand
ugcagugucgcaucuaacaac

SEQ ID NO: 8200 - RNA, 21 nt, Artificial Sequence
  Ebola virus siRNA sense strand
gcagugucgcaucuaacaacc

SEQ ID NO: 8201 - RNA, 21 nt, Artificial Sequence
  Ebola virus siRNA sense strand
cagugucgcaucuaacaaccc

SEQ ID NO: 8202 - RNA, 21 nt, Artificial Sequence
  Ebola virus siRNA sense strand
agugucgcaucuaacaacccu

SEQ ID NO: 8203 - RNA, 21 nt, Artificial Sequence
  Ebola virus siRNA sense strand
gugucgcaucuaacaacccuu

SEQ ID NO: 8204 - RNA, 21 nt, Artificial Sequence
  Ebola virus siRNA sense strand
ugucgcaucuaacaacccuug

SEQ ID NO: 8205 - RNA, 21 nt, Artificial Sequence
  Ebola virus siRNA sense strand
gucgcaucuaacaacccuugc

SEQ ID NO: 8206 - RNA, 21 nt, Artificial Sequence
  Ebola virus siRNA sense strand
ucgcaucuaacaacccuugcc

SEQ ID NO: 8207 - RNA, 21 nt, Artificial Sequence
  Ebola virus siRNA sense strand
cgcaucuaacaacccuugcca

SEQ ID NO: 8208 - RNA, 21 nt, Artificial Sequence
  Ebola virus siRNA sense strand
gcaucuaacaacccuugccac

SEQ ID NO: 8209 - RNA, 21 nt, Artificial Sequence
  Ebola virus siRNA sense strand
caucuaacaacccuugccaca

SEQ ID NO: 8210 - RNA, 21 nt, Artificial Sequence
  Ebola virus siRNA sense strand
aucuaacaacccuugccacaa

SEQ ID NO: 8211 - RNA, 21 nt, Artificial Sequence
  Ebola virus siRNA sense strand
ucuaacaacccuugccacaau

SEQ ID NO: 8212 - RNA, 21 nt, Artificial Sequence
  Ebola virus siRNA sense strand
cuaacaacccuugccacaauc

SEQ ID NO: 8213 - RNA, 21 nt, Artificial Sequence
  Ebola virus siRNA sense strand
uaacaacccuugccacaaucu

SEQ ID NO: 8214 - RNA, 21 nt, Artificial Sequence
  Ebola virus siRNA sense strand
aacaacccuugccacaaucuc

SEQ ID NO: 8215 - RNA, 21 nt, Artificial Sequence
  Ebola virus siRNA sense strand
acaacccuugccacaaucucc

SEQ ID NO: 8216 - RNA, 21 nt, Artificial Sequence
  Ebola virus siRNA sense strand
caacccuugccacaaucucca

SEQ ID NO: 8217 - RNA, 21 nt, Artificial Sequence
  Ebola virus siRNA sense strand
aacccuugccacaaucuccac

SEQ ID NO: 8218 - RNA, 21 nt, Artificial Sequence
  Ebola virus siRNA sense strand
acccuugccacaaucuccacg

SEQ ID NO: 8219 - RNA, 21 nt, Artificial Sequence
  Ebola virus siRNA sense strand
cccuugccacaaucuccacga

SEQ ID NO: 8220 - RNA, 21 nt, Artificial Sequence
  Ebola virus siRNA sense strand
ccuugccacaaucuccacgag

SEQ ID NO: 8221 - RNA, 21 nt, Artificial Sequence
  Ebola virus siRNA sense strand
cuugccacaaucuccacgagu

SEQ ID NO: 8222 - RNA, 21 nt, Artificial Sequence
  Ebola virus siRNA sense strand
uugccacaaucuccacgaguc

SEQ ID NO: 8223 - RNA, 21 nt, Artificial Sequence
  Ebola virus siRNA sense strand
ugccacaaucuccacgagucc

SEQ ID NO: 8224 - RNA, 21 nt, Artificial Sequence
  Ebola virus siRNA sense strand
gccacaaucuccacgaguccc

SEQ ID NO: 8225 - RNA, 21 nt, Artificial Sequence
  Ebola virus siRNA sense strand
ccacaaucuccacgagucccc

SEQ ID NO: 8226 - RNA, 21 nt, Artificial Sequence
  Ebola virus siRNA sense strand
cacaaucuccacgagucccca

SEQ ID NO: 8227 - RNA, 21 nt, Artificial Sequence
  Ebola virus siRNA sense strand
acaaucuccacgaguccccaa

SEQ ID NO: 8228 - RNA, 21 nt, Artificial Sequence
  Ebola virus siRNA sense strand
caaucuccacgaguccccaau

SEQ ID NO: 8229 - RNA, 21 nt, Artificial Sequence
  Ebola virus siRNA sense strand
aaucuccacgaguccccaauc

SEQ ID NO: 8230 - RNA, 21 nt, Artificial Sequence
  Ebola virus siRNA sense strand
aucuccacgaguccccaaucc

SEQ ID NO: 8231 - RNA, 21 nt, Artificial Sequence
  Ebola virus siRNA sense strand
ucuccacgaguccccaauccc

SEQ ID NO: 8232 - RNA, 21 nt, Artificial Sequence
  Ebola virus siRNA sense strand
cuccacgaguccccaaucccu

SEQ ID NO: 8233 - RNA, 21 nt, Artificial Sequence
  Ebola virus siRNA sense strand
uccacgaguccccaaucccuc

SEQ ID NO: 8234 - RNA, 21 nt, Artificial Sequence
  Ebola virus siRNA sense strand
ccacgaguccccaaucccuca

SEQ ID NO: 8235 - RNA, 21 nt, Artificial Sequence
  Ebola virus siRNA sense strand
cacgaguccccaaucccucac

SEQ ID NO: 8236 - RNA, 21 nt, Artificial Sequence
  Ebola virus siRNA sense strand
acgaguccccaaucccucaca

SEQ ID NO: 8237 - RNA, 21 nt, Artificial Sequence
  Ebola virus siRNA sense strand
cgaguccccaaucccucacaa

SEQ ID NO: 8238 - RNA, 21 nt, Artificial Sequence
  Ebola virus siRNA sense strand
gaguccccaaucccucacaac

SEQ ID NO: 8239 - RNA, 21 nt, Artificial Sequence
  Ebola virus siRNA sense strand
aguccccaaucccucacaacc

SEQ ID NO: 8240 - RNA, 21 nt, Artificial Sequence
  Ebola virus siRNA sense strand
guccccaaucccucacaacca

SEQ ID NO: 8241 - RNA, 21 nt, Artificial Sequence
  Ebola virus siRNA sense strand
uccccaaucccucacaaccaa

SEQ ID NO: 8242 - RNA, 21 nt, Artificial Sequence
  Ebola virus siRNA sense strand
ccccaaucccucacaaccaaa

SEQ ID NO: 8243 - RNA, 21 nt, Artificial Sequence
  Ebola virus siRNA sense strand
cccaaucccucacaaccaaac

SEQ ID NO: 8244 - RNA, 21 nt, Artificial Sequence
  Ebola virus siRNA sense strand
ccaaucccucacaaccaaacc

SEQ ID NO: 8245 - RNA, 21 nt, Artificial Sequence
  Ebola virus siRNA sense strand
caaucccucacaaccaaacca

SEQ ID NO: 8246 - RNA, 21 nt, Artificial Sequence
  Ebola virus siRNA sense strand
aaucccucacaaccaaaccag

SEQ ID NO: 8247 - RNA, 21 nt, Artificial Sequence
  Ebola virus siRNA sense strand
aucccucacaaccaaaccagg

SEQ ID NO: 8248 - RNA, 21 nt, Artificial Sequence
  Ebola virus siRNA sense strand
ucccucacaaccaaaccaggu

SEQ ID NO: 8249 - RNA, 21 nt, Artificial Sequence
  Ebola virus siRNA sense strand
cccucacaaccaaaccagguc

SEQ ID NO: 8250 - RNA, 21 nt, Artificial Sequence
  Ebola virus siRNA sense strand
ccucacaaccaaaccaggucc

SEQ ID NO: 8251 - RNA, 21 nt, Artificial Sequence
  Ebola virus siRNA sense strand
cucacaaccaaaccagguccg

SEQ ID NO: 8252 - RNA, 21 nt, Artificial Sequence
  Ebola virus siRNA sense strand
ucacaaccaaaccagguccgg

SEQ ID NO: 8253 - RNA, 21 nt, Artificial Sequence
  Ebola virus siRNA sense strand
cacaaccaaaccagguccgga

SEQ ID NO: 8254 - RNA, 21 nt, Artificial Sequence
  Ebola virus siRNA sense strand
acaaccaaaccagguccggac

SEQ ID NO: 8255 - RNA, 21 nt, Artificial Sequence
  Ebola virus siRNA sense strand
caaccaaaccagguccggaca

SEQ ID NO: 8256 - RNA, 21 nt, Artificial Sequence
  Ebola virus siRNA sense strand
aaccaaaccagguccggacaa

SEQ ID NO: 8257 - RNA, 21 nt, Artificial Sequence
  Ebola virus siRNA sense strand
accaaaccagguccggacaac

SEQ ID NO: 8258 - RNA, 21 nt, Artificial Sequence
  Ebola virus siRNA sense strand
ccaaaccagguccggacaaca

SEQ ID NO: 8259 - RNA, 21 nt, Artificial Sequence
  Ebola virus siRNA sense strand
caaaccagguccggacaacag

SEQ ID NO: 8260 - RNA, 21 nt, Artificial Sequence
  Ebola virus siRNA sense strand
aaaccagguccggacaacagc

SEQ ID NO: 8261 - RNA, 21 nt, Artificial Sequence
  Ebola virus siRNA sense strand
aaccagguccggacaacagca

SEQ ID NO: 8262 - RNA, 21 nt, Artificial Sequence
  Ebola virus siRNA sense strand
accagguccggacaacagcac

SEQ ID NO: 8263 - RNA, 21 nt, Artificial Sequence
  Ebola virus siRNA sense strand
ccagguccggacaacagcacc

SEQ ID NO: 8264 - RNA, 21 nt, Artificial Sequence
  Ebola virus siRNA sense strand
cagguccggacaacagcaccc

SEQ ID NO: 8265 - RNA, 21 nt, Artificial Sequence
  Ebola virus siRNA sense strand
agguccggacaacagcaccca

SEQ ID NO: 8266 - RNA, 21 nt, Artificial Sequence
  Ebola virus siRNA sense strand
gguccggacaacagcacccau

SEQ ID NO: 8267 - RNA, 21 nt, Artificial Sequence
  Ebola virus siRNA sense strand
guccggacaacagcacccaua

SEQ ID NO: 8268 - RNA, 21 nt, Artificial Sequence
  Ebola virus siRNA sense strand
uccggacaacagcacccauaa

SEQ ID NO: 8269 - RNA, 21 nt, Artificial Sequence
  Ebola virus siRNA sense strand
ccggacaacagcacccauaau

SEQ ID NO: 8270 - RNA, 21 nt, Artificial Sequence
  Ebola virus siRNA sense strand
cggacaacagcacccauaaua

SEQ ID NO: 8271 - RNA, 21 nt, Artificial Sequence
  Ebola virus siRNA sense strand
ggacaacagcacccauaauac

SEQ ID NO: 8272 - RNA, 21 nt, Artificial Sequence
  Ebola virus siRNA sense strand
gacaacagcacccauaauaca

SEQ ID NO: 8273 - RNA, 21 nt, Artificial Sequence
  Ebola virus siRNA sense strand
acaacagcacccauaauacac

SEQ ID NO: 8274 - RNA, 21 nt, Artificial Sequence
  Ebola virus siRNA sense strand
caacagcacccauaauacacc

SEQ ID NO: 8275 - RNA, 21 nt, Artificial Sequence
  Ebola virus siRNA sense strand
aacagcacccauaauacaccc

SEQ ID NO: 8276 - RNA, 21 nt, Artificial Sequence
  Ebola virus siRNA sense strand
acagcacccauaauacacccg

SEQ ID NO: 8277 - RNA, 21 nt, Artificial Sequence
  Ebola virus siRNA sense strand
cagcacccauaauacacccgu

SEQ ID NO: 8278 - RNA, 21 nt, Artificial Sequence
  Ebola virus siRNA sense strand
agcacccauaauacacccgug

SEQ ID NO: 8279 - RNA, 21 nt, Artificial Sequence
  Ebola virus siRNA sense strand
gcacccauaauacacccgugu

SEQ ID NO: 8280 - RNA, 21 nt, Artificial Sequence
  Ebola virus siRNA sense strand
cacccauaauacacccgugua

SEQ ID NO: 8281 - RNA, 21 nt, Artificial Sequence
  Ebola virus siRNA sense strand
acccauaauacacccguguau

SEQ ID NO: 8282 - RNA, 21 nt, Artificial Sequence
  Ebola virus siRNA sense strand
cccauaauacacccguguaua

SEQ ID NO: 8283 - RNA, 21 nt, Artificial Sequence
  Ebola virus siRNA sense strand
ccauaauacacccguguauaa

SEQ ID NO: 8284 - RNA, 21 nt, Artificial Sequence
  Ebola virus siRNA sense strand
cauaauacacccguguauaaa

SEQ ID NO: 8285 - RNA, 21 nt, Artificial Sequence
  Ebola virus siRNA sense strand
auaauacacccguguauaaac

SEQ ID NO: 8286 - RNA, 21 nt, Artificial Sequence
  Ebola virus siRNA sense strand
uaauacacccguguauaaacu

SEQ ID NO: 8287 - RNA, 21 nt, Artificial Sequence
  Ebola virus siRNA sense strand
aauacacccguguauaaacuu

SEQ ID NO: 8288 - RNA, 21 nt, Artificial Sequence
  Ebola virus siRNA sense strand
auacacccguguauaaacuug

SEQ ID NO: 8289 - RNA, 21 nt, Artificial Sequence
  Ebola virus siRNA sense strand
uacacccguguauaaacuuga

SEQ ID NO: 8290 - RNA, 21 nt, Artificial Sequence
  Ebola virus siRNA sense strand
acacccguguauaaacuugac

SEQ ID NO: 8291 - RNA, 21 nt, Artificial Sequence
  Ebola virus siRNA sense strand
cacccguguauaaacuugaca

SEQ ID NO: 8292 - RNA, 21 nt, Artificial Sequence
  Ebola virus siRNA sense strand
acccguguauaaacuugacau

SEQ ID NO: 8293 - RNA, 21 nt, Artificial Sequence
  Ebola virus siRNA sense strand
cccguguauaaacuugacauc

SEQ ID NO: 8294 - RNA, 21 nt, Artificial Sequence
  Ebola virus siRNA sense strand
ccguguauaaacuugacaucu

SEQ ID NO: 8295 - RNA, 21 nt, Artificial Sequence
  Ebola virus siRNA sense strand
cguguauaaacuugacaucuc

SEQ ID NO: 8296 - RNA, 21 nt, Artificial Sequence
  Ebola virus siRNA sense strand
guguauaaacuugacaucucu

SEQ ID NO: 8297 - RNA, 21 nt, Artificial Sequence
  Ebola virus siRNA sense strand
uguauaaacuugacaucucug

SEQ ID NO: 8298 - RNA, 21 nt, Artificial Sequence
  Ebola virus siRNA sense strand
guauaaacuugacaucucuga

SEQ ID NO: 8299 - RNA, 21 nt, Artificial Sequence
  Ebola virus siRNA sense strand
uauaaacuugacaucucugag

SEQ ID NO: 8300 - RNA, 21 nt, Artificial Sequence
  Ebola virus siRNA sense strand
auaaacuugacaucucugagg

SEQ ID NO: 8301 - RNA, 21 nt, Artificial Sequence
  Ebola virus siRNA sense strand
uaaacuugacaucucugaggc

SEQ ID NO: 8302 - RNA, 21 nt, Artificial Sequence
  Ebola virus siRNA sense strand
aaacuugacaucucugaggca

SEQ ID NO: 8303 - RNA, 21 nt, Artificial Sequence
  Ebola virus siRNA sense strand
aacuugacaucucugaggcaa

SEQ ID NO: 8304 - RNA, 21 nt, Artificial Sequence
  Ebola virus siRNA sense strand
acuugacaucucugaggcaac

SEQ ID NO: 8305 - RNA, 21 nt, Artificial Sequence
  Ebola virus siRNA sense strand
cuugacaucucugaggcaacu

SEQ ID NO: 8306 - RNA, 21 nt, Artificial Sequence
  Ebola virus siRNA sense strand
uugacaucucugaggcaacuc

SEQ ID NO: 8307 - RNA, 21 nt, Artificial Sequence
  Ebola virus siRNA sense strand
ugacaucucugaggcaacuca

SEQ ID NO: 8308 - RNA, 21 nt, Artificial Sequence
  Ebola virus siRNA sense strand
gacaucucugaggcaacucaa

SEQ ID NO: 8309 - RNA, 21 nt, Artificial Sequence
  Ebola virus siRNA sense strand
acaucucugaggcaacucaag

SEQ ID NO: 8310 - RNA, 21 nt, Artificial Sequence
  Ebola virus siRNA sense strand
caucucugaggcaacucaagu

SEQ ID NO: 8311 - RNA, 21 nt, Artificial Sequence
  Ebola virus siRNA sense strand
aucucugaggcaacucaaguu

SEQ ID NO: 8312 - RNA, 21 nt, Artificial Sequence
  Ebola virus siRNA sense strand
ucucugaggcaacucaaguug

SEQ ID NO: 8313 - RNA, 21 nt, Artificial Sequence
  Ebola virus siRNA sense strand
cucugaggcaacucaaguuga

SEQ ID NO: 8314 - RNA, 21 nt, Artificial Sequence
  Ebola virus siRNA sense strand
ucugaggcaacucaaguugaa

SEQ ID NO: 8315 - RNA, 21 nt, Artificial Sequence
  Ebola virus siRNA sense strand
cugaggcaacucaaguugaac

SEQ ID NO: 8316 - RNA, 21 nt, Artificial Sequence
  Ebola virus siRNA sense strand
ugaggcaacucaaguugaaca

SEQ ID NO: 8317 - RNA, 21 nt, Artificial Sequence
  Ebola virus siRNA sense strand
gaggcaacucaaguugaacaa

SEQ ID NO: 8318 - RNA, 21 nt, Artificial Sequence
  Ebola virus siRNA sense strand
aggcaacucaaguugaacaac

SEQ ID NO: 8319 - RNA, 21 nt, Artificial Sequence
  Ebola virus siRNA sense strand
ggcaacucaaguugaacaaca

SEQ ID NO: 8320 - RNA, 21 nt, Artificial Sequence
  Ebola virus siRNA sense strand
gcaacucaaguugaacaacau

SEQ ID NO: 8321 - RNA, 21 nt, Artificial Sequence
  Ebola virus siRNA sense strand
caacucaaguugaacaacauc

SEQ ID NO: 8322 - RNA, 21 nt, Artificial Sequence
  Ebola virus siRNA sense strand
aacucaaguugaacaacauca

SEQ ID NO: 8323 - RNA, 21 nt, Artificial Sequence
  Ebola virus siRNA sense strand
acucaaguugaacaacaucac

SEQ ID NO: 8324 - RNA, 21 nt, Artificial Sequence
  Ebola virus siRNA sense strand
cucaaguugaacaacaucacc

SEQ ID NO: 8325 - RNA, 21 nt, Artificial Sequence
  Ebola virus siRNA sense strand
ucaaguugaacaacaucaccg

SEQ ID NO: 8326 - RNA, 21 nt, Artificial Sequence
  Ebola virus siRNA sense strand
caaguugaacaacaucaccgc

SEQ ID NO: 8327 - RNA, 21 nt, Artificial Sequence
  Ebola virus siRNA sense strand
aaguugaacaacaucaccgca

SEQ ID NO: 8328 - RNA, 21 nt, Artificial Sequence
  Ebola virus siRNA sense strand
aguugaacaacaucaccgcag

SEQ ID NO: 8329 - RNA, 21 nt, Artificial Sequence
  Ebola virus siRNA sense strand
guugaacaacaucaccgcaga

SEQ ID NO: 8330 - RNA, 21 nt, Artificial Sequence
  Ebola virus siRNA sense strand
uugaacaacaucaccgcagaa

SEQ ID NO: 8331 - RNA, 21 nt, Artificial Sequence
  Ebola virus siRNA sense strand
ugaacaacaucaccgcagaac

SEQ ID NO: 8332 - RNA, 21 nt, Artificial Sequence
  Ebola virus siRNA sense strand
gaacaacaucaccgcagaaca

SEQ ID NO: 8333 - RNA, 21 nt, Artificial Sequence
  Ebola virus siRNA sense strand
aacaacaucaccgcagaacag

SEQ ID NO: 8334 - RNA, 21 nt, Artificial Sequence
  Ebola virus siRNA sense strand
acaacaucaccgcagaacaga

SEQ ID NO: 8335 - RNA, 21 nt, Artificial Sequence
  Ebola virus siRNA sense strand
caacaucaccgcagaacagac

SEQ ID NO: 8336 - RNA, 21 nt, Artificial Sequence
  Ebola virus siRNA sense strand
aacaucaccgcagaacagaca

SEQ ID NO: 8337 - RNA, 21 nt, Artificial Sequence
  Ebola virus siRNA sense strand
acaucaccgcagaacagacaa

SEQ ID NO: 8338 - RNA, 21 nt, Artificial Sequence
  Ebola virus siRNA sense strand
caucaccgcagaacagacaac

SEQ ID NO: 8339 - RNA, 21 nt, Artificial Sequence
  Ebola virus siRNA sense strand
aucaccgcagaacagacaacg

SEQ ID NO: 8340 - RNA, 21 nt, Artificial Sequence
  Ebola virus siRNA sense strand
ucaccgcagaacagacaacga

SEQ ID NO: 8341 - RNA, 21 nt, Artificial Sequence
  Ebola virus siRNA sense strand
caccgcagaacagacaacgac

SEQ ID NO: 8342 - RNA, 21 nt, Artificial Sequence
  Ebola virus siRNA sense strand
accgcagaacagacaacgaca

SEQ ID NO: 8343 - RNA, 21 nt, Artificial Sequence
  Ebola virus siRNA sense strand
ccgcagaacagacaacgacag

SEQ ID NO: 8344 - RNA, 21 nt, Artificial Sequence
  Ebola virus siRNA sense strand
cgcagaacagacaacgacagc

SEQ ID NO: 8345 - RNA, 21 nt, Artificial Sequence
  Ebola virus siRNA sense strand
gcagaacagacaacgacagca

SEQ ID NO: 8346 - RNA, 21 nt, Artificial Sequence
  Ebola virus siRNA sense strand
cagaacagacaacgacagcac

SEQ ID NO: 8347 - RNA, 21 nt, Artificial Sequence
  Ebola virus siRNA sense strand
agaacagacaacgacagcaca

SEQ ID NO: 8348 - RNA, 21 nt, Artificial Sequence
  Ebola virus siRNA sense strand
gaacagacaacgacagcacag

SEQ ID NO: 8349 - RNA, 21 nt, Artificial Sequence
  Ebola virus siRNA sense strand
aacagacaacgacagcacagc

SEQ ID NO: 8350 - RNA, 21 nt, Artificial Sequence
  Ebola virus siRNA sense strand
acagacaacgacagcacagcc

SEQ ID NO: 8351 - RNA, 21 nt, Artificial Sequence
  Ebola virus siRNA sense strand
cagacaacgacagcacagccu

SEQ ID NO: 8352 - RNA, 21 nt, Artificial Sequence
  Ebola virus siRNA sense strand
agacaacgacagcacagccuc

SEQ ID NO: 8353 - RNA, 21 nt, Artificial Sequence
  Ebola virus siRNA sense strand
gacaacgacagcacagccucc

SEQ ID NO: 8354 - RNA, 21 nt, Artificial Sequence
  Ebola virus siRNA sense strand
acaacgacagcacagccuccg

SEQ ID NO: 8355 - RNA, 21 nt, Artificial Sequence
  Ebola virus siRNA sense strand
caacgacagcacagccuccga

SEQ ID NO: 8356 - RNA, 21 nt, Artificial Sequence
  Ebola virus siRNA sense strand
aacgacagcacagccuccgac

SEQ ID NO: 8357 - RNA, 21 nt, Artificial Sequence
  Ebola virus siRNA sense strand
acgacagcacagccuccgaca

SEQ ID NO: 8358 - RNA, 21 nt, Artificial Sequence
  Ebola virus siRNA sense strand
cgacagcacagccuccgacac

SEQ ID NO: 8359 - RNA, 21 nt, Artificial Sequence
  Ebola virus siRNA sense strand
gacagcacagccuccgacacu

SEQ ID NO: 8360 - RNA, 21 nt, Artificial Sequence
  Ebola virus siRNA sense strand
acagcacagccuccgacacuc

SEQ ID NO: 8361 - RNA, 21 nt, Artificial Sequence
  Ebola virus siRNA sense strand
cagcacagccuccgacacucc

SEQ ID NO: 8362 - RNA, 21 nt, Artificial Sequence
  Ebola virus siRNA sense strand
agcacagccuccgacacuccc

SEQ ID NO: 8363 - RNA, 21 nt, Artificial Sequence
  Ebola virus siRNA sense strand
gcacagccuccgacacucccu

SEQ ID NO: 8364 - RNA, 21 nt, Artificial Sequence
  Ebola virus siRNA sense strand
cacagccuccgacacucccuc

SEQ ID NO: 8365 - RNA, 21 nt, Artificial Sequence
  Ebola virus siRNA sense strand
acagccuccgacacucccucu

SEQ ID NO: 8366 - RNA, 21 nt, Artificial Sequence
  Ebola virus siRNA sense strand
cagccuccgacacucccucug

SEQ ID NO: 8367 - RNA, 21 nt, Artificial Sequence
  Ebola virus siRNA sense strand
agccuccgacacucccucugc

SEQ ID NO: 8368 - RNA, 21 nt, Artificial Sequence
  Ebola virus siRNA sense strand
gccuccgacacucccucugcc

SEQ ID NO: 8369 - RNA, 21 nt, Artificial Sequence
  Ebola virus siRNA sense strand
ccuccgacacucccucugcca

SEQ ID NO: 8370 - RNA, 21 nt, Artificial Sequence
  Ebola virus siRNA sense strand
cuccgacacucccucugccac

SEQ ID NO: 8371 - RNA, 21 nt, Artificial Sequence
  Ebola virus siRNA sense strand
uccgacacucccucugccacg

SEQ ID NO: 8372 - RNA, 21 nt, Artificial Sequence
  Ebola virus siRNA sense strand
ccgacacucccucugccacga

SEQ ID NO: 8373 - RNA, 21 nt, Artificial Sequence
  Ebola virus siRNA sense strand
cgacacucccucugccacgac

SEQ ID NO: 8374 - RNA, 21 nt, Artificial Sequence
  Ebola virus siRNA sense strand
gacacucccucugccacgacc

SEQ ID NO: 8375 - RNA, 21 nt, Artificial Sequence
  Ebola virus siRNA sense strand
acacucccucugccacgaccg

SEQ ID NO: 8376 - RNA, 21 nt, Artificial Sequence
  Ebola virus siRNA sense strand
cacucccucugccacgaccgc

SEQ ID NO: 8377 - RNA, 21 nt, Artificial Sequence
  Ebola virus siRNA sense strand
acucccucugccacgaccgca

SEQ ID NO: 8378 - RNA, 21 nt, Artificial Sequence
  Ebola virus siRNA sense strand
cucccucugccacgaccgcag

SEQ ID NO: 8379 - RNA, 21 nt, Artificial Sequence
  Ebola virus siRNA sense strand
ucccucugccacgaccgcagc

SEQ ID NO: 8380 - RNA, 21 nt, Artificial Sequence
  Ebola virus siRNA sense strand
cccucugccacgaccgcagcc

SEQ ID NO: 8381 - RNA, 21 nt, Artificial Sequence
  Ebola virus siRNA sense strand
ccucugccacgaccgcagccg

SEQ ID NO: 8382 - RNA, 21 nt, Artificial Sequence
  Ebola virus siRNA sense strand
cucugccacgaccgcagccgg

SEQ ID NO: 8383 - RNA, 21 nt, Artificial Sequence
  Ebola virus siRNA sense strand
ucugccacgaccgcagccgga

SEQ ID NO: 8384 - RNA, 21 nt, Artificial Sequence
  Ebola virus siRNA sense strand
cugccacgaccgcagccggac

SEQ ID NO: 8385 - RNA, 21 nt, Artificial Sequence
  Ebola virus siRNA sense strand
ugccacgaccgcagccggacc

SEQ ID NO: 8386 - RNA, 21 nt, Artificial Sequence
  Ebola virus siRNA sense strand
gccacgaccgcagccggaccc

SEQ ID NO: 8387 - RNA, 21 nt, Artificial Sequence
  Ebola virus siRNA sense strand
ccacgaccgcagccggacccc

SEQ ID NO: 8388 - RNA, 21 nt, Artificial Sequence
  Ebola virus siRNA sense strand
cacgaccgcagccggaccccc

SEQ ID NO: 8389 - RNA, 21 nt, Artificial Sequence
  Ebola virus siRNA sense strand
acgaccgcagccggaccccca

SEQ ID NO: 8390 - RNA, 21 nt, Artificial Sequence
  Ebola virus siRNA sense strand
cgaccgcagccggacccccaa

SEQ ID NO: 8391 - RNA, 21 nt, Artificial Sequence
  Ebola virus siRNA sense strand
gaccgcagccggacccccaaa

SEQ ID NO: 8392 - RNA, 21 nt, Artificial Sequence
  Ebola virus siRNA sense strand
accgcagccggacccccaaaa

SEQ ID NO: 8393 - RNA, 21 nt, Artificial Sequence
  Ebola virus siRNA sense strand
ccgcagccggacccccaaaag

SEQ ID NO: 8394 - RNA, 21 nt, Artificial Sequence
  Ebola virus siRNA sense strand
cgcagccggacccccaaaagc

SEQ ID NO: 8395 - RNA, 21 nt, Artificial Sequence
  Ebola virus siRNA sense strand
gcagccggacccccaaaagca

SEQ ID NO: 8396 - RNA, 21 nt, Artificial Sequence
  Ebola virus siRNA sense strand
cagccggacccccaaaagcag

SEQ ID NO: 8397 - RNA, 21 nt, Artificial Sequence
  Ebola virus siRNA sense strand
agccggacccccaaaagcaga

SEQ ID NO: 8398 - RNA, 21 nt, Artificial Sequence
  Ebola virus siRNA sense strand
gccggacccccaaaagcagag

SEQ ID NO: 8399 - RNA, 21 nt, Artificial Sequence
  Ebola virus siRNA sense strand
ccggacccccaaaagcagaga

SEQ ID NO: 8400 - RNA, 21 nt, Artificial Sequence
  Ebola virus siRNA sense strand
cggacccccaaaagcagagaa

SEQ ID NO: 8401 - RNA, 21 nt, Artificial Sequence
  Ebola virus siRNA sense strand
ggacccccaaaagcagagaac

SEQ ID NO: 8402 - RNA, 21 nt, Artificial Sequence
  Ebola virus siRNA sense strand
gacccccaaaagcagagaaca

SEQ ID NO: 8403 - RNA, 21 nt, Artificial Sequence
  Ebola virus siRNA sense strand
acccccaaaagcagagaacac

SEQ ID NO: 8404 - RNA, 21 nt, Artificial Sequence
  Ebola virus siRNA sense strand
cccccaaaagcagagaacacc

SEQ ID NO: 8405 - RNA, 21 nt, Artificial Sequence
  Ebola virus siRNA sense strand
ccccaaaagcagagaacacca

SEQ ID NO: 8406 - RNA, 21 nt, Artificial Sequence
  Ebola virus siRNA sense strand
cccaaaagcagagaacaccaa

SEQ ID NO: 8407 - RNA, 21 nt, Artificial Sequence
  Ebola virus siRNA sense strand
ccaaaagcagagaacaccaac

SEQ ID NO: 8408 - RNA, 21 nt, Artificial Sequence
  Ebola virus siRNA sense strand
caaaagcagagaacaccaaca

SEQ ID NO: 8409 - RNA, 21 nt, Artificial Sequence
  Ebola virus siRNA sense strand
aaaagcagagaacaccaacac

SEQ ID NO: 8410 - RNA, 21 nt, Artificial Sequence
  Ebola virus siRNA sense strand
aaagcagagaacaccaacacg

SEQ ID NO: 8411 - RNA, 21 nt, Artificial Sequence
  Ebola virus siRNA sense strand
aagcagagaacaccaacacga

SEQ ID NO: 8412 - RNA, 21 nt, Artificial Sequence
  Ebola virus siRNA sense strand
agcagagaacaccaacacgag

SEQ ID NO: 8413 - RNA, 21 nt, Artificial Sequence
  Ebola virus siRNA sense strand
gcagagaacaccaacacgagc

SEQ ID NO: 8414 - RNA, 21 nt, Artificial Sequence
  Ebola virus siRNA sense strand
cagagaacaccaacacgagca

SEQ ID NO: 8415 - RNA, 21 nt, Artificial Sequence
  Ebola virus siRNA sense strand
agagaacaccaacacgagcaa

SEQ ID NO: 8416 - RNA, 21 nt, Artificial Sequence
  Ebola virus siRNA sense strand
gagaacaccaacacgagcaag

SEQ ID NO: 8417 - RNA, 21 nt, Artificial Sequence
  Ebola virus siRNA sense strand
agaacaccaacacgagcaaga

SEQ ID NO: 8418 - RNA, 21 nt, Artificial Sequence
  Ebola virus siRNA sense strand
gaacaccaacacgagcaagag

SEQ ID NO: 8419 - RNA, 21 nt, Artificial Sequence
  Ebola virus siRNA sense strand
aacaccaacacgagcaagagc

SEQ ID NO: 8420 - RNA, 21 nt, Artificial Sequence
  Ebola virus siRNA sense strand
acaccaacacgagcaagagca

SEQ ID NO: 8421 - RNA, 21 nt, Artificial Sequence
  Ebola virus siRNA sense strand
caccaacacgagcaagagcac

SEQ ID NO: 8422 - RNA, 21 nt, Artificial Sequence
  Ebola virus siRNA sense strand
accaacacgagcaagagcacu

SEQ ID NO: 8423 - RNA, 21 nt, Artificial Sequence
  Ebola virus siRNA sense strand
ccaacacgagcaagagcacug

SEQ ID NO: 8424 - RNA, 21 nt, Artificial Sequence
  Ebola virus siRNA sense strand
caacacgagcaagagcacuga

SEQ ID NO: 8425 - RNA, 21 nt, Artificial Sequence
  Ebola virus siRNA sense strand
aacacgagcaagagcacugac

SEQ ID NO: 8426 - RNA, 21 nt, Artificial Sequence
  Ebola virus siRNA sense strand
acacgagcaagagcacugacu

SEQ ID NO: 8427 - RNA, 21 nt, Artificial Sequence
  Ebola virus siRNA sense strand
cacgagcaagagcacugacuu

SEQ ID NO: 8428 - RNA, 21 nt, Artificial Sequence
  Ebola virus siRNA sense strand
acgagcaagagcacugacuuc

SEQ ID NO: 8429 - RNA, 21 nt, Artificial Sequence
  Ebola virus siRNA sense strand
cgagcaagagcacugacuucc

SEQ ID NO: 8430 - RNA, 21 nt, Artificial Sequence
  Ebola virus siRNA sense strand
gagcaagagcacugacuuccu

SEQ ID NO: 8431 - RNA, 21 nt, Artificial Sequence
  Ebola virus siRNA sense strand
agcaagagcacugacuuccug

SEQ ID NO: 8432 - RNA, 21 nt, Artificial Sequence
  Ebola virus siRNA sense strand
gcaagagcacugacuuccugg

SEQ ID NO: 8433 - RNA, 21 nt, Artificial Sequence
  Ebola virus siRNA sense strand
caagagcacugacuuccugga

SEQ ID NO: 8434 - RNA, 21 nt, Artificial Sequence
  Ebola virus siRNA sense strand
aagagcacugacuuccuggac

SEQ ID NO: 8435 - RNA, 21 nt, Artificial Sequence
  Ebola virus siRNA sense strand
agagcacugacuuccuggacc

SEQ ID NO: 8436 - RNA, 21 nt, Artificial Sequence
  Ebola virus siRNA sense strand
gagcacugacuuccuggaccc

SEQ ID NO: 8437 - RNA, 21 nt, Artificial Sequence
  Ebola virus siRNA sense strand
agcacugacuuccuggacccc

SEQ ID NO: 8438 - RNA, 21 nt, Artificial Sequence
  Ebola virus siRNA sense strand
gcacugacuuccuggaccccg

SEQ ID NO: 8439 - RNA, 21 nt, Artificial Sequence
  Ebola virus siRNA sense strand
cacugacuuccuggaccccgc

SEQ ID NO: 8440 - RNA, 21 nt, Artificial Sequence
  Ebola virus siRNA sense strand
acugacuuccuggaccccgcc

SEQ ID NO: 8441 - RNA, 21 nt, Artificial Sequence
  Ebola virus siRNA sense strand
cugacuuccuggaccccgcca

SEQ ID NO: 8442 - RNA, 21 nt, Artificial Sequence
  Ebola virus siRNA sense strand
ugacuuccuggaccccgccac

SEQ ID NO: 8443 - RNA, 21 nt, Artificial Sequence
  Ebola virus siRNA sense strand
gacuuccuggaccccgccacc

SEQ ID NO: 8444 - RNA, 21 nt, Artificial Sequence
  Ebola virus siRNA sense strand
acuuccuggaccccgccacca

SEQ ID NO: 8445 - RNA, 21 nt, Artificial Sequence
  Ebola virus siRNA sense strand
cuuccuggaccccgccaccac

SEQ ID NO: 8446 - RNA, 21 nt, Artificial Sequence
  Ebola virus siRNA sense strand
uuccuggaccccgccaccaca

SEQ ID NO: 8447 - RNA, 21 nt, Artificial Sequence
  Ebola virus siRNA sense strand
uccuggaccccgccaccacaa

SEQ ID NO: 8448 - RNA, 21 nt, Artificial Sequence
  Ebola virus siRNA sense strand
ccuggaccccgccaccacaac

SEQ ID NO: 8449 - RNA, 21 nt, Artificial Sequence
  Ebola virus siRNA sense strand
cuggaccccgccaccacaaca

SEQ ID NO: 8450 - RNA, 21 nt, Artificial Sequence
  Ebola virus siRNA sense strand
uggaccccgccaccacaacaa

SEQ ID NO: 8451 - RNA, 21 nt, Artificial Sequence
  Ebola virus siRNA sense strand
ggaccccgccaccacaacaag

SEQ ID NO: 8452 - RNA, 21 nt, Artificial Sequence
  Ebola virus siRNA sense strand
gaccccgccaccacaacaagu

SEQ ID NO: 8453 - RNA, 21 nt, Artificial Sequence
  Ebola virus siRNA sense strand
accccgccaccacaacaaguc

SEQ ID NO: 8454 - RNA, 21 nt, Artificial Sequence
  Ebola virus siRNA sense strand
ccccgccaccacaacaagucc

SEQ ID NO: 8455 - RNA, 21 nt, Artificial Sequence
  Ebola virus siRNA sense strand
cccgccaccacaacaaguccc

SEQ ID NO: 8456 - RNA, 21 nt, Artificial Sequence
  Ebola virus siRNA sense strand
ccgccaccacaacaagucccc

SEQ ID NO: 8457 - RNA, 21 nt, Artificial Sequence
  Ebola virus siRNA sense strand
cgccaccacaacaagucccca

SEQ ID NO: 8458 - RNA, 21 nt, Artificial Sequence
  Ebola virus siRNA sense strand
gccaccacaacaaguccccaa

SEQ ID NO: 8459 - RNA, 21 nt, Artificial Sequence
  Ebola virus siRNA sense strand
ccaccacaacaaguccccaaa

SEQ ID NO: 8460 - RNA, 21 nt, Artificial Sequence
  Ebola virus siRNA sense strand
caccacaacaaguccccaaaa

SEQ ID NO: 8461 - RNA, 21 nt, Artificial Sequence
  Ebola virus siRNA sense strand
accacaacaaguccccaaaac

SEQ ID NO: 8462 - RNA, 21 nt, Artificial Sequence
  Ebola virus siRNA sense strand
ccacaacaaguccccaaaacc

SEQ ID NO: 8463 - RNA, 21 nt, Artificial Sequence
  Ebola virus siRNA sense strand
cacaacaaguccccaaaacca

SEQ ID NO: 8464 - RNA, 21 nt, Artificial Sequence
  Ebola virus siRNA sense strand
acaacaaguccccaaaaccac

SEQ ID NO: 8465 - RNA, 21 nt, Artificial Sequence
  Ebola virus siRNA sense strand
caacaaguccccaaaaccaca

SEQ ID NO: 8466 - RNA, 21 nt, Artificial Sequence
  Ebola virus siRNA sense strand
aacaaguccccaaaaccacag

SEQ ID NO: 8467 - RNA, 21 nt, Artificial Sequence
  Ebola virus siRNA sense strand
acaaguccccaaaaccacagc

SEQ ID NO: 8468 - RNA, 21 nt, Artificial Sequence
  Ebola virus siRNA sense strand
caaguccccaaaaccacagcg

SEQ ID NO: 8469 - RNA, 21 nt, Artificial Sequence
  Ebola virus siRNA sense strand
aaguccccaaaaccacagcga

SEQ ID NO: 8470 - RNA, 21 nt, Artificial Sequence
  Ebola virus siRNA sense strand
aguccccaaaaccacagcgag

SEQ ID NO: 8471 - RNA, 21 nt, Artificial Sequence
  Ebola virus siRNA sense strand
guccccaaaaccacagcgaga

SEQ ID NO: 8472 - RNA, 21 nt, Artificial Sequence
  Ebola virus siRNA sense strand
uccccaaaaccacagcgagac

SEQ ID NO: 8473 - RNA, 21 nt, Artificial Sequence
  Ebola virus siRNA sense strand
ccccaaaaccacagcgagacc

SEQ ID NO: 8474 - RNA, 21 nt, Artificial Sequence
  Ebola virus siRNA sense strand
cccaaaaccacagcgagaccg

SEQ ID NO: 8475 - RNA, 21 nt, Artificial Sequence
  Ebola virus siRNA sense strand
ccaaaaccacagcgagaccgc

SEQ ID NO: 8476 - RNA, 21 nt, Artificial Sequence
  Ebola virus siRNA sense strand
caaaaccacagcgagaccgcu

SEQ ID NO: 8477 - RNA, 21 nt, Artificial Sequence
  Ebola virus siRNA sense strand
aaaaccacagcgagaccgcug

SEQ ID NO: 8478 - RNA, 21 nt, Artificial Sequence
  Ebola virus siRNA sense strand
aaaccacagcgagaccgcugg

SEQ ID NO: 8479 - RNA, 21 nt, Artificial Sequence
  Ebola virus siRNA sense strand
aaccacagcgagaccgcuggc

SEQ ID NO: 8480 - RNA, 21 nt, Artificial Sequence
  Ebola virus siRNA sense strand
accacagcgagaccgcuggca

SEQ ID NO: 8481 - RNA, 21 nt, Artificial Sequence
  Ebola virus siRNA sense strand
ccacagcgagaccgcuggcaa

SEQ ID NO: 8482 - RNA, 21 nt, Artificial Sequence
  Ebola virus siRNA sense strand
cacagcgagaccgcuggcaac

SEQ ID NO: 8483 - RNA, 21 nt, Artificial Sequence
  Ebola virus siRNA sense strand
acagcgagaccgcuggcaaca

SEQ ID NO: 8484 - RNA, 21 nt, Artificial Sequence
  Ebola virus siRNA sense strand
cagcgagaccgcuggcaacaa

SEQ ID NO: 8485 - RNA, 21 nt, Artificial Sequence
  Ebola virus siRNA sense strand
agcgagaccgcuggcaacaac

SEQ ID NO: 8486 - RNA, 21 nt, Artificial Sequence
  Ebola virus siRNA sense strand
gcgagaccgcuggcaacaaca

SEQ ID NO: 8487 - RNA, 21 nt, Artificial Sequence
  Ebola virus siRNA sense strand
cgagaccgcuggcaacaacaa

SEQ ID NO: 8488 - RNA, 21 nt, Artificial Sequence
  Ebola virus siRNA sense strand
gagaccgcuggcaacaacaac

SEQ ID NO: 8489 - RNA, 21 nt, Artificial Sequence
  Ebola virus siRNA sense strand
agaccgcuggcaacaacaaca

SEQ ID NO: 8490 - RNA, 21 nt, Artificial Sequence
  Ebola virus siRNA sense strand
gaccgcuggcaacaacaacac

SEQ ID NO: 8491 - RNA, 21 nt, Artificial Sequence
  Ebola virus siRNA sense strand
accgcuggcaacaacaacacu

SEQ ID NO: 8492 - RNA, 21 nt, Artificial Sequence
  Ebola virus siRNA sense strand
ccgcuggcaacaacaacacuc

SEQ ID NO: 8493 - RNA, 21 nt, Artificial Sequence
  Ebola virus siRNA sense strand
cgcuggcaacaacaacacuca

SEQ ID NO: 8494 - RNA, 21 nt, Artificial Sequence
  Ebola virus siRNA sense strand
gcuggcaacaacaacacucau

SEQ ID NO: 8495 - RNA, 21 nt, Artificial Sequence
  Ebola virus siRNA sense strand
cuggcaacaacaacacucauc

SEQ ID NO: 8496 - RNA, 21 nt, Artificial Sequence
  Ebola virus siRNA sense strand
uggcaacaacaacacucauca

SEQ ID NO: 8497 - RNA, 21 nt, Artificial Sequence
  Ebola virus siRNA sense strand
ggcaacaacaacacucaucac

SEQ ID NO: 8498 - RNA, 21 nt, Artificial Sequence
  Ebola virus siRNA sense strand
gcaacaacaacacucaucacc

SEQ ID NO: 8499 - RNA, 21 nt, Artificial Sequence
  Ebola virus siRNA sense strand
caacaacaacacucaucacca

SEQ ID NO: 8500 - RNA, 21 nt, Artificial Sequence
  Ebola virus siRNA sense strand
aacaacaacacucaucaccaa

SEQ ID NO: 8501 - RNA, 21 nt, Artificial Sequence
  Ebola virus siRNA sense strand
acaacaacacucaucaccaag

SEQ ID NO: 8502 - RNA, 21 nt, Artificial Sequence
  Ebola virus siRNA sense strand
caacaacacucaucaccaaga

SEQ ID NO: 8503 - RNA, 21 nt, Artificial Sequence
  Ebola virus siRNA sense strand
aacaacacucaucaccaagau

SEQ ID NO: 8504 - RNA, 21 nt, Artificial Sequence
  Ebola virus siRNA sense strand
acaacacucaucaccaagaua

SEQ ID NO: 8505 - RNA, 21 nt, Artificial Sequence
  Ebola virus siRNA sense strand
caacacucaucaccaagauac

SEQ ID NO: 8506 - RNA, 21 nt, Artificial Sequence
  Ebola virus siRNA sense strand
aacacucaucaccaagauacc

SEQ ID NO: 8507 - RNA, 21 nt, Artificial Sequence
  Ebola virus siRNA sense strand
acacucaucaccaagauaccg

SEQ ID NO: 8508 - RNA, 21 nt, Artificial Sequence
  Ebola virus siRNA sense strand
cacucaucaccaagauaccgg

SEQ ID NO: 8509 - RNA, 21 nt, Artificial Sequence
  Ebola virus siRNA sense strand
acucaucaccaagauaccgga

SEQ ID NO: 8510 - RNA, 21 nt, Artificial Sequence
  Ebola virus siRNA sense strand
cucaucaccaagauaccggag

SEQ ID NO: 8511 - RNA, 21 nt, Artificial Sequence
  Ebola virus siRNA sense strand
ucaucaccaagauaccggaga

SEQ ID NO: 8512 - RNA, 21 nt, Artificial Sequence
  Ebola virus siRNA sense strand
caucaccaagauaccggagaa

SEQ ID NO: 8513 - RNA, 21 nt, Artificial Sequence
  Ebola virus siRNA sense strand
aucaccaagauaccggagaag

SEQ ID NO: 8514 - RNA, 21 nt, Artificial Sequence
  Ebola virus siRNA sense strand
ucaccaagauaccggagaaga

SEQ ID NO: 8515 - RNA, 21 nt, Artificial Sequence
  Ebola virus siRNA sense strand
caccaagauaccggagaagag

SEQ ID NO: 8516 - RNA, 21 nt, Artificial Sequence
  Ebola virus siRNA sense strand
accaagauaccggagaagaga

SEQ ID NO: 8517 - RNA, 21 nt, Artificial Sequence
  Ebola virus siRNA sense strand
ccaagauaccggagaagagag

SEQ ID NO: 8518 - RNA, 21 nt, Artificial Sequence
  Ebola virus siRNA sense strand
caagauaccggagaagagagu

SEQ ID NO: 8519 - RNA, 21 nt, Artificial Sequence
  Ebola virus siRNA sense strand
aagauaccggagaagagagug

SEQ ID NO: 8520 - RNA, 21 nt, Artificial Sequence
  Ebola virus siRNA sense strand
agauaccggagaagagagugc

SEQ ID NO: 8521 - RNA, 21 nt, Artificial Sequence
  Ebola virus siRNA sense strand
gauaccggagaagagagugcc

SEQ ID NO: 8522 - RNA, 21 nt, Artificial Sequence
  Ebola virus siRNA sense strand
auaccggagaagagagugcca

SEQ ID NO: 8523 - RNA, 21 nt, Artificial Sequence
  Ebola virus siRNA sense strand
uaccggagaagagagugccag

SEQ ID NO: 8524 - RNA, 21 nt, Artificial Sequence
  Ebola virus siRNA sense strand
accggagaagagagugccagc

SEQ ID NO: 8525 - RNA, 21 nt, Artificial Sequence
  Ebola virus siRNA sense strand
ccggagaagagagugccagca

SEQ ID NO: 8526 - RNA, 21 nt, Artificial Sequence
  Ebola virus siRNA sense strand
cggagaagagagugccagcag

SEQ ID NO: 8527 - RNA, 21 nt, Artificial Sequence
  Ebola virus siRNA sense strand
ggagaagagagugccagcagc

SEQ ID NO: 8528 - RNA, 21 nt, Artificial Sequence
  Ebola virus siRNA sense strand
gagaagagagugccagcagcg

SEQ ID NO: 8529 - RNA, 21 nt, Artificial Sequence
  Ebola virus siRNA sense strand
agaagagagugccagcagcgg

SEQ ID NO: 8530 - RNA, 21 nt, Artificial Sequence
  Ebola virus siRNA sense strand
gaagagagugccagcagcggg

SEQ ID NO: 8531 - RNA, 21 nt, Artificial Sequence
  Ebola virus siRNA sense strand
aagagagugccagcagcggga

SEQ ID NO: 8532 - RNA, 21 nt, Artificial Sequence
  Ebola virus siRNA sense strand
agagagugccagcagcgggaa

SEQ ID NO: 8533 - RNA, 21 nt, Artificial Sequence
  Ebola virus siRNA sense strand
gagagugccagcagcgggaag

SEQ ID NO: 8534 - RNA, 21 nt, Artificial Sequence
  Ebola virus siRNA sense strand
agagugccagcagcgggaagc

SEQ ID NO: 8535 - RNA, 21 nt, Artificial Sequence
  Ebola virus siRNA sense strand
gagugccagcagcgggaagcu

SEQ ID NO: 8536 - RNA, 21 nt, Artificial Sequence
  Ebola virus siRNA sense strand
agugccagcagcgggaagcua

SEQ ID NO: 8537 - RNA, 21 nt, Artificial Sequence
  Ebola virus siRNA sense strand
gugccagcagcgggaagcuag

SEQ ID NO: 8538 - RNA, 21 nt, Artificial Sequence
  Ebola virus siRNA sense strand
ugccagcagcgggaagcuagg

SEQ ID NO: 8539 - RNA, 21 nt, Artificial Sequence
  Ebola virus siRNA sense strand
gccagcagcgggaagcuaggc

SEQ ID NO: 8540 - RNA, 21 nt, Artificial Sequence
  Ebola virus siRNA sense strand
ccagcagcgggaagcuaggcu

SEQ ID NO: 8541 - RNA, 21 nt, Artificial Sequence
  Ebola virus siRNA sense strand
cagcagcgggaagcuaggcuu

SEQ ID NO: 8542 - RNA, 21 nt, Artificial Sequence
  Ebola virus siRNA sense strand
agcagcgggaagcuaggcuua

SEQ ID NO: 8543 - RNA, 21 nt, Artificial Sequence
  Ebola virus siRNA sense strand
gcagcgggaagcuaggcuuaa

SEQ ID NO: 8544 - RNA, 21 nt, Artificial Sequence
  Ebola virus siRNA sense strand
cagcgggaagcuaggcuuaau

SEQ ID NO: 8545 - RNA, 21 nt, Artificial Sequence
  Ebola virus siRNA sense strand
agcgggaagcuaggcuuaauu

SEQ ID NO: 8546 - RNA, 21 nt, Artificial Sequence
  Ebola virus siRNA sense strand
gcgggaagcuaggcuuaauua

SEQ ID NO: 8547 - RNA, 21 nt, Artificial Sequence
  Ebola virus siRNA sense strand
cgggaagcuaggcuuaauuac

SEQ ID NO: 8548 - RNA, 21 nt, Artificial Sequence
  Ebola virus siRNA sense strand
gggaagcuaggcuuaauuacc

SEQ ID NO: 8549 - RNA, 21 nt, Artificial Sequence
  Ebola virus siRNA sense strand
ggaagcuaggcuuaauuacca

SEQ ID NO: 8550 - RNA, 21 nt, Artificial Sequence
  Ebola virus siRNA sense strand
gaagcuaggcuuaauuaccaa

SEQ ID NO: 8551 - RNA, 21 nt, Artificial Sequence
  Ebola virus siRNA sense strand
aagcuaggcuuaauuaccaau

SEQ ID NO: 8552 - RNA, 21 nt, Artificial Sequence
  Ebola virus siRNA sense strand
agcuaggcuuaauuaccaaua

SEQ ID NO: 8553 - RNA, 21 nt, Artificial Sequence
  Ebola virus siRNA sense strand
gcuaggcuuaauuaccaauac

SEQ ID NO: 8554 - RNA, 21 nt, Artificial Sequence
  Ebola virus siRNA sense strand
cuaggcuuaauuaccaauacu

SEQ ID NO: 8555 - RNA, 21 nt, Artificial Sequence
  Ebola virus siRNA sense strand
uaggcuuaauuaccaauacua

SEQ ID NO: 8556 - RNA, 21 nt, Artificial Sequence
  Ebola virus siRNA sense strand
aggcuuaauuaccaauacuau

SEQ ID NO: 8557 - RNA, 21 nt, Artificial Sequence
  Ebola virus siRNA sense strand
ggcuuaauuaccaauacuauu

SEQ ID NO: 8558 - RNA, 21 nt, Artificial Sequence
  Ebola virus siRNA sense strand
gcuuaauuaccaauacuauug

SEQ ID NO: 8559 - RNA, 21 nt, Artificial Sequence
  Ebola virus siRNA sense strand
cuuaauuaccaauacuauugc

SEQ ID NO: 8560 - RNA, 21 nt, Artificial Sequence
  Ebola virus siRNA sense strand
uuaauuaccaauacuauugcu

SEQ ID NO: 8561 - RNA, 21 nt, Artificial Sequence
  Ebola virus siRNA sense strand
uaauuaccaauacuauugcug

SEQ ID NO: 8562 - RNA, 21 nt, Artificial Sequence
  Ebola virus siRNA sense strand
aauuaccaauacuauugcugg

SEQ ID NO: 8563 - RNA, 21 nt, Artificial Sequence
  Ebola virus siRNA sense strand
auuaccaauacuauugcugga

SEQ ID NO: 8564 - RNA, 21 nt, Artificial Sequence
  Ebola virus siRNA sense strand
uuaccaauacuauugcuggag

SEQ ID NO: 8565 - RNA, 21 nt, Artificial Sequence
  Ebola virus siRNA sense strand
uaccaauacuauugcuggagu

SEQ ID NO: 8566 - RNA, 21 nt, Artificial Sequence
  Ebola virus siRNA sense strand
accaauacuauugcuggaguc

SEQ ID NO: 8567 - RNA, 21 nt, Artificial Sequence
  Ebola virus siRNA sense strand
ccaauacuauugcuggagucg

SEQ ID NO: 8568 - RNA, 21 nt, Artificial Sequence
  Ebola virus siRNA sense strand
caauacuauugcuggagucgc

SEQ ID NO: 8569 - RNA, 21 nt, Artificial Sequence
  Ebola virus siRNA sense strand
aauacuauugcuggagucgca

SEQ ID NO: 8570 - RNA, 21 nt, Artificial Sequence
  Ebola virus siRNA sense strand
auacuauugcuggagucgcag

SEQ ID NO: 8571 - RNA, 21 nt, Artificial Sequence
  Ebola virus siRNA sense strand
uacuauugcuggagucgcagg

SEQ ID NO: 8572 - RNA, 21 nt, Artificial Sequence
  Ebola virus siRNA sense strand
acuauugcuggagucgcagga

SEQ ID NO: 8573 - RNA, 21 nt, Artificial Sequence
  Ebola virus siRNA sense strand
cuauugcuggagucgcaggac

SEQ ID NO: 8574 - RNA, 21 nt, Artificial Sequence
  Ebola virus siRNA sense strand
uauugcuggagucgcaggacu

SEQ ID NO: 8575 - RNA, 21 nt, Artificial Sequence
  Ebola virus siRNA sense strand
auugcuggagucgcaggacug

SEQ ID NO: 8576 - RNA, 21 nt, Artificial Sequence
  Ebola virus siRNA sense strand
uugcuggagucgcaggacuga

SEQ ID NO: 8577 - RNA, 21 nt, Artificial Sequence
  Ebola virus siRNA sense strand
ugcuggagucgcaggacugau

SEQ ID NO: 8578 - RNA, 21 nt, Artificial Sequence
  Ebola virus siRNA sense strand
gcuggagucgcaggacugauc

SEQ ID NO: 8579 - RNA, 21 nt, Artificial Sequence
  Ebola virus siRNA sense strand
cuggagucgcaggacugauca

SEQ ID NO: 8580 - RNA, 21 nt, Artificial Sequence
  Ebola virus siRNA sense strand
uggagucgcaggacugaucac

SEQ ID NO: 8581 - RNA, 21 nt, Artificial Sequence
  Ebola virus siRNA sense strand
ggagucgcaggacugaucaca

SEQ ID NO: 8582 - RNA, 21 nt, Artificial Sequence
  Ebola virus siRNA sense strand
gagucgcaggacugaucacag

SEQ ID NO: 8583 - RNA, 21 nt, Artificial Sequence
  Ebola virus siRNA sense strand
agucgcaggacugaucacagg

SEQ ID NO: 8584 - RNA, 21 nt, Artificial Sequence
  Ebola virus siRNA sense strand
gucgcaggacugaucacaggc

SEQ ID NO: 8585 - RNA, 21 nt, Artificial Sequence
  Ebola virus siRNA sense strand
ucgcaggacugaucacaggcg

SEQ ID NO: 8586 - RNA, 21 nt, Artificial Sequence
  Ebola virus siRNA sense strand
cgcaggacugaucacaggcgg

SEQ ID NO: 8587 - RNA, 21 nt, Artificial Sequence
  Ebola virus siRNA sense strand
gcaggacugaucacaggcggg

SEQ ID NO: 8588 - RNA, 21 nt, Artificial Sequence
  Ebola virus siRNA sense strand
caggacugaucacaggcggga

SEQ ID NO: 8589 - RNA, 21 nt, Artificial Sequence
  Ebola virus siRNA sense strand
aggacugaucacaggcgggag

SEQ ID NO: 8590 - RNA, 21 nt, Artificial Sequence
  Ebola virus siRNA sense strand
ggacugaucacaggcgggaga

SEQ ID NO: 8591 - RNA, 21 nt, Artificial Sequence
  Ebola virus siRNA sense strand
gacugaucacaggcgggagaa

SEQ ID NO: 8592 - RNA, 21 nt, Artificial Sequence
  Ebola virus siRNA sense strand
acugaucacaggcgggagaag

SEQ ID NO: 8593 - RNA, 21 nt, Artificial Sequence
  Ebola virus siRNA sense strand
cugaucacaggcgggagaaga

SEQ ID NO: 8594 - RNA, 21 nt, Artificial Sequence
  Ebola virus siRNA sense strand
ugaucacaggcgggagaagaa

SEQ ID NO: 8595 - RNA, 21 nt, Artificial Sequence
  Ebola virus siRNA sense strand
gaucacaggcgggagaagaac

SEQ ID NO: 8596 - RNA, 21 nt, Artificial Sequence
  Ebola virus siRNA sense strand
aucacaggcgggagaagaacu

SEQ ID NO: 8597 - RNA, 21 nt, Artificial Sequence
  Ebola virus siRNA sense strand
ucacaggcgggagaagaacuc

SEQ ID NO: 8598 - RNA, 21 nt, Artificial Sequence
  Ebola virus siRNA sense strand
cacaggcgggagaagaacucg

SEQ ID NO: 8599 - RNA, 21 nt, Artificial Sequence
  Ebola virus siRNA sense strand
acaggcgggagaagaacucga

SEQ ID NO: 8600 - RNA, 21 nt, Artificial Sequence
  Ebola virus siRNA sense strand
caggcgggagaagaacucgaa

SEQ ID NO: 8601 - RNA, 21 nt, Artificial Sequence
  Ebola virus siRNA sense strand
aggcgggagaagaacucgaag

SEQ ID NO: 8602 - RNA, 21 nt, Artificial Sequence
  Ebola virus siRNA sense strand
ggcgggagaagaacucgaaga

SEQ ID NO: 8603 - RNA, 21 nt, Artificial Sequence
  Ebola virus siRNA sense strand
gcgggagaagaacucgaagag

SEQ ID NO: 8604 - RNA, 21 nt, Artificial Sequence
  Ebola virus siRNA sense strand
cgggagaagaacucgaagaga

SEQ ID NO: 8605 - RNA, 21 nt, Artificial Sequence
  Ebola virus siRNA sense strand
gggagaagaacucgaagagaa

SEQ ID NO: 8606 - RNA, 21 nt, Artificial Sequence
  Ebola virus siRNA sense strand
ggagaagaacucgaagagaag

SEQ ID NO: 8607 - RNA, 21 nt, Artificial Sequence
  Ebola virus siRNA sense strand
gagaagaacucgaagagaagc

SEQ ID NO: 8608 - RNA, 21 nt, Artificial Sequence
  Ebola virus siRNA sense strand
agaagaacucgaagagaagca

SEQ ID NO: 8609 - RNA, 21 nt, Artificial Sequence
  Ebola virus siRNA sense strand
gaagaacucgaagagaagcaa

SEQ ID NO: 8610 - RNA, 21 nt, Artificial Sequence
  Ebola virus siRNA sense strand
aagaacucgaagagaagcaau

SEQ ID NO: 8611 - RNA, 21 nt, Artificial Sequence
  Ebola virus siRNA sense strand
agaacucgaagagaagcaauu

SEQ ID NO: 8612 - RNA, 21 nt, Artificial Sequence
  Ebola virus siRNA sense strand
gaacucgaagagaagcaauug

SEQ ID NO: 8613 - RNA, 21 nt, Artificial Sequence
  Ebola virus siRNA sense strand
aacucgaagagaagcaauugu

SEQ ID NO: 8614 - RNA, 21 nt, Artificial Sequence
  Ebola virus siRNA sense strand
acucgaagagaagcaauuguc

SEQ ID NO: 8615 - RNA, 21 nt, Artificial Sequence
  Ebola virus siRNA sense strand
cucgaagagaagcaauuguca

SEQ ID NO: 8616 - RNA, 21 nt, Artificial Sequence
  Ebola virus siRNA sense strand
ucgaagagaagcaauugucaa

SEQ ID NO: 8617 - RNA, 21 nt, Artificial Sequence
  Ebola virus siRNA sense strand
cgaagagaagcaauugucaau

SEQ ID NO: 8618 - RNA, 21 nt, Artificial Sequence
  Ebola virus siRNA sense strand
gaagagaagcaauugucaaug

SEQ ID NO: 8619 - RNA, 21 nt, Artificial Sequence
  Ebola virus siRNA sense strand
aagagaagcaauugucaaugc

SEQ ID NO: 8620 - RNA, 21 nt, Artificial Sequence
  Ebola virus siRNA sense strand
agagaagcaauugucaaugcu

SEQ ID NO: 8621 - RNA, 21 nt, Artificial Sequence
  Ebola virus siRNA sense strand
gagaagcaauugucaaugcuc

SEQ ID NO: 8622 - RNA, 21 nt, Artificial Sequence
  Ebola virus siRNA sense strand
agaagcaauugucaaugcuca

SEQ ID NO: 8623 - RNA, 21 nt, Artificial Sequence
  Ebola virus siRNA sense strand
gaagcaauugucaaugcucaa

SEQ ID NO: 8624 - RNA, 21 nt, Artificial Sequence
  Ebola virus siRNA sense strand
aagcaauugucaaugcucaac

SEQ ID NO: 8625 - RNA, 21 nt, Artificial Sequence
  Ebola virus siRNA sense strand
agcaauugucaaugcucaacc

SEQ ID NO: 8626 - RNA, 21 nt, Artificial Sequence
  Ebola virus siRNA sense strand
gcaauugucaaugcucaaccc

SEQ ID NO: 8627 - RNA, 21 nt, Artificial Sequence
  Ebola virus siRNA sense strand
caauugucaaugcucaaccca

SEQ ID NO: 8628 - RNA, 21 nt, Artificial Sequence
  Ebola virus siRNA sense strand
aauugucaaugcucaacccaa

SEQ ID NO: 8629 - RNA, 21 nt, Artificial Sequence
  Ebola virus siRNA sense strand
auugucaaugcucaacccaaa

SEQ ID NO: 8630 - RNA, 21 nt, Artificial Sequence
  Ebola virus siRNA sense strand
uugucaaugcucaacccaaau

SEQ ID NO: 8631 - RNA, 21 nt, Artificial Sequence
  Ebola virus siRNA sense strand
ugucaaugcucaacccaaaug

SEQ ID NO: 8632 - RNA, 21 nt, Artificial Sequence
  Ebola virus siRNA sense strand
gucaaugcucaacccaaaugc

SEQ ID NO: 8633 - RNA, 21 nt, Artificial Sequence
  Ebola virus siRNA sense strand
ucaaugcucaacccaaaugca

SEQ ID NO: 8634 - RNA, 21 nt, Artificial Sequence
  Ebola virus siRNA sense strand
caaugcucaacccaaaugcaa

SEQ ID NO: 8635 - RNA, 21 nt, Artificial Sequence
  Ebola virus siRNA sense strand
aaugcucaacccaaaugcaac

SEQ ID NO: 8636 - RNA, 21 nt, Artificial Sequence
  Ebola virus siRNA sense strand
augcucaacccaaaugcaacc

SEQ ID NO: 8637 - RNA, 21 nt, Artificial Sequence
  Ebola virus siRNA sense strand
ugcucaacccaaaugcaaccc

SEQ ID NO: 8638 - RNA, 21 nt, Artificial Sequence
  Ebola virus siRNA sense strand
gcucaacccaaaugcaacccu

SEQ ID NO: 8639 - RNA, 21 nt, Artificial Sequence
  Ebola virus siRNA sense strand
cucaacccaaaugcaacccua

SEQ ID NO: 8640 - RNA, 21 nt, Artificial Sequence
  Ebola virus siRNA sense strand
ucaacccaaaugcaacccuaa

SEQ ID NO: 8641 - RNA, 21 nt, Artificial Sequence
  Ebola virus siRNA sense strand
caacccaaaugcaacccuaau

SEQ ID NO: 8642 - RNA, 21 nt, Artificial Sequence
  Ebola virus siRNA sense strand
aacccaaaugcaacccuaauu

SEQ ID NO: 8643 - RNA, 21 nt, Artificial Sequence
  Ebola virus siRNA sense strand
acccaaaugcaacccuaauuu

SEQ ID NO: 8644 - RNA, 21 nt, Artificial Sequence
  Ebola virus siRNA sense strand
cccaaaugcaacccuaauuua

SEQ ID NO: 8645 - RNA, 21 nt, Artificial Sequence
  Ebola virus siRNA sense strand
ccaaaugcaacccuaauuuac

SEQ ID NO: 8646 - RNA, 21 nt, Artificial Sequence
  Ebola virus siRNA sense strand
caaaugcaacccuaauuuaca

SEQ ID NO: 8647 - RNA, 21 nt, Artificial Sequence
  Ebola virus siRNA sense strand
aaaugcaacccuaauuuacau

SEQ ID NO: 8648 - RNA, 21 nt, Artificial Sequence
  Ebola virus siRNA sense strand
aaugcaacccuaauuuacauu

SEQ ID NO: 8649 - RNA, 21 nt, Artificial Sequence
  Ebola virus siRNA sense strand
augcaacccuaauuuacauua

SEQ ID NO: 8650 - RNA, 21 nt, Artificial Sequence
  Ebola virus siRNA sense strand
ugcaacccuaauuuacauuac

SEQ ID NO: 8651 - RNA, 21 nt, Artificial Sequence
  Ebola virus siRNA sense strand
gcaacccuaauuuacauuacu

SEQ ID NO: 8652 - RNA, 21 nt, Artificial Sequence
  Ebola virus siRNA sense strand
caacccuaauuuacauuacug

SEQ ID NO: 8653 - RNA, 21 nt, Artificial Sequence
  Ebola virus siRNA sense strand
aacccuaauuuacauuacugg

SEQ ID NO: 8654 - RNA, 21 nt, Artificial Sequence
  Ebola virus siRNA sense strand
acccuaauuuacauuacugga

SEQ ID NO: 8655 - RNA, 21 nt, Artificial Sequence
  Ebola virus siRNA sense strand
cccuaauuuacauuacuggac

SEQ ID NO: 8656 - RNA, 21 nt, Artificial Sequence
  Ebola virus siRNA sense strand
ccuaauuuacauuacuggacu

SEQ ID NO: 8657 - RNA, 21 nt, Artificial Sequence
  Ebola virus siRNA sense strand
cuaauuuacauuacuggacua

SEQ ID NO: 8658 - RNA, 21 nt, Artificial Sequence
  Ebola virus siRNA sense strand
uaauuuacauuacuggacuac

SEQ ID NO: 8659 - RNA, 21 nt, Artificial Sequence
  Ebola virus siRNA sense strand
aauuuacauuacuggacuacu

SEQ ID NO: 8660 - RNA, 21 nt, Artificial Sequence
  Ebola virus siRNA sense strand
auuuacauuacuggacuacuc

SEQ ID NO: 8661 - RNA, 21 nt, Artificial Sequence
  Ebola virus siRNA sense strand
uuuacauuacuggacuacuca

SEQ ID NO: 8662 - RNA, 21 nt, Artificial Sequence
  Ebola virus siRNA sense strand
uuacauuacuggacuacucag

SEQ ID NO: 8663 - RNA, 21 nt, Artificial Sequence
  Ebola virus siRNA sense strand
uacauuacuggacuacucagg

SEQ ID NO: 8664 - RNA, 21 nt, Artificial Sequence
  Ebola virus siRNA sense strand
acauuacuggacuacucagga

SEQ ID NO: 8665 - RNA, 21 nt, Artificial Sequence
  Ebola virus siRNA sense strand
cauuacuggacuacucaggau

SEQ ID NO: 8666 - RNA, 21 nt, Artificial Sequence
  Ebola virus siRNA sense strand
auuacuggacuacucaggaug

SEQ ID NO: 8667 - RNA, 21 nt, Artificial Sequence
  Ebola virus siRNA sense strand
uuacuggacuacucaggauga

SEQ ID NO: 8668 - RNA, 21 nt, Artificial Sequence
  Ebola virus siRNA sense strand
uacuggacuacucaggaugaa

SEQ ID NO: 8669 - RNA, 21 nt, Artificial Sequence
  Ebola virus siRNA sense strand
acuggacuacucaggaugaag

SEQ ID NO: 8670 - RNA, 21 nt, Artificial Sequence
  Ebola virus siRNA sense strand
cuggacuacucaggaugaagg

SEQ ID NO: 8671 - RNA, 21 nt, Artificial Sequence
  Ebola virus siRNA sense strand
uggacuacucaggaugaaggu

SEQ ID NO: 8672 - RNA, 21 nt, Artificial Sequence
  Ebola virus siRNA sense strand
ggacuacucaggaugaaggug

SEQ ID NO: 8673 - RNA, 21 nt, Artificial Sequence
  Ebola virus siRNA sense strand
gacuacucaggaugaaggugc

SEQ ID NO: 8674 - RNA, 21 nt, Artificial Sequence
  Ebola virus siRNA sense strand
acuacucaggaugaaggugcu

SEQ ID NO: 8675 - RNA, 21 nt, Artificial Sequence
  Ebola virus siRNA sense strand
cuacucaggaugaaggugcug

SEQ ID NO: 8676 - RNA, 21 nt, Artificial Sequence
  Ebola virus siRNA sense strand
uacucaggaugaaggugcugc

SEQ ID NO: 8677 - RNA, 21 nt, Artificial Sequence
  Ebola virus siRNA sense strand
acucaggaugaaggugcugca

SEQ ID NO: 8678 - RNA, 21 nt, Artificial Sequence
  Ebola virus siRNA sense strand
cucaggaugaaggugcugcaa

SEQ ID NO: 8679 - RNA, 21 nt, Artificial Sequence
  Ebola virus siRNA sense strand
ucaggaugaaggugcugcaau

SEQ ID NO: 8680 - RNA, 21 nt, Artificial Sequence
  Ebola virus siRNA sense strand
caggaugaaggugcugcaauc

SEQ ID NO: 8681 - RNA, 21 nt, Artificial Sequence
  Ebola virus siRNA sense strand
aggaugaaggugcugcaaucg

SEQ ID NO: 8682 - RNA, 21 nt, Artificial Sequence
  Ebola virus siRNA sense strand
ggaugaaggugcugcaaucgg

SEQ ID NO: 8683 - RNA, 21 nt, Artificial Sequence
  Ebola virus siRNA sense strand
gaugaaggugcugcaaucgga

SEQ ID NO: 8684 - RNA, 21 nt, Artificial Sequence
  Ebola virus siRNA sense strand
augaaggugcugcaaucggac

SEQ ID NO: 8685 - RNA, 21 nt, Artificial Sequence
  Ebola virus siRNA sense strand
ugaaggugcugcaaucggacu

SEQ ID NO: 8686 - RNA, 21 nt, Artificial Sequence
  Ebola virus siRNA sense strand
gaaggugcugcaaucggacug

SEQ ID NO: 8687 - RNA, 21 nt, Artificial Sequence
  Ebola virus siRNA sense strand
aaggugcugcaaucggacugg

SEQ ID NO: 8688 - RNA, 21 nt, Artificial Sequence
  Ebola virus siRNA sense strand
aggugcugcaaucggacuggc

SEQ ID NO: 8689 - RNA, 21 nt, Artificial Sequence
  Ebola virus siRNA sense strand
ggugcugcaaucggacuggcc

SEQ ID NO: 8690 - RNA, 21 nt, Artificial Sequence
  Ebola virus siRNA sense strand
gugcugcaaucggacuggccu

SEQ ID NO: 8691 - RNA, 21 nt, Artificial Sequence
  Ebola virus siRNA sense strand
ugcugcaaucggacuggccug

SEQ ID NO: 8692 - RNA, 21 nt, Artificial Sequence
  Ebola virus siRNA sense strand
gcugcaaucggacuggccugg

SEQ ID NO: 8693 - RNA, 21 nt, Artificial Sequence
  Ebola virus siRNA sense strand
cugcaaucggacuggccugga

SEQ ID NO: 8694 - RNA, 21 nt, Artificial Sequence
  Ebola virus siRNA sense strand
ugcaaucggacuggccuggau

SEQ ID NO: 8695 - RNA, 21 nt, Artificial Sequence
  Ebola virus siRNA sense strand
gcaaucggacuggccuggaua

SEQ ID NO: 8696 - RNA, 21 nt, Artificial Sequence
  Ebola virus siRNA sense strand
caaucggacuggccuggauac

SEQ ID NO: 8697 - RNA, 21 nt, Artificial Sequence
  Ebola virus siRNA sense strand
aaucggacuggccuggauacc

SEQ ID NO: 8698 - RNA, 21 nt, Artificial Sequence
  Ebola virus siRNA sense strand
aucggacuggccuggauacca

SEQ ID NO: 8699 - RNA, 21 nt, Artificial Sequence
  Ebola virus siRNA sense strand
ucggacuggccuggauaccau

SEQ ID NO: 8700 - RNA, 21 nt, Artificial Sequence
  Ebola virus siRNA sense strand
cggacuggccuggauaccaua

SEQ ID NO: 8701 - RNA, 21 nt, Artificial Sequence
  Ebola virus siRNA sense strand
ggacuggccuggauaccauau

SEQ ID NO: 8702 - RNA, 21 nt, Artificial Sequence
  Ebola virus siRNA sense strand
gacuggccuggauaccauauu

SEQ ID NO: 8703 - RNA, 21 nt, Artificial Sequence
  Ebola virus siRNA sense strand
acuggccuggauaccauauuu

SEQ ID NO: 8704 - RNA, 21 nt, Artificial Sequence
  Ebola virus siRNA sense strand
cuggccuggauaccauauuuc

SEQ ID NO: 8705 - RNA, 21 nt, Artificial Sequence
  Ebola virus siRNA sense strand
uggccuggauaccauauuucg

SEQ ID NO: 8706 - RNA, 21 nt, Artificial Sequence
  Ebola virus siRNA sense strand
ggccuggauaccauauuucgg

SEQ ID NO: 8707 - RNA, 21 nt, Artificial Sequence
  Ebola virus siRNA sense strand
gccuggauaccauauuucggg

SEQ ID NO: 8708 - RNA, 21 nt, Artificial Sequence
  Ebola virus siRNA sense strand
ccuggauaccauauuucgggc

SEQ ID NO: 8709 - RNA, 21 nt, Artificial Sequence
  Ebola virus siRNA sense strand
cuggauaccauauuucgggcc

SEQ ID NO: 8710 - RNA, 21 nt, Artificial Sequence
  Ebola virus siRNA sense strand
uggauaccauauuucgggcca

SEQ ID NO: 8711 - RNA, 21 nt, Artificial Sequence
  Ebola virus siRNA sense strand
ggauaccauauuucgggccag

SEQ ID NO: 8712 - RNA, 21 nt, Artificial Sequence
  Ebola virus siRNA sense strand
gauaccauauuucgggccagc

SEQ ID NO: 8713 - RNA, 21 nt, Artificial Sequence
  Ebola virus siRNA sense strand
auaccauauuucgggccagca

SEQ ID NO: 8714 - RNA, 21 nt, Artificial Sequence
  Ebola virus siRNA sense strand
uaccauauuucgggccagcag

SEQ ID NO: 8715 - RNA, 21 nt, Artificial Sequence
  Ebola virus siRNA sense strand
accauauuucgggccagcagc

SEQ ID NO: 8716 - RNA, 21 nt, Artificial Sequence
  Ebola virus siRNA sense strand
ccauauuucgggccagcagcc

SEQ ID NO: 8717 - RNA, 21 nt, Artificial Sequence
  Ebola virus siRNA sense strand
cauauuucgggccagcagccg

SEQ ID NO: 8718 - RNA, 21 nt, Artificial Sequence
  Ebola virus siRNA sense strand
auauuucgggccagcagccga

SEQ ID NO: 8719 - RNA, 21 nt, Artificial Sequence
  Ebola virus siRNA sense strand
uauuucgggccagcagccgag

SEQ ID NO: 8720 - RNA, 21 nt, Artificial Sequence
  Ebola virus siRNA sense strand
auuucgggccagcagccgagg

SEQ ID NO: 8721 - RNA, 21 nt, Artificial Sequence
  Ebola virus siRNA sense strand
uuucgggccagcagccgaggg

SEQ ID NO: 8722 - RNA, 21 nt, Artificial Sequence
  Ebola virus siRNA sense strand
uucgggccagcagccgaggga

SEQ ID NO: 8723 - RNA, 21 nt, Artificial Sequence
  Ebola virus siRNA sense strand
ucgggccagcagccgagggaa

SEQ ID NO: 8724 - RNA, 21 nt, Artificial Sequence
  Ebola virus siRNA sense strand
cgggccagcagccgagggaau

SEQ ID NO: 8725 - RNA, 21 nt, Artificial Sequence
  Ebola virus siRNA sense strand
gggccagcagccgagggaauu

SEQ ID NO: 8726 - RNA, 21 nt, Artificial Sequence
  Ebola virus siRNA sense strand
ggccagcagccgagggaauuu

SEQ ID NO: 8727 - RNA, 21 nt, Artificial Sequence
  Ebola virus siRNA sense strand
gccagcagccgagggaauuua

SEQ ID NO: 8728 - RNA, 21 nt, Artificial Sequence
  Ebola virus siRNA sense strand
ccagcagccgagggaauuuac

SEQ ID NO: 8729 - RNA, 21 nt, Artificial Sequence
  Ebola virus siRNA sense strand
cagcagccgagggaauuuaca

SEQ ID NO: 8730 - RNA, 21 nt, Artificial Sequence
  Ebola virus siRNA sense strand
agcagccgagggaauuuacau

SEQ ID NO: 8731 - RNA, 21 nt, Artificial Sequence
  Ebola virus siRNA sense strand
gcagccgagggaauuuacaua

SEQ ID NO: 8732 - RNA, 21 nt, Artificial Sequence
  Ebola virus siRNA sense strand
cagccgagggaauuuacauag

SEQ ID NO: 8733 - RNA, 21 nt, Artificial Sequence
  Ebola virus siRNA sense strand
agccgagggaauuuacauaga

SEQ ID NO: 8734 - RNA, 21 nt, Artificial Sequence
  Ebola virus siRNA sense strand
gccgagggaauuuacauagag

SEQ ID NO: 8735 - RNA, 21 nt, Artificial Sequence
  Ebola virus siRNA sense strand
ccgagggaauuuacauagagg

SEQ ID NO: 8736 - RNA, 21 nt, Artificial Sequence
  Ebola virus siRNA sense strand
cgagggaauuuacauagaggg

SEQ ID NO: 8737 - RNA, 21 nt, Artificial Sequence
  Ebola virus siRNA sense strand
gagggaauuuacauagagggg

SEQ ID NO: 8738 - RNA, 21 nt, Artificial Sequence
  Ebola virus siRNA sense strand
agggaauuuacauagaggggc

SEQ ID NO: 8739 - RNA, 21 nt, Artificial Sequence
  Ebola virus siRNA sense strand
gggaauuuacauagaggggcu

SEQ ID NO: 8740 - RNA, 21 nt, Artificial Sequence
  Ebola virus siRNA sense strand
ggaauuuacauagaggggcua

SEQ ID NO: 8741 - RNA, 21 nt, Artificial Sequence
  Ebola virus siRNA sense strand
gaauuuacauagaggggcuaa

SEQ ID NO: 8742 - RNA, 21 nt, Artificial Sequence
  Ebola virus siRNA sense strand
aauuuacauagaggggcuaau

SEQ ID NO: 8743 - RNA, 21 nt, Artificial Sequence
  Ebola virus siRNA sense strand
auuuacauagaggggcuaaug

SEQ ID NO: 8744 - RNA, 21 nt, Artificial Sequence
  Ebola virus siRNA sense strand
uuuacauagaggggcuaaugc

SEQ ID NO: 8745 - RNA, 21 nt, Artificial Sequence
  Ebola virus siRNA sense strand
uuacauagaggggcuaaugca

SEQ ID NO: 8746 - RNA, 21 nt, Artificial Sequence
  Ebola virus siRNA sense strand
uacauagaggggcuaaugcac

SEQ ID NO: 8747 - RNA, 21 nt, Artificial Sequence
  Ebola virus siRNA sense strand
acauagaggggcuaaugcaca

SEQ ID NO: 8748 - RNA, 21 nt, Artificial Sequence
  Ebola virus siRNA sense strand
cauagaggggcuaaugcacaa

SEQ ID NO: 8749 - RNA, 21 nt, Artificial Sequence
  Ebola virus siRNA sense strand
auagaggggcuaaugcacaau

SEQ ID NO: 8750 - RNA, 21 nt, Artificial Sequence
  Ebola virus siRNA sense strand
uagaggggcuaaugcacaauc

SEQ ID NO: 8751 - RNA, 21 nt, Artificial Sequence
  Ebola virus siRNA sense strand
agaggggcuaaugcacaauca

SEQ ID NO: 8752 - RNA, 21 nt, Artificial Sequence
  Ebola virus siRNA sense strand
gaggggcuaaugcacaaucaa

SEQ ID NO: 8753 - RNA, 21 nt, Artificial Sequence
  Ebola virus siRNA sense strand
aggggcuaaugcacaaucaag

SEQ ID NO: 8754 - RNA, 21 nt, Artificial Sequence
  Ebola virus siRNA sense strand
ggggcuaaugcacaaucaaga

SEQ ID NO: 8755 - RNA, 21 nt, Artificial Sequence
  Ebola virus siRNA sense strand
gggcuaaugcacaaucaagau

SEQ ID NO: 8756 - RNA, 21 nt, Artificial Sequence
  Ebola virus siRNA sense strand
ggcuaaugcacaaucaagaug

SEQ ID NO: 8757 - RNA, 21 nt, Artificial Sequence
  Ebola virus siRNA sense strand
gcuaaugcacaaucaagaugg

SEQ ID NO: 8758 - RNA, 21 nt, Artificial Sequence
  Ebola virus siRNA sense strand
cuaaugcacaaucaagauggu

SEQ ID NO: 8759 - RNA, 21 nt, Artificial Sequence
  Ebola virus siRNA sense strand
uaaugcacaaucaagaugguu

SEQ ID NO: 8760 - RNA, 21 nt, Artificial Sequence
  Ebola virus siRNA sense strand
aaugcacaaucaagaugguuu

SEQ ID NO: 8761 - RNA, 21 nt, Artificial Sequence
  Ebola virus siRNA sense strand
augcacaaucaagaugguuua

SEQ ID NO: 8762 - RNA, 21 nt, Artificial Sequence
  Ebola virus siRNA sense strand
ugcacaaucaagaugguuuaa

SEQ ID NO: 8763 - RNA, 21 nt, Artificial Sequence
  Ebola virus siRNA sense strand
gcacaaucaagaugguuuaau

SEQ ID NO: 8764 - RNA, 21 nt, Artificial Sequence
  Ebola virus siRNA sense strand
cacaaucaagaugguuuaauc

SEQ ID NO: 8765 - RNA, 21 nt, Artificial Sequence
  Ebola virus siRNA sense strand
acaaucaagaugguuuaaucu

SEQ ID NO: 8766 - RNA, 21 nt, Artificial Sequence
  Ebola virus siRNA sense strand
caaucaagaugguuuaaucug

SEQ ID NO: 8767 - RNA, 21 nt, Artificial Sequence
  Ebola virus siRNA sense strand
aaucaagaugguuuaaucugu

SEQ ID NO: 8768 - RNA, 21 nt, Artificial Sequence
  Ebola virus siRNA sense strand
aucaagaugguuuaaucugug

SEQ ID NO: 8769 - RNA, 21 nt, Artificial Sequence
  Ebola virus siRNA sense strand
ucaagaugguuuaaucugugg

SEQ ID NO: 8770 - RNA, 21 nt, Artificial Sequence
  Ebola virus siRNA sense strand
caagaugguuuaaucuguggg

SEQ ID NO: 8771 - RNA, 21 nt, Artificial Sequence
  Ebola virus siRNA sense strand
aagaugguuuaaucugugggu

SEQ ID NO: 8772 - RNA, 21 nt, Artificial Sequence
  Ebola virus siRNA sense strand
agaugguuuaaucuguggguu

SEQ ID NO: 8773 - RNA, 21 nt, Artificial Sequence
  Ebola virus siRNA sense strand
gaugguuuaaucuguggguug

SEQ ID NO: 8774 - RNA, 21 nt, Artificial Sequence
  Ebola virus siRNA sense strand
augguuuaaucuguggguuga

SEQ ID NO: 8775 - RNA, 21 nt, Artificial Sequence
  Ebola virus siRNA sense strand
ugguuuaaucuguggguugag

SEQ ID NO: 8776 - RNA, 21 nt, Artificial Sequence
  Ebola virus siRNA sense strand
gguuuaaucuguggguugaga

SEQ ID NO: 8777 - RNA, 21 nt, Artificial Sequence
  Ebola virus siRNA sense strand
guuuaaucuguggguugagac

SEQ ID NO: 8778 - RNA, 21 nt, Artificial Sequence
  Ebola virus siRNA sense strand
uuuaaucuguggguugagaca

SEQ ID NO: 8779 - RNA, 21 nt, Artificial Sequence
  Ebola virus siRNA sense strand
uuaaucuguggguugagacag

SEQ ID NO: 8780 - RNA, 21 nt, Artificial Sequence
  Ebola virus siRNA sense strand
uaaucuguggguugagacagc

SEQ ID NO: 8781 - RNA, 21 nt, Artificial Sequence
  Ebola virus siRNA sense strand
aaucuguggguugagacagcu

SEQ ID NO: 8782 - RNA, 21 nt, Artificial Sequence
  Ebola virus siRNA sense strand
aucuguggguugagacagcug

SEQ ID NO: 8783 - RNA, 21 nt, Artificial Sequence
  Ebola virus siRNA sense strand
ucuguggguugagacagcugg

SEQ ID NO: 8784 - RNA, 21 nt, Artificial Sequence
  Ebola virus siRNA sense strand
cuguggguugagacagcuggc

SEQ ID NO: 8785 - RNA, 21 nt, Artificial Sequence
  Ebola virus siRNA sense strand
uguggguugagacagcuggcc

SEQ ID NO: 8786 - RNA, 21 nt, Artificial Sequence
  Ebola virus siRNA sense strand
guggguugagacagcuggcca

SEQ ID NO: 8787 - RNA, 21 nt, Artificial Sequence
  Ebola virus siRNA sense strand
uggguugagacagcuggccaa

SEQ ID NO: 8788 - RNA, 21 nt, Artificial Sequence
  Ebola virus siRNA sense strand
ggguugagacagcuggccaac

SEQ ID NO: 8789 - RNA, 21 nt, Artificial Sequence
  Ebola virus siRNA sense strand
gguugagacagcuggccaacg

SEQ ID NO: 8790 - RNA, 21 nt, Artificial Sequence
  Ebola virus siRNA sense strand
guugagacagcuggccaacga

SEQ ID NO: 8791 - RNA, 21 nt, Artificial Sequence
  Ebola virus siRNA sense strand
uugagacagcuggccaacgag

SEQ ID NO: 8792 - RNA, 21 nt, Artificial Sequence
  Ebola virus siRNA sense strand
ugagacagcuggccaacgaga

SEQ ID NO: 8793 - RNA, 21 nt, Artificial Sequence
  Ebola virus siRNA sense strand
gagacagcuggccaacgagac

SEQ ID NO: 8794 - RNA, 21 nt, Artificial Sequence
  Ebola virus siRNA sense strand
agacagcuggccaacgagacg

SEQ ID NO: 8795 - RNA, 21 nt, Artificial Sequence
  Ebola virus siRNA sense strand
gacagcuggccaacgagacga

SEQ ID NO: 8796 - RNA, 21 nt, Artificial Sequence
  Ebola virus siRNA sense strand
acagcuggccaacgagacgac

SEQ ID NO: 8797 - RNA, 21 nt, Artificial Sequence
  Ebola virus siRNA sense strand
cagcuggccaacgagacgacu

SEQ ID NO: 8798 - RNA, 21 nt, Artificial Sequence
  Ebola virus siRNA sense strand
agcuggccaacgagacgacuc

SEQ ID NO: 8799 - RNA, 21 nt, Artificial Sequence
  Ebola virus siRNA sense strand
gcuggccaacgagacgacuca

SEQ ID NO: 8800 - RNA, 21 nt, Artificial Sequence
  Ebola virus siRNA sense strand
cuggccaacgagacgacucaa

SEQ ID NO: 8801 - RNA, 21 nt, Artificial Sequence
  Ebola virus siRNA sense strand
uggccaacgagacgacucaag

SEQ ID NO: 8802 - RNA, 21 nt, Artificial Sequence
  Ebola virus siRNA sense strand
ggccaacgagacgacucaagc

SEQ ID NO: 8803 - RNA, 21 nt, Artificial Sequence
  Ebola virus siRNA sense strand
gccaacgagacgacucaagcu

SEQ ID NO: 8804 - RNA, 21 nt, Artificial Sequence
  Ebola virus siRNA sense strand
ccaacgagacgacucaagcuc

SEQ ID NO: 8805 - RNA, 21 nt, Artificial Sequence
  Ebola virus siRNA sense strand
caacgagacgacucaagcucu

SEQ ID NO: 8806 - RNA, 21 nt, Artificial Sequence
  Ebola virus siRNA sense strand
aacgagacgacucaagcucuu

SEQ ID NO: 8807 - RNA, 21 nt, Artificial Sequence
  Ebola virus siRNA sense strand
acgagacgacucaagcucuuc

SEQ ID NO: 8808 - RNA, 21 nt, Artificial Sequence
  Ebola virus siRNA sense strand
cgagacgacucaagcucuuca

SEQ ID NO: 8809 - RNA, 21 nt, Artificial Sequence
  Ebola virus siRNA sense strand
gagacgacucaagcucuucaa

SEQ ID NO: 8810 - RNA, 21 nt, Artificial Sequence
  Ebola virus siRNA sense strand
agacgacucaagcucuucaac

SEQ ID NO: 8811 - RNA, 21 nt, Artificial Sequence
  Ebola virus siRNA sense strand
gacgacucaagcucuucaacu

SEQ ID NO: 8812 - RNA, 21 nt, Artificial Sequence
  Ebola virus siRNA sense strand
acgacucaagcucuucaacug

SEQ ID NO: 8813 - RNA, 21 nt, Artificial Sequence
  Ebola virus siRNA sense strand
cgacucaagcucuucaacugu

SEQ ID NO: 8814 - RNA, 21 nt, Artificial Sequence
  Ebola virus siRNA sense strand
gacucaagcucuucaacuguu

SEQ ID NO: 8815 - RNA, 21 nt, Artificial Sequence
  Ebola virus siRNA sense strand
acucaagcucuucaacuguuc

SEQ ID NO: 8816 - RNA, 21 nt, Artificial Sequence
  Ebola virus siRNA sense strand
cucaagcucuucaacuguucc

SEQ ID NO: 8817 - RNA, 21 nt, Artificial Sequence
  Ebola virus siRNA sense strand
ucaagcucuucaacuguuccu

SEQ ID NO: 8818 - RNA, 21 nt, Artificial Sequence
  Ebola virus siRNA sense strand
caagcucuucaacuguuccug

SEQ ID NO: 8819 - RNA, 21 nt, Artificial Sequence
  Ebola virus siRNA sense strand
aagcucuucaacuguuccuga

SEQ ID NO: 8820 - RNA, 21 nt, Artificial Sequence
  Ebola virus siRNA sense strand
agcucuucaacuguuccugag

SEQ ID NO: 8821 - RNA, 21 nt, Artificial Sequence
  Ebola virus siRNA sense strand
gcucuucaacuguuccugaga

SEQ ID NO: 8822 - RNA, 21 nt, Artificial Sequence
  Ebola virus siRNA sense strand
cucuucaacuguuccugagag

SEQ ID NO: 8823 - RNA, 21 nt, Artificial Sequence
  Ebola virus siRNA sense strand
ucuucaacuguuccugagagc

SEQ ID NO: 8824 - RNA, 21 nt, Artificial Sequence
  Ebola virus siRNA sense strand
cuucaacuguuccugagagcc

SEQ ID NO: 8825 - RNA, 21 nt, Artificial Sequence
  Ebola virus siRNA sense strand
uucaacuguuccugagagcca

SEQ ID NO: 8826 - RNA, 21 nt, Artificial Sequence
  Ebola virus siRNA sense strand
ucaacuguuccugagagccac

SEQ ID NO: 8827 - RNA, 21 nt, Artificial Sequence
  Ebola virus siRNA sense strand
caacuguuccugagagccaca

SEQ ID NO: 8828 - RNA, 21 nt, Artificial Sequence
  Ebola virus siRNA sense strand
aacuguuccugagagccacaa

SEQ ID NO: 8829 - RNA, 21 nt, Artificial Sequence
  Ebola virus siRNA sense strand
acuguuccugagagccacaac

SEQ ID NO: 8830 - RNA, 21 nt, Artificial Sequence
  Ebola virus siRNA sense strand
cuguuccugagagccacaacu

SEQ ID NO: 8831 - RNA, 21 nt, Artificial Sequence
  Ebola virus siRNA sense strand
uguuccugagagccacaacug

SEQ ID NO: 8832 - RNA, 21 nt, Artificial Sequence
  Ebola virus siRNA sense strand
guuccugagagccacaacuga

SEQ ID NO: 8833 - RNA, 21 nt, Artificial Sequence
  Ebola virus siRNA sense strand
uuccugagagccacaacugag

SEQ ID NO: 8834 - RNA, 21 nt, Artificial Sequence
  Ebola virus siRNA sense strand
uccugagagccacaacugagc

SEQ ID NO: 8835 - RNA, 21 nt, Artificial Sequence
  Ebola virus siRNA sense strand
ccugagagccacaacugagcu

SEQ ID NO: 8836 - RNA, 21 nt, Artificial Sequence
  Ebola virus siRNA sense strand
cugagagccacaacugagcua

SEQ ID NO: 8837 - RNA, 21 nt, Artificial Sequence
  Ebola virus siRNA sense strand
ugagagccacaacugagcuac

SEQ ID NO: 8838 - RNA, 21 nt, Artificial Sequence
  Ebola virus siRNA sense strand
gagagccacaacugagcuacg

SEQ ID NO: 8839 - RNA, 21 nt, Artificial Sequence
  Ebola virus siRNA sense strand
agagccacaacugagcuacgc

SEQ ID NO: 8840 - RNA, 21 nt, Artificial Sequence
  Ebola virus siRNA sense strand
gagccacaacugagcuacgca

SEQ ID NO: 8841 - RNA, 21 nt, Artificial Sequence
  Ebola virus siRNA sense strand
agccacaacugagcuacgcac

SEQ ID NO: 8842 - RNA, 21 nt, Artificial Sequence
  Ebola virus siRNA sense strand
gccacaacugagcuacgcacc

SEQ ID NO: 8843 - RNA, 21 nt, Artificial Sequence
  Ebola virus siRNA sense strand
ccacaacugagcuacgcaccu

SEQ ID NO: 8844 - RNA, 21 nt, Artificial Sequence
  Ebola virus siRNA sense strand
cacaacugagcuacgcaccuu

SEQ ID NO: 8845 - RNA, 21 nt, Artificial Sequence
  Ebola virus siRNA sense strand
acaacugagcuacgcaccuuu

SEQ ID NO: 8846 - RNA, 21 nt, Artificial Sequence
  Ebola virus siRNA sense strand
caacugagcuacgcaccuuuu

SEQ ID NO: 8847 - RNA, 21 nt, Artificial Sequence
  Ebola virus siRNA sense strand
aacugagcuacgcaccuuuuc

SEQ ID NO: 8848 - RNA, 21 nt, Artificial Sequence
  Ebola virus siRNA sense strand
acugagcuacgcaccuuuuca

SEQ ID NO: 8849 - RNA, 21 nt, Artificial Sequence
  Ebola virus siRNA sense strand
cugagcuacgcaccuuuucaa

SEQ ID NO: 8850 - RNA, 21 nt, Artificial Sequence
  Ebola virus siRNA sense strand
ugagcuacgcaccuuuucaau

SEQ ID NO: 8851 - RNA, 21 nt, Artificial Sequence
  Ebola virus siRNA sense strand
gagcuacgcaccuuuucaauc

SEQ ID NO: 8852 - RNA, 21 nt, Artificial Sequence
  Ebola virus siRNA sense strand
agcuacgcaccuuuucaaucc

SEQ ID NO: 8853 - RNA, 21 nt, Artificial Sequence
  Ebola virus siRNA sense strand
gcuacgcaccuuuucaauccu

SEQ ID NO: 8854 - RNA, 21 nt, Artificial Sequence
  Ebola virus siRNA sense strand
cuacgcaccuuuucaauccuc

SEQ ID NO: 8855 - RNA, 21 nt, Artificial Sequence
  Ebola virus siRNA sense strand
uacgcaccuuuucaauccuca

SEQ ID NO: 8856 - RNA, 21 nt, Artificial Sequence
  Ebola virus siRNA sense strand
acgcaccuuuucaauccucaa

SEQ ID NO: 8857 - RNA, 21 nt, Artificial Sequence
  Ebola virus siRNA sense strand
cgcaccuuuucaauccucaac

SEQ ID NO: 8858 - RNA, 21 nt, Artificial Sequence
  Ebola virus siRNA sense strand
gcaccuuuucaauccucaacc

SEQ ID NO: 8859 - RNA, 21 nt, Artificial Sequence
  Ebola virus siRNA sense strand
caccuuuucaauccucaaccg

SEQ ID NO: 8860 - RNA, 21 nt, Artificial Sequence
  Ebola virus siRNA sense strand
accuuuucaauccucaaccgu

SEQ ID NO: 8861 - RNA, 21 nt, Artificial Sequence
  Ebola virus siRNA sense strand
ccuuuucaauccucaaccgua

SEQ ID NO: 8862 - RNA, 21 nt, Artificial Sequence
  Ebola virus siRNA sense strand
cuuuucaauccucaaccguaa

SEQ ID NO: 8863 - RNA, 21 nt, Artificial Sequence
  Ebola virus siRNA sense strand
uuuucaauccucaaccguaag

SEQ ID NO: 8864 - RNA, 21 nt, Artificial Sequence
  Ebola virus siRNA sense strand
uuucaauccucaaccguaagg

SEQ ID NO: 8865 - RNA, 21 nt, Artificial Sequence
  Ebola virus siRNA sense strand
uucaauccucaaccguaaggc

SEQ ID NO: 8866 - RNA, 21 nt, Artificial Sequence
  Ebola virus siRNA sense strand
ucaauccucaaccguaaggca

SEQ ID NO: 8867 - RNA, 21 nt, Artificial Sequence
  Ebola virus siRNA sense strand
caauccucaaccguaaggcaa

SEQ ID NO: 8868 - RNA, 21 nt, Artificial Sequence
  Ebola virus siRNA sense strand
aauccucaaccguaaggcaau

SEQ ID NO: 8869 - RNA, 21 nt, Artificial Sequence
  Ebola virus siRNA sense strand
auccucaaccguaaggcaauu

SEQ ID NO: 8870 - RNA, 21 nt, Artificial Sequence
  Ebola virus siRNA sense strand
uccucaaccguaaggcaauug

SEQ ID NO: 8871 - RNA, 21 nt, Artificial Sequence
  Ebola virus siRNA sense strand
ccucaaccguaaggcaauuga

SEQ ID NO: 8872 - RNA, 21 nt, Artificial Sequence
  Ebola virus siRNA sense strand
cucaaccguaaggcaauugau

SEQ ID NO: 8873 - RNA, 21 nt, Artificial Sequence
  Ebola virus siRNA sense strand
ucaaccguaaggcaauugauu

SEQ ID NO: 8874 - RNA, 21 nt, Artificial Sequence
  Ebola virus siRNA sense strand
caaccguaaggcaauugauuu

SEQ ID NO: 8875 - RNA, 21 nt, Artificial Sequence
  Ebola virus siRNA sense strand
aaccguaaggcaauugauuuc

SEQ ID NO: 8876 - RNA, 21 nt, Artificial Sequence
  Ebola virus siRNA sense strand
accguaaggcaauugauuucu

SEQ ID NO: 8877 - RNA, 21 nt, Artificial Sequence
  Ebola virus siRNA sense strand
ccguaaggcaauugauuucuu

SEQ ID NO: 8878 - RNA, 21 nt, Artificial Sequence
  Ebola virus siRNA sense strand
cguaaggcaauugauuucuug

SEQ ID NO: 8879 - RNA, 21 nt, Artificial Sequence
  Ebola virus siRNA sense strand
guaaggcaauugauuucuugc

SEQ ID NO: 8880 - RNA, 21 nt, Artificial Sequence
  Ebola virus siRNA sense strand
uaaggcaauugauuucuugcu

SEQ ID NO: 8881 - RNA, 21 nt, Artificial Sequence
  Ebola virus siRNA sense strand
aaggcaauugauuucuugcug

SEQ ID NO: 8882 - RNA, 21 nt, Artificial Sequence
  Ebola virus siRNA sense strand
aggcaauugauuucuugcugc

SEQ ID NO: 8883 - RNA, 21 nt, Artificial Sequence
  Ebola virus siRNA sense strand
ggcaauugauuucuugcugca

SEQ ID NO: 8884 - RNA, 21 nt, Artificial Sequence
  Ebola virus siRNA sense strand
gcaauugauuucuugcugcag

SEQ ID NO: 8885 - RNA, 21 nt, Artificial Sequence
  Ebola virus siRNA sense strand
caauugauuucuugcugcagc

SEQ ID NO: 8886 - RNA, 21 nt, Artificial Sequence
  Ebola virus siRNA sense strand
aauugauuucuugcugcagcg

SEQ ID NO: 8887 - RNA, 21 nt, Artificial Sequence
  Ebola virus siRNA sense strand
auugauuucuugcugcagcga

SEQ ID NO: 8888 - RNA, 21 nt, Artificial Sequence
  Ebola virus siRNA sense strand
uugauuucuugcugcagcgau

SEQ ID NO: 8889 - RNA, 21 nt, Artificial Sequence
  Ebola virus siRNA sense strand
ugauuucuugcugcagcgaug

SEQ ID NO: 8890 - RNA, 21 nt, Artificial Sequence
  Ebola virus siRNA sense strand
gauuucuugcugcagcgaugg

SEQ ID NO: 8891 - RNA, 21 nt, Artificial Sequence
  Ebola virus siRNA sense strand
auuucuugcugcagcgauggg

SEQ ID NO: 8892 - RNA, 21 nt, Artificial Sequence
  Ebola virus siRNA sense strand
uuucuugcugcagcgaugggg

SEQ ID NO: 8893 - RNA, 21 nt, Artificial Sequence
  Ebola virus siRNA sense strand
uucuugcugcagcgauggggc

SEQ ID NO: 8894 - RNA, 21 nt, Artificial Sequence
  Ebola virus siRNA sense strand
ucuugcugcagcgauggggcg

SEQ ID NO: 8895 - RNA, 21 nt, Artificial Sequence
  Ebola virus siRNA sense strand
cuugcugcagcgauggggcgg

SEQ ID NO: 8896 - RNA, 21 nt, Artificial Sequence
  Ebola virus siRNA sense strand
uugcugcagcgauggggcggc

SEQ ID NO: 8897 - RNA, 21 nt, Artificial Sequence
  Ebola virus siRNA sense strand
ugcugcagcgauggggcggca

SEQ ID NO: 8898 - RNA, 21 nt, Artificial Sequence
  Ebola virus siRNA sense strand
gcugcagcgauggggcggcac

SEQ ID NO: 8899 - RNA, 21 nt, Artificial Sequence
  Ebola virus siRNA sense strand
cugcagcgauggggcggcaca

SEQ ID NO: 8900 - RNA, 21 nt, Artificial Sequence
  Ebola virus siRNA sense strand
ugcagcgauggggcggcacau

SEQ ID NO: 8901 - RNA, 21 nt, Artificial Sequence
  Ebola virus siRNA sense strand
gcagcgauggggcggcacaug

SEQ ID NO: 8902 - RNA, 21 nt, Artificial Sequence
  Ebola virus siRNA sense strand
cagcgauggggcggcacaugc

SEQ ID NO: 8903 - RNA, 21 nt, Artificial Sequence
  Ebola virus siRNA sense strand
agcgauggggcggcacaugcc

SEQ ID NO: 8904 - RNA, 21 nt, Artificial Sequence
  Ebola virus siRNA sense strand
gcgauggggcggcacaugcca

SEQ ID NO: 8905 - RNA, 21 nt, Artificial Sequence
  Ebola virus siRNA sense strand
cgauggggcggcacaugccac

SEQ ID NO: 8906 - RNA, 21 nt, Artificial Sequence
  Ebola virus siRNA sense strand
gauggggcggcacaugccaca

SEQ ID NO: 8907 - RNA, 21 nt, Artificial Sequence
  Ebola virus siRNA sense strand
auggggcggcacaugccacau

SEQ ID NO: 8908 - RNA, 21 nt, Artificial Sequence
  Ebola virus siRNA sense strand
uggggcggcacaugccacauu

SEQ ID NO: 8909 - RNA, 21 nt, Artificial Sequence
  Ebola virus siRNA sense strand
ggggcggcacaugccacauuc

SEQ ID NO: 8910 - RNA, 21 nt, Artificial Sequence
  Ebola virus siRNA sense strand
gggcggcacaugccacauucu

SEQ ID NO: 8911 - RNA, 21 nt, Artificial Sequence
  Ebola virus siRNA sense strand
ggcggcacaugccacauucug

SEQ ID NO: 8912 - RNA, 21 nt, Artificial Sequence
  Ebola virus siRNA sense strand
gcggcacaugccacauucugg

SEQ ID NO: 8913 - RNA, 21 nt, Artificial Sequence
  Ebola virus siRNA sense strand
cggcacaugccacauucuggg

SEQ ID NO: 8914 - RNA, 21 nt, Artificial Sequence
  Ebola virus siRNA sense strand
ggcacaugccacauucuggga

SEQ ID NO: 8915 - RNA, 21 nt, Artificial Sequence
  Ebola virus siRNA sense strand
gcacaugccacauucugggac

SEQ ID NO: 8916 - RNA, 21 nt, Artificial Sequence
  Ebola virus siRNA sense strand
cacaugccacauucugggacc

SEQ ID NO: 8917 - RNA, 21 nt, Artificial Sequence
  Ebola virus siRNA sense strand
acaugccacauucugggaccg

SEQ ID NO: 8918 - RNA, 21 nt, Artificial Sequence
  Ebola virus siRNA sense strand
caugccacauucugggaccgg

SEQ ID NO: 8919 - RNA, 21 nt, Artificial Sequence
  Ebola virus siRNA sense strand
augccacauucugggaccgga

SEQ ID NO: 8920 - RNA, 21 nt, Artificial Sequence
  Ebola virus siRNA sense strand
ugccacauucugggaccggac

SEQ ID NO: 8921 - RNA, 21 nt, Artificial Sequence
  Ebola virus siRNA sense strand
gccacauucugggaccggacu

SEQ ID NO: 8922 - RNA, 21 nt, Artificial Sequence
  Ebola virus siRNA sense strand
ccacauucugggaccggacug

SEQ ID NO: 8923 - RNA, 21 nt, Artificial Sequence
  Ebola virus siRNA sense strand
cacauucugggaccggacugc

SEQ ID NO: 8924 - RNA, 21 nt, Artificial Sequence
  Ebola virus siRNA sense strand
acauucugggaccggacugcu

SEQ ID NO: 8925 - RNA, 21 nt, Artificial Sequence
  Ebola virus siRNA sense strand
cauucugggaccggacugcug

SEQ ID NO: 8926 - RNA, 21 nt, Artificial Sequence
  Ebola virus siRNA sense strand
auucugggaccggacugcugu

SEQ ID NO: 8927 - RNA, 21 nt, Artificial Sequence
  Ebola virus siRNA sense strand
uucugggaccggacugcugua

SEQ ID NO: 8928 - RNA, 21 nt, Artificial Sequence
  Ebola virus siRNA sense strand
ucugggaccggacugcuguau

SEQ ID NO: 8929 - RNA, 21 nt, Artificial Sequence
  Ebola virus siRNA sense strand
cugggaccggacugcuguauc

SEQ ID NO: 8930 - RNA, 21 nt, Artificial Sequence
  Ebola virus siRNA sense strand
ugggaccggacugcuguaucg

SEQ ID NO: 8931 - RNA, 21 nt, Artificial Sequence
  Ebola virus siRNA sense strand
gggaccggacugcuguaucga

SEQ ID NO: 8932 - RNA, 21 nt, Artificial Sequence
  Ebola virus siRNA sense strand
ggaccggacugcuguaucgaa

SEQ ID NO: 8933 - RNA, 21 nt, Artificial Sequence
  Ebola virus siRNA sense strand
gaccggacugcuguaucgaac

SEQ ID NO: 8934 - RNA, 21 nt, Artificial Sequence
  Ebola virus siRNA sense strand
accggacugcuguaucgaacc

SEQ ID NO: 8935 - RNA, 21 nt, Artificial Sequence
  Ebola virus siRNA sense strand
ccggacugcuguaucgaacca

SEQ ID NO: 8936 - RNA, 21 nt, Artificial Sequence
  Ebola virus siRNA sense strand
cggacugcuguaucgaaccac

SEQ ID NO: 8937 - RNA, 21 nt, Artificial Sequence
  Ebola virus siRNA sense strand
ggacugcuguaucgaaccaca

SEQ ID NO: 8938 - RNA, 21 nt, Artificial Sequence
  Ebola virus siRNA sense strand
gacugcuguaucgaaccacau

SEQ ID NO: 8939 - RNA, 21 nt, Artificial Sequence
  Ebola virus siRNA sense strand
acugcuguaucgaaccacaug

SEQ ID NO: 8940 - RNA, 21 nt, Artificial Sequence
  Ebola virus siRNA sense strand
cugcuguaucgaaccacauga

SEQ ID NO: 8941 - RNA, 21 nt, Artificial Sequence
  Ebola virus siRNA sense strand
ugcuguaucgaaccacaugau

SEQ ID NO: 8942 - RNA, 21 nt, Artificial Sequence
  Ebola virus siRNA sense strand
gcuguaucgaaccacaugauu

SEQ ID NO: 8943 - RNA, 21 nt, Artificial Sequence
  Ebola virus siRNA sense strand
cuguaucgaaccacaugauug

SEQ ID NO: 8944 - RNA, 21 nt, Artificial Sequence
  Ebola virus siRNA sense strand
uguaucgaaccacaugauugg

SEQ ID NO: 8945 - RNA, 21 nt, Artificial Sequence
  Ebola virus siRNA sense strand
guaucgaaccacaugauugga

SEQ ID NO: 8946 - RNA, 21 nt, Artificial Sequence
  Ebola virus siRNA sense strand
uaucgaaccacaugauuggac

SEQ ID NO: 8947 - RNA, 21 nt, Artificial Sequence
  Ebola virus siRNA sense strand
aucgaaccacaugauuggacc

SEQ ID NO: 8948 - RNA, 21 nt, Artificial Sequence
  Ebola virus siRNA sense strand
ucgaaccacaugauuggacca

SEQ ID NO: 8949 - RNA, 21 nt, Artificial Sequence
  Ebola virus siRNA sense strand
cgaaccacaugauuggaccaa

SEQ ID NO: 8950 - RNA, 21 nt, Artificial Sequence
  Ebola virus siRNA sense strand
gaaccacaugauuggaccaag

SEQ ID NO: 8951 - RNA, 21 nt, Artificial Sequence
  Ebola virus siRNA sense strand
aaccacaugauuggaccaaga

SEQ ID NO: 8952 - RNA, 21 nt, Artificial Sequence
  Ebola virus siRNA sense strand
accacaugauuggaccaagaa

SEQ ID NO: 8953 - RNA, 21 nt, Artificial Sequence
  Ebola virus siRNA sense strand
ccacaugauuggaccaagaac

SEQ ID NO: 8954 - RNA, 21 nt, Artificial Sequence
  Ebola virus siRNA sense strand
cacaugauuggaccaagaaca

SEQ ID NO: 8955 - RNA, 21 nt, Artificial Sequence
  Ebola virus siRNA sense strand
acaugauuggaccaagaacau

SEQ ID NO: 8956 - RNA, 21 nt, Artificial Sequence
  Ebola virus siRNA sense strand
caugauuggaccaagaacaua

SEQ ID NO: 8957 - RNA, 21 nt, Artificial Sequence
  Ebola virus siRNA sense strand
augauuggaccaagaacauaa

SEQ ID NO: 8958 - RNA, 21 nt, Artificial Sequence
  Ebola virus siRNA sense strand
ugauuggaccaagaacauaac

SEQ ID NO: 8959 - RNA, 21 nt, Artificial Sequence
  Ebola virus siRNA sense strand
gauuggaccaagaacauaaca

SEQ ID NO: 8960 - RNA, 21 nt, Artificial Sequence
  Ebola virus siRNA sense strand
auuggaccaagaacauaacag

SEQ ID NO: 8961 - RNA, 21 nt, Artificial Sequence
  Ebola virus siRNA sense strand
uuggaccaagaacauaacaga

SEQ ID NO: 8962 - RNA, 21 nt, Artificial Sequence
  Ebola virus siRNA sense strand
uggaccaagaacauaacagac

SEQ ID NO: 8963 - RNA, 21 nt, Artificial Sequence
  Ebola virus siRNA sense strand
ggaccaagaacauaacagaca

SEQ ID NO: 8964 - RNA, 21 nt, Artificial Sequence
  Ebola virus siRNA sense strand
gaccaagaacauaacagacaa

SEQ ID NO: 8965 - RNA, 21 nt, Artificial Sequence
  Ebola virus siRNA sense strand
accaagaacauaacagacaaa

SEQ ID NO: 8966 - RNA, 21 nt, Artificial Sequence
  Ebola virus siRNA sense strand
ccaagaacauaacagacaaaa

SEQ ID NO: 8967 - RNA, 21 nt, Artificial Sequence
  Ebola virus siRNA sense strand
caagaacauaacagacaaaau

SEQ ID NO: 8968 - RNA, 21 nt, Artificial Sequence
  Ebola virus siRNA sense strand
aagaacauaacagacaaaauu

SEQ ID NO: 8969 - RNA, 21 nt, Artificial Sequence
  Ebola virus siRNA sense strand
agaacauaacagacaaaauug

SEQ ID NO: 8970 - RNA, 21 nt, Artificial Sequence
  Ebola virus siRNA sense strand
gaacauaacagacaaaauuga

SEQ ID NO: 8971 - RNA, 21 nt, Artificial Sequence
  Ebola virus siRNA sense strand
aacauaacagacaaaauugau

SEQ ID NO: 8972 - RNA, 21 nt, Artificial Sequence
  Ebola virus siRNA sense strand
acauaacagacaaaauugauc

SEQ ID NO: 8973 - RNA, 21 nt, Artificial Sequence
  Ebola virus siRNA sense strand
cauaacagacaaaauugauca

SEQ ID NO: 8974 - RNA, 21 nt, Artificial Sequence
  Ebola virus siRNA sense strand
auaacagacaaaauugaucag

SEQ ID NO: 8975 - RNA, 21 nt, Artificial Sequence
  Ebola virus siRNA sense strand
uaacagacaaaauugaucaga

SEQ ID NO: 8976 - RNA, 21 nt, Artificial Sequence
  Ebola virus siRNA sense strand
aacagacaaaauugaucagau

SEQ ID NO: 8977 - RNA, 21 nt, Artificial Sequence
  Ebola virus siRNA sense strand
acagacaaaauugaucagauu

SEQ ID NO: 8978 - RNA, 21 nt, Artificial Sequence
  Ebola virus siRNA sense strand
cagacaaaauugaucagauua

SEQ ID NO: 8979 - RNA, 21 nt, Artificial Sequence
  Ebola virus siRNA sense strand
agacaaaauugaucagauuau

SEQ ID NO: 8980 - RNA, 21 nt, Artificial Sequence
  Ebola virus siRNA sense strand
gacaaaauugaucagauuauu

SEQ ID NO: 8981 - RNA, 21 nt, Artificial Sequence
  Ebola virus siRNA sense strand
acaaaauugaucagauuauuc

SEQ ID NO: 8982 - RNA, 21 nt, Artificial Sequence
  Ebola virus siRNA sense strand
caaaauugaucagauuauuca

SEQ ID NO: 8983 - RNA, 21 nt, Artificial Sequence
  Ebola virus siRNA sense strand
aaaauugaucagauuauucau

SEQ ID NO: 8984 - RNA, 21 nt, Artificial Sequence
  Ebola virus siRNA sense strand
aaauugaucagauuauucaug

SEQ ID NO: 8985 - RNA, 21 nt, Artificial Sequence
  Ebola virus siRNA sense strand
aauugaucagauuauucauga

SEQ ID NO: 8986 - RNA, 21 nt, Artificial Sequence
  Ebola virus siRNA sense strand
auugaucagauuauucaugau

SEQ ID NO: 8987 - RNA, 21 nt, Artificial Sequence
  Ebola virus siRNA sense strand
uugaucagauuauucaugauu

SEQ ID NO: 8988 - RNA, 21 nt, Artificial Sequence
  Ebola virus siRNA sense strand
ugaucagauuauucaugauuu

SEQ ID NO: 8989 - RNA, 21 nt, Artificial Sequence
  Ebola virus siRNA sense strand
gaucagauuauucaugauuuu

SEQ ID NO: 8990 - RNA, 21 nt, Artificial Sequence
  Ebola virus siRNA sense strand
aucagauuauucaugauuuug

SEQ ID NO: 8991 - RNA, 21 nt, Artificial Sequence
  Ebola virus siRNA sense strand
ucagauuauucaugauuuugu

SEQ ID NO: 8992 - RNA, 21 nt, Artificial Sequence
  Ebola virus siRNA sense strand
cagauuauucaugauuuuguu

SEQ ID NO: 8993 - RNA, 21 nt, Artificial Sequence
  Ebola virus siRNA sense strand
agauuauucaugauuuuguug

SEQ ID NO: 8994 - RNA, 21 nt, Artificial Sequence
  Ebola virus siRNA sense strand
gauuauucaugauuuuguuga

SEQ ID NO: 8995 - RNA, 21 nt, Artificial Sequence
  Ebola virus siRNA sense strand
auuauucaugauuuuguugau

SEQ ID NO: 8996 - RNA, 21 nt, Artificial Sequence
  Ebola virus siRNA sense strand
uuauucaugauuuuguugaua

SEQ ID NO: 8997 - RNA, 21 nt, Artificial Sequence
  Ebola virus siRNA sense strand
uauucaugauuuuguugauaa

SEQ ID NO: 8998 - RNA, 21 nt, Artificial Sequence
  Ebola virus siRNA sense strand
auucaugauuuuguugauaaa

SEQ ID NO: 8999 - RNA, 21 nt, Artificial Sequence
  Ebola virus siRNA sense strand
uucaugauuuuguugauaaaa

SEQ ID NO: 9000 - RNA, 21 nt, Artificial Sequence
  Ebola virus siRNA sense strand
ucaugauuuuguugauaaaac

SEQ ID NO: 9001 - RNA, 21 nt, Artificial Sequence
  Ebola virus siRNA sense strand
caugauuuuguugauaaaacc

SEQ ID NO: 9002 - RNA, 21 nt, Artificial Sequence
  Ebola virus siRNA sense strand
augauuuuguugauaaaaccc

SEQ ID NO: 9003 - RNA, 21 nt, Artificial Sequence
  Ebola virus siRNA sense strand
ugauuuuguugauaaaacccu

SEQ ID NO: 9004 - RNA, 21 nt, Artificial Sequence
  Ebola virus siRNA sense strand
gauuuuguugauaaaacccuu

SEQ ID NO: 9005 - RNA, 21 nt, Artificial Sequence
  Ebola virus siRNA sense strand
auuuuguugauaaaacccuuc

SEQ ID NO: 9006 - RNA, 21 nt, Artificial Sequence
  Ebola virus siRNA sense strand
uuuuguugauaaaacccuucc

SEQ ID NO: 9007 - RNA, 21 nt, Artificial Sequence
  Ebola virus siRNA sense strand
uuuguugauaaaacccuuccg

SEQ ID NO: 9008 - RNA, 21 nt, Artificial Sequence
  Ebola virus siRNA sense strand
uuguugauaaaacccuuccgg

SEQ ID NO: 9009 - RNA, 21 nt, Artificial Sequence
  Ebola virus siRNA sense strand
uguugauaaaacccuuccgga

SEQ ID NO: 9010 - RNA, 21 nt, Artificial Sequence
  Ebola virus siRNA sense strand
guugauaaaacccuuccggac

SEQ ID NO: 9011 - RNA, 21 nt, Artificial Sequence
  Ebola virus siRNA sense strand
uugauaaaacccuuccggacc

SEQ ID NO: 9012 - RNA, 21 nt, Artificial Sequence
  Ebola virus siRNA sense strand
ugauaaaacccuuccggacca

SEQ ID NO: 9013 - RNA, 21 nt, Artificial Sequence
  Ebola virus siRNA sense strand
gauaaaacccuuccggaccag

SEQ ID NO: 9014 - RNA, 21 nt, Artificial Sequence
  Ebola virus siRNA sense strand
auaaaacccuuccggaccagg

SEQ ID NO: 9015 - RNA, 21 nt, Artificial Sequence
  Ebola virus siRNA sense strand
uaaaacccuuccggaccaggg

SEQ ID NO: 9016 - RNA, 21 nt, Artificial Sequence
  Ebola virus siRNA sense strand
aaaacccuuccggaccagggg

SEQ ID NO: 9017 - RNA, 21 nt, Artificial Sequence
  Ebola virus siRNA sense strand
aaacccuuccggaccaggggg

SEQ ID NO: 9018 - RNA, 21 nt, Artificial Sequence
  Ebola virus siRNA sense strand
aacccuuccggaccaggggga

SEQ ID NO: 9019 - RNA, 21 nt, Artificial Sequence
  Ebola virus siRNA sense strand
acccuuccggaccagggggac

SEQ ID NO: 9020 - RNA, 21 nt, Artificial Sequence
  Ebola virus siRNA sense strand
cccuuccggaccagggggaca

SEQ ID NO: 9021 - RNA, 21 nt, Artificial Sequence
  Ebola virus siRNA sense strand
ccuuccggaccagggggacaa

SEQ ID NO: 9022 - RNA, 21 nt, Artificial Sequence
  Ebola virus siRNA sense strand
cuuccggaccagggggacaau

SEQ ID NO: 9023 - RNA, 21 nt, Artificial Sequence
  Ebola virus siRNA sense strand
uuccggaccagggggacaaug

SEQ ID NO: 9024 - RNA, 21 nt, Artificial Sequence
  Ebola virus siRNA sense strand
uccggaccagggggacaauga

SEQ ID NO: 9025 - RNA, 21 nt, Artificial Sequence
  Ebola virus siRNA sense strand
ccggaccagggggacaaugac

SEQ ID NO: 9026 - RNA, 21 nt, Artificial Sequence
  Ebola virus siRNA sense strand
cggaccagggggacaaugaca

SEQ ID NO: 9027 - RNA, 21 nt, Artificial Sequence
  Ebola virus siRNA sense strand
ggaccagggggacaaugacaa

SEQ ID NO: 9028 - RNA, 21 nt, Artificial Sequence
  Ebola virus siRNA sense strand
gaccagggggacaaugacaau

SEQ ID NO: 9029 - RNA, 21 nt, Artificial Sequence
  Ebola virus siRNA sense strand
accagggggacaaugacaauu

SEQ ID NO: 9030 - RNA, 21 nt, Artificial Sequence
  Ebola virus siRNA sense strand
ccagggggacaaugacaauug

SEQ ID NO: 9031 - RNA, 21 nt, Artificial Sequence
  Ebola virus siRNA sense strand
cagggggacaaugacaauugg

SEQ ID NO: 9032 - RNA, 21 nt, Artificial Sequence
  Ebola virus siRNA sense strand
agggggacaaugacaauuggu

SEQ ID NO: 9033 - RNA, 21 nt, Artificial Sequence
  Ebola virus siRNA sense strand
gggggacaaugacaauuggug

SEQ ID NO: 9034 - RNA, 21 nt, Artificial Sequence
  Ebola virus siRNA sense strand
ggggacaaugacaauuggugg

SEQ ID NO: 9035 - RNA, 21 nt, Artificial Sequence
  Ebola virus siRNA sense strand
gggacaaugacaauuggugga

SEQ ID NO: 9036 - RNA, 21 nt, Artificial Sequence
  Ebola virus siRNA sense strand
ggacaaugacaauugguggac

SEQ ID NO: 9037 - RNA, 21 nt, Artificial Sequence
  Ebola virus siRNA sense strand
gacaaugacaauugguggaca

SEQ ID NO: 9038 - RNA, 21 nt, Artificial Sequence
  Ebola virus siRNA sense strand
acaaugacaauugguggacag

SEQ ID NO: 9039 - RNA, 21 nt, Artificial Sequence
  Ebola virus siRNA sense strand
caaugacaauugguggacagg

SEQ ID NO: 9040 - RNA, 21 nt, Artificial Sequence
  Ebola virus siRNA sense strand
aaugacaauugguggacagga

SEQ ID NO: 9041 - RNA, 21 nt, Artificial Sequence
  Ebola virus siRNA sense strand
augacaauugguggacaggau

SEQ ID NO: 9042 - RNA, 21 nt, Artificial Sequence
  Ebola virus siRNA sense strand
ugacaauugguggacaggaug

SEQ ID NO: 9043 - RNA, 21 nt, Artificial Sequence
  Ebola virus siRNA sense strand
gacaauugguggacaggaugg

SEQ ID NO: 9044 - RNA, 21 nt, Artificial Sequence
  Ebola virus siRNA sense strand
acaauugguggacaggaugga

SEQ ID NO: 9045 - RNA, 21 nt, Artificial Sequence
  Ebola virus siRNA sense strand
caauugguggacaggauggag

SEQ ID NO: 9046 - RNA, 21 nt, Artificial Sequence
  Ebola virus siRNA sense strand
aauugguggacaggauggaga

SEQ ID NO: 9047 - RNA, 21 nt, Artificial Sequence
  Ebola virus siRNA sense strand
auugguggacaggauggagac

SEQ ID NO: 9048 - RNA, 21 nt, Artificial Sequence
  Ebola virus siRNA sense strand
uugguggacaggauggagaca

SEQ ID NO: 9049 - RNA, 21 nt, Artificial Sequence
  Ebola virus siRNA sense strand
ugguggacaggauggagacaa

SEQ ID NO: 9050 - RNA, 21 nt, Artificial Sequence
  Ebola virus siRNA sense strand
gguggacaggauggagacaau

SEQ ID NO: 9051 - RNA, 21 nt, Artificial Sequence
  Ebola virus siRNA sense strand
guggacaggauggagacaaug

SEQ ID NO: 9052 - RNA, 21 nt, Artificial Sequence
  Ebola virus siRNA sense strand
uggacaggauggagacaaugg

SEQ ID NO: 9053 - RNA, 21 nt, Artificial Sequence
  Ebola virus siRNA sense strand
ggacaggauggagacaaugga

SEQ ID NO: 9054 - RNA, 21 nt, Artificial Sequence
  Ebola virus siRNA sense strand
gacaggauggagacaauggau

SEQ ID NO: 9055 - RNA, 21 nt, Artificial Sequence
  Ebola virus siRNA sense strand
acaggauggagacaauggaua

SEQ ID NO: 9056 - RNA, 21 nt, Artificial Sequence
  Ebola virus siRNA sense strand
caggauggagacaauggauac

SEQ ID NO: 9057 - RNA, 21 nt, Artificial Sequence
  Ebola virus siRNA sense strand
aggauggagacaauggauacc

SEQ ID NO: 9058 - RNA, 21 nt, Artificial Sequence
  Ebola virus siRNA sense strand
ggauggagacaauggauaccg

SEQ ID NO: 9059 - RNA, 21 nt, Artificial Sequence
  Ebola virus siRNA sense strand
gauggagacaauggauaccgg

SEQ ID NO: 9060 - RNA, 21 nt, Artificial Sequence
  Ebola virus siRNA sense strand
auggagacaauggauaccggc

SEQ ID NO: 9061 - RNA, 21 nt, Artificial Sequence
  Ebola virus siRNA sense strand
uggagacaauggauaccggca

SEQ ID NO: 9062 - RNA, 21 nt, Artificial Sequence
  Ebola virus siRNA sense strand
ggagacaauggauaccggcag

SEQ ID NO: 9063 - RNA, 21 nt, Artificial Sequence
  Ebola virus siRNA sense strand
gagacaauggauaccggcagg

SEQ ID NO: 9064 - RNA, 21 nt, Artificial Sequence
  Ebola virus siRNA sense strand
agacaauggauaccggcaggu

SEQ ID NO: 9065 - RNA, 21 nt, Artificial Sequence
  Ebola virus siRNA sense strand
gacaauggauaccggcaggua

SEQ ID NO: 9066 - RNA, 21 nt, Artificial Sequence
  Ebola virus siRNA sense strand
acaauggauaccggcagguau

SEQ ID NO: 9067 - RNA, 21 nt, Artificial Sequence
  Ebola virus siRNA sense strand
caauggauaccggcagguauu

SEQ ID NO: 9068 - RNA, 21 nt, Artificial Sequence
  Ebola virus siRNA sense strand
aauggauaccggcagguauug

SEQ ID NO: 9069 - RNA, 21 nt, Artificial Sequence
  Ebola virus siRNA sense strand
auggauaccggcagguauugg

SEQ ID NO: 9070 - RNA, 21 nt, Artificial Sequence
  Ebola virus siRNA sense strand
uggauaccggcagguauugga

SEQ ID NO: 9071 - RNA, 21 nt, Artificial Sequence
  Ebola virus siRNA sense strand
ggauaccggcagguauuggag

SEQ ID NO: 9072 - RNA, 21 nt, Artificial Sequence
  Ebola virus siRNA sense strand
gauaccggcagguauuggagu

SEQ ID NO: 9073 - RNA, 21 nt, Artificial Sequence
  Ebola virus siRNA sense strand
auaccggcagguauuggaguu

SEQ ID NO: 9074 - RNA, 21 nt, Artificial Sequence
  Ebola virus siRNA sense strand
uaccggcagguauuggaguua

SEQ ID NO: 9075 - RNA, 21 nt, Artificial Sequence
  Ebola virus siRNA sense strand
accggcagguauuggaguuac

SEQ ID NO: 9076 - RNA, 21 nt, Artificial Sequence
  Ebola virus siRNA sense strand
ccggcagguauuggaguuaca

SEQ ID NO: 9077 - RNA, 21 nt, Artificial Sequence
  Ebola virus siRNA sense strand
cggcagguauuggaguuacag

SEQ ID NO: 9078 - RNA, 21 nt, Artificial Sequence
  Ebola virus siRNA sense strand
ggcagguauuggaguuacagg

SEQ ID NO: 9079 - RNA, 21 nt, Artificial Sequence
  Ebola virus siRNA sense strand
gcagguauuggaguuacaggc

SEQ ID NO: 9080 - RNA, 21 nt, Artificial Sequence
  Ebola virus siRNA sense strand
cagguauuggaguuacaggcg

SEQ ID NO: 9081 - RNA, 21 nt, Artificial Sequence
  Ebola virus siRNA sense strand
agguauuggaguuacaggcgu

SEQ ID NO: 9082 - RNA, 21 nt, Artificial Sequence
  Ebola virus siRNA sense strand
gguauuggaguuacaggcguu

SEQ ID NO: 9083 - RNA, 21 nt, Artificial Sequence
  Ebola virus siRNA sense strand
guauuggaguuacaggcguua

SEQ ID NO: 9084 - RNA, 21 nt, Artificial Sequence
  Ebola virus siRNA sense strand
uauuggaguuacaggcguuau

SEQ ID NO: 9085 - RNA, 21 nt, Artificial Sequence
  Ebola virus siRNA sense strand
auuggaguuacaggcguuaua

SEQ ID NO: 9086 - RNA, 21 nt, Artificial Sequence
  Ebola virus siRNA sense strand
uuggaguuacaggcguuauaa

SEQ ID NO: 9087 - RNA, 21 nt, Artificial Sequence
  Ebola virus siRNA sense strand
uggaguuacaggcguuauaau

SEQ ID NO: 9088 - RNA, 21 nt, Artificial Sequence
  Ebola virus siRNA sense strand
ggaguuacaggcguuauaauu

SEQ ID NO: 9089 - RNA, 21 nt, Artificial Sequence
  Ebola virus siRNA sense strand
gaguuacaggcguuauaauug

SEQ ID NO: 9090 - RNA, 21 nt, Artificial Sequence
  Ebola virus siRNA sense strand
aguuacaggcguuauaauugc

SEQ ID NO: 9091 - RNA, 21 nt, Artificial Sequence
  Ebola virus siRNA sense strand
guuacaggcguuauaauugca

SEQ ID NO: 9092 - RNA, 21 nt, Artificial Sequence
  Ebola virus siRNA sense strand
uuacaggcguuauaauugcag

SEQ ID NO: 9093 - RNA, 21 nt, Artificial Sequence
  Ebola virus siRNA sense strand
uacaggcguuauaauugcagu

SEQ ID NO: 9094 - RNA, 21 nt, Artificial Sequence
  Ebola virus siRNA sense strand
acaggcguuauaauugcaguu

SEQ ID NO: 9095 - RNA, 21 nt, Artificial Sequence
  Ebola virus siRNA sense strand
caggcguuauaauugcaguua

SEQ ID NO: 9096 - RNA, 21 nt, Artificial Sequence
  Ebola virus siRNA sense strand
aggcguuauaauugcaguuau

SEQ ID NO: 9097 - RNA, 21 nt, Artificial Sequence
  Ebola virus siRNA sense strand
ggcguuauaauugcaguuauc

SEQ ID NO: 9098 - RNA, 21 nt, Artificial Sequence
  Ebola virus siRNA sense strand
gcguuauaauugcaguuaucg

SEQ ID NO: 9099 - RNA, 21 nt, Artificial Sequence
  Ebola virus siRNA sense strand
cguuauaauugcaguuaucgc

SEQ ID NO: 9100 - RNA, 21 nt, Artificial Sequence
  Ebola virus siRNA sense strand
guuauaauugcaguuaucgcu

SEQ ID NO: 9101 - RNA, 21 nt, Artificial Sequence
  Ebola virus siRNA sense strand
uuauaauugcaguuaucgcuu

SEQ ID NO: 9102 - RNA, 21 nt, Artificial Sequence
  Ebola virus siRNA sense strand
uauaauugcaguuaucgcuuu

SEQ ID NO: 9103 - RNA, 21 nt, Artificial Sequence
  Ebola virus siRNA sense strand
auaauugcaguuaucgcuuua

SEQ ID NO: 9104 - RNA, 21 nt, Artificial Sequence
  Ebola virus siRNA sense strand
uaauugcaguuaucgcuuuau

SEQ ID NO: 9105 - RNA, 21 nt, Artificial Sequence
  Ebola virus siRNA sense strand
aauugcaguuaucgcuuuauu

SEQ ID NO: 9106 - RNA, 21 nt, Artificial Sequence
  Ebola virus siRNA sense strand
auugcaguuaucgcuuuauuc

SEQ ID NO: 9107 - RNA, 21 nt, Artificial Sequence
  Ebola virus siRNA sense strand
uugcaguuaucgcuuuauucu

SEQ ID NO: 9108 - RNA, 21 nt, Artificial Sequence
  Ebola virus siRNA sense strand
ugcaguuaucgcuuuauucug

SEQ ID NO: 9109 - RNA, 21 nt, Artificial Sequence
  Ebola virus siRNA sense strand
gcaguuaucgcuuuauucugu

SEQ ID NO: 9110 - RNA, 21 nt, Artificial Sequence
  Ebola virus siRNA sense strand
caguuaucgcuuuauucugua

SEQ ID NO: 9111 - RNA, 21 nt, Artificial Sequence
  Ebola virus siRNA sense strand
aguuaucgcuuuauucuguau

SEQ ID NO: 9112 - RNA, 21 nt, Artificial Sequence
  Ebola virus siRNA sense strand
guuaucgcuuuauucuguaua

SEQ ID NO: 9113 - RNA, 21 nt, Artificial Sequence
  Ebola virus siRNA sense strand
uuaucgcuuuauucuguauau

SEQ ID NO: 9114 - RNA, 21 nt, Artificial Sequence
  Ebola virus siRNA sense strand
uaucgcuuuauucuguauaug

SEQ ID NO: 9115 - RNA, 21 nt, Artificial Sequence
  Ebola virus siRNA sense strand
aucgcuuuauucuguauaugc

SEQ ID NO: 9116 - RNA, 21 nt, Artificial Sequence
  Ebola virus siRNA sense strand
ucgcuuuauucuguauaugca

SEQ ID NO: 9117 - RNA, 21 nt, Artificial Sequence
  Ebola virus siRNA sense strand
cgcuuuauucuguauaugcaa

SEQ ID NO: 9118 - RNA, 21 nt, Artificial Sequence
  Ebola virus siRNA sense strand
gcuuuauucuguauaugcaaa

SEQ ID NO: 9119 - RNA, 21 nt, Artificial Sequence
  Ebola virus siRNA sense strand
cuuuauucuguauaugcaaau

SEQ ID NO: 9120 - RNA, 21 nt, Artificial Sequence
  Ebola virus siRNA sense strand
uuuauucuguauaugcaaauu

SEQ ID NO: 9121 - RNA, 21 nt, Artificial Sequence
  Ebola virus siRNA sense strand
uuauucuguauaugcaaauuu

SEQ ID NO: 9122 - RNA, 21 nt, Artificial Sequence
  Ebola virus siRNA sense strand
uauucuguauaugcaaauuug

SEQ ID NO: 9123 - RNA, 21 nt, Artificial Sequence
  Ebola virus siRNA sense strand
auucuguauaugcaaauuugu

SEQ ID NO: 9124 - RNA, 21 nt, Artificial Sequence
  Ebola virus siRNA sense strand
uucuguauaugcaaauuuguc

SEQ ID NO: 9125 - RNA, 21 nt, Artificial Sequence
  Ebola virus siRNA sense strand
ucuguauaugcaaauuugucu

SEQ ID NO: 9126 - RNA, 21 nt, Artificial Sequence
  Ebola virus siRNA sense strand
cuguauaugcaaauuugucuu

SEQ ID NO: 9127 - RNA, 21 nt, Artificial Sequence
  Ebola virus siRNA sense strand
uguauaugcaaauuugucuuu

SEQ ID NO: 9128 - RNA, 21 nt, Artificial Sequence
  Ebola virus siRNA sense strand
guauaugcaaauuugucuuuu

SEQ ID NO: 9129 - RNA, 21 nt, Artificial Sequence
  Ebola virus siRNA sense strand
uauaugcaaauuugucuuuua

SEQ ID NO: 9130 - RNA, 21 nt, Artificial Sequence
  Ebola virus siRNA sense strand
auaugcaaauuugucuuuuag

SEQ ID NO: 9131 - RNA, 21 nt, Artificial Sequence
  Ebola virus siRNA sense strand
uaugcaaauuugucuuuuagu

SEQ ID NO: 9132 - RNA, 21 nt, Artificial Sequence
  Ebola virus siRNA sense strand
augcaaauuugucuuuuaguu

SEQ ID NO: 9133 - RNA, 21 nt, Artificial Sequence
  Ebola virus siRNA sense strand
ugcaaauuugucuuuuaguuu

SEQ ID NO: 9134 - RNA, 21 nt, Artificial Sequence
  Ebola virus siRNA sense strand
gcaaauuugucuuuuaguuuu

SEQ ID NO: 9135 - RNA, 21 nt, Artificial Sequence
  Ebola virus siRNA sense strand
caaauuugucuuuuaguuuuu

SEQ ID NO: 9136 - RNA, 21 nt, Artificial Sequence
  Ebola virus siRNA sense strand
aaauuugucuuuuaguuuuuc

SEQ ID NO: 9137 - RNA, 21 nt, Artificial Sequence
  Ebola virus siRNA sense strand
aauuugucuuuuaguuuuucu

SEQ ID NO: 9138 - RNA, 21 nt, Artificial Sequence
  Ebola virus siRNA sense strand
auuugucuuuuaguuuuucuu

SEQ ID NO: 9139 - RNA, 21 nt, Artificial Sequence
  Ebola virus siRNA sense strand
uuugucuuuuaguuuuucuuc

SEQ ID NO: 9140 - RNA, 21 nt, Artificial Sequence
  Ebola virus siRNA sense strand
uugucuuuuaguuuuucuuca

SEQ ID NO: 9141 - RNA, 21 nt, Artificial Sequence
  Ebola virus siRNA sense strand
ugucuuuuaguuuuucuucag

SEQ ID NO: 9142 - RNA, 21 nt, Artificial Sequence
  Ebola virus siRNA sense strand
gucuuuuaguuuuucuucaga

SEQ ID NO: 9143 - RNA, 21 nt, Artificial Sequence
  Ebola virus siRNA sense strand
ucuuuuaguuuuucuucagau

SEQ ID NO: 9144 - RNA, 21 nt, Artificial Sequence
  Ebola virus siRNA sense strand
cuuuuaguuuuucuucagauu

SEQ ID NO: 9145 - RNA, 21 nt, Artificial Sequence
  Ebola virus siRNA sense strand
uuuuaguuuuucuucagauug

SEQ ID NO: 9146 - RNA, 21 nt, Artificial Sequence
  Ebola virus siRNA sense strand
uuuaguuuuucuucagauugc

SEQ ID NO: 9147 - RNA, 21 nt, Artificial Sequence
  Ebola virus siRNA sense strand
uuaguuuuucuucagauugcu

SEQ ID NO: 9148 - RNA, 21 nt, Artificial Sequence
  Ebola virus siRNA sense strand
uaguuuuucuucagauugcuu

SEQ ID NO: 9149 - RNA, 21 nt, Artificial Sequence
  Ebola virus siRNA sense strand
aguuuuucuucagauugcuuc

SEQ ID NO: 9150 - RNA, 21 nt, Artificial Sequence
  Ebola virus siRNA sense strand
guuuuucuucagauugcuuca

SEQ ID NO: 9151 - RNA, 21 nt, Artificial Sequence
  Ebola virus siRNA sense strand
uuuuucuucagauugcuucau

SEQ ID NO: 9152 - RNA, 21 nt, Artificial Sequence
  Ebola virus siRNA sense strand
uuuucuucagauugcuucaug

SEQ ID NO: 9153 - RNA, 21 nt, Artificial Sequence
  Ebola virus siRNA sense strand
uuucuucagauugcuucaugg

SEQ ID NO: 9154 - RNA, 21 nt, Artificial Sequence
  Ebola virus siRNA sense strand
uucuucagauugcuucaugga

SEQ ID NO: 9155 - RNA, 21 nt, Artificial Sequence
  Ebola virus siRNA sense strand
ucuucagauugcuucauggaa

SEQ ID NO: 9156 - RNA, 21 nt, Artificial Sequence
  Ebola virus siRNA sense strand
cuucagauugcuucauggaaa

SEQ ID NO: 9157 - RNA, 21 nt, Artificial Sequence
  Ebola virus siRNA sense strand
uucagauugcuucauggaaaa

SEQ ID NO: 9158 - RNA, 21 nt, Artificial Sequence
  Ebola virus siRNA sense strand
ucagauugcuucauggaaaag

SEQ ID NO: 9159 - RNA, 21 nt, Artificial Sequence
  Ebola virus siRNA sense strand
cagauugcuucauggaaaagc

SEQ ID NO: 9160 - RNA, 21 nt, Artificial Sequence
  Ebola virus siRNA sense strand
agauugcuucauggaaaagcu

SEQ ID NO: 9161 - RNA, 21 nt, Artificial Sequence
  Ebola virus siRNA sense strand
gauugcuucauggaaaagcuc

SEQ ID NO: 9162 - RNA, 21 nt, Artificial Sequence
  Ebola virus siRNA sense strand
auugcuucauggaaaagcuca

SEQ ID NO: 9163 - RNA, 21 nt, Artificial Sequence
  Ebola virus siRNA sense strand
uugcuucauggaaaagcucag

SEQ ID NO: 9164 - RNA, 21 nt, Artificial Sequence
  Ebola virus siRNA sense strand
ugcuucauggaaaagcucagc

SEQ ID NO: 9165 - RNA, 21 nt, Artificial Sequence
  Ebola virus siRNA sense strand
gcuucauggaaaagcucagcc

SEQ ID NO: 9166 - RNA, 21 nt, Artificial Sequence
  Ebola virus siRNA sense strand
cuucauggaaaagcucagccu

SEQ ID NO: 9167 - RNA, 21 nt, Artificial Sequence
  Ebola virus siRNA sense strand
uucauggaaaagcucagccuc

SEQ ID NO: 9168 - RNA, 21 nt, Artificial Sequence
  Ebola virus siRNA sense strand
ucauggaaaagcucagccuca

SEQ ID NO: 9169 - RNA, 21 nt, Artificial Sequence
  Ebola virus siRNA sense strand
cauggaaaagcucagccucaa

SEQ ID NO: 9170 - RNA, 21 nt, Artificial Sequence
  Ebola virus siRNA sense strand
auggaaaagcucagccucaaa

SEQ ID NO: 9171 - RNA, 21 nt, Artificial Sequence
  Ebola virus siRNA sense strand
uggaaaagcucagccucaaau

SEQ ID NO: 9172 - RNA, 21 nt, Artificial Sequence
  Ebola virus siRNA sense strand
ggaaaagcucagccucaaauc

SEQ ID NO: 9173 - RNA, 21 nt, Artificial Sequence
  Ebola virus siRNA sense strand
gaaaagcucagccucaaauca

SEQ ID NO: 9174 - RNA, 21 nt, Artificial Sequence
  Ebola virus siRNA sense strand
aaaagcucagccucaaaucaa

SEQ ID NO: 9175 - RNA, 21 nt, Artificial Sequence
  Ebola virus siRNA sense strand
aaagcucagccucaaaucaau

SEQ ID NO: 9176 - RNA, 21 nt, Artificial Sequence
  Ebola virus siRNA sense strand
aagcucagccucaaaucaaug

SEQ ID NO: 9177 - RNA, 21 nt, Artificial Sequence
  Ebola virus siRNA sense strand
agcucagccucaaaucaauga

SEQ ID NO: 9178 - RNA, 21 nt, Artificial Sequence
  Ebola virus siRNA sense strand
gcucagccucaaaucaaugaa

SEQ ID NO: 9179 - RNA, 21 nt, Artificial Sequence
  Ebola virus siRNA sense strand
cucagccucaaaucaaugaaa

SEQ ID NO: 9180 - RNA, 21 nt, Artificial Sequence
  Ebola virus siRNA sense strand
ucagccucaaaucaaugaaac

SEQ ID NO: 9181 - RNA, 21 nt, Artificial Sequence
  Ebola virus siRNA sense strand
cagccucaaaucaaugaaacc

SEQ ID NO: 9182 - RNA, 21 nt, Artificial Sequence
  Ebola virus siRNA sense strand
agccucaaaucaaugaaacca

SEQ ID NO: 9183 - RNA, 21 nt, Artificial Sequence
  Ebola virus siRNA sense strand
gccucaaaucaaugaaaccag

SEQ ID NO: 9184 - RNA, 21 nt, Artificial Sequence
  Ebola virus siRNA sense strand
ccucaaaucaaugaaaccagg

SEQ ID NO: 9185 - RNA, 21 nt, Artificial Sequence
  Ebola virus siRNA sense strand
cucaaaucaaugaaaccagga

SEQ ID NO: 9186 - RNA, 21 nt, Artificial Sequence
  Ebola virus siRNA sense strand
ucaaaucaaugaaaccaggau

SEQ ID NO: 9187 - RNA, 21 nt, Artificial Sequence
  Ebola virus siRNA sense strand
caaaucaaugaaaccaggauu

SEQ ID NO: 9188 - RNA, 21 nt, Artificial Sequence
  Ebola virus siRNA sense strand
aaaucaaugaaaccaggauuu

SEQ ID NO: 9189 - RNA, 21 nt, Artificial Sequence
  Ebola virus siRNA sense strand
aaucaaugaaaccaggauuua

SEQ ID NO: 9190 - RNA, 21 nt, Artificial Sequence
  Ebola virus siRNA sense strand
aucaaugaaaccaggauuuaa

SEQ ID NO: 9191 - RNA, 21 nt, Artificial Sequence
  Ebola virus siRNA sense strand
ucaaugaaaccaggauuuaau

SEQ ID NO: 9192 - RNA, 21 nt, Artificial Sequence
  Ebola virus siRNA sense strand
caaugaaaccaggauuuaauu

SEQ ID NO: 9193 - RNA, 21 nt, Artificial Sequence
  Ebola virus siRNA sense strand
aaugaaaccaggauuuaauua

SEQ ID NO: 9194 - RNA, 21 nt, Artificial Sequence
  Ebola virus siRNA sense strand
augaaaccaggauuuaauuau

SEQ ID NO: 9195 - RNA, 21 nt, Artificial Sequence
  Ebola virus siRNA sense strand
ugaaaccaggauuuaauuaua

SEQ ID NO: 9196 - RNA, 21 nt, Artificial Sequence
  Ebola virus siRNA sense strand
gaaaccaggauuuaauuauau

SEQ ID NO: 9197 - RNA, 21 nt, Artificial Sequence
  Ebola virus siRNA sense strand
aaaccaggauuuaauuauaug

SEQ ID NO: 9198 - RNA, 21 nt, Artificial Sequence
  Ebola virus siRNA sense strand
aaccaggauuuaauuauaugg

SEQ ID NO: 9199 - RNA, 21 nt, Artificial Sequence
  Ebola virus siRNA sense strand
accaggauuuaauuauaugga

SEQ ID NO: 9200 - RNA, 21 nt, Artificial Sequence
  Ebola virus siRNA sense strand
ccaggauuuaauuauauggau

SEQ ID NO: 9201 - RNA, 21 nt, Artificial Sequence
  Ebola virus siRNA sense strand
caggauuuaauuauauggauu

SEQ ID NO: 9202 - RNA, 21 nt, Artificial Sequence
  Ebola virus siRNA sense strand
aggauuuaauuauauggauua

SEQ ID NO: 9203 - RNA, 21 nt, Artificial Sequence
  Ebola virus siRNA sense strand
ggauuuaauuauauggauuac

SEQ ID NO: 9204 - RNA, 21 nt, Artificial Sequence
  Ebola virus siRNA sense strand
gauuuaauuauauggauuacu

SEQ ID NO: 9205 - RNA, 21 nt, Artificial Sequence
  Ebola virus siRNA sense strand
auuuaauuauauggauuacuu

SEQ ID NO: 9206 - RNA, 21 nt, Artificial Sequence
  Ebola virus siRNA sense strand
uuuaauuauauggauuacuug

SEQ ID NO: 9207 - RNA, 21 nt, Artificial Sequence
  Ebola virus siRNA sense strand
uuaauuauauggauuacuuga

SEQ ID NO: 9208 - RNA, 21 nt, Artificial Sequence
  Ebola virus siRNA sense strand
uaauuauauggauuacuugaa

SEQ ID NO: 9209 - RNA, 21 nt, Artificial Sequence
  Ebola virus siRNA sense strand
aauuauauggauuacuugaau

SEQ ID NO: 9210 - RNA, 21 nt, Artificial Sequence
  Ebola virus siRNA sense strand
auuauauggauuacuugaauc

SEQ ID NO: 9211 - RNA, 21 nt, Artificial Sequence
  Ebola virus siRNA sense strand
uuauauggauuacuugaaucu

SEQ ID NO: 9212 - RNA, 21 nt, Artificial Sequence
  Ebola virus siRNA sense strand
uauauggauuacuugaaucua

SEQ ID NO: 9213 - RNA, 21 nt, Artificial Sequence
  Ebola virus siRNA sense strand
auauggauuacuugaaucuaa

SEQ ID NO: 9214 - RNA, 21 nt, Artificial Sequence
  Ebola virus siRNA sense strand
uauggauuacuugaaucuaag

SEQ ID NO: 9215 - RNA, 21 nt, Artificial Sequence
  Ebola virus siRNA sense strand
auggauuacuugaaucuaaga

SEQ ID NO: 9216 - RNA, 21 nt, Artificial Sequence
  Ebola virus siRNA sense strand
uggauuacuugaaucuaagau

SEQ ID NO: 9217 - RNA, 21 nt, Artificial Sequence
  Ebola virus siRNA sense strand
ggauuacuugaaucuaagauu

SEQ ID NO: 9218 - RNA, 21 nt, Artificial Sequence
  Ebola virus siRNA sense strand
gauuacuugaaucuaagauua

SEQ ID NO: 9219 - RNA, 21 nt, Artificial Sequence
  Ebola virus siRNA sense strand
auuacuugaaucuaagauuac

SEQ ID NO: 9220 - RNA, 21 nt, Artificial Sequence
  Ebola virus siRNA sense strand
uuacuugaaucuaagauuacu

SEQ ID NO: 9221 - RNA, 21 nt, Artificial Sequence
  Ebola virus siRNA sense strand
uacuugaaucuaagauuacuu

SEQ ID NO: 9222 - RNA, 21 nt, Artificial Sequence
  Ebola virus siRNA sense strand
acuugaaucuaagauuacuug

SEQ ID NO: 9223 - RNA, 21 nt, Artificial Sequence
  Ebola virus siRNA sense strand
cuugaaucuaagauuacuuga

SEQ ID NO: 9224 - RNA, 21 nt, Artificial Sequence
  Ebola virus siRNA sense strand
uugaaucuaagauuacuugac

SEQ ID NO: 9225 - RNA, 21 nt, Artificial Sequence
  Ebola virus siRNA sense strand
ugaaucuaagauuacuugaca

SEQ ID NO: 9226 - RNA, 21 nt, Artificial Sequence
  Ebola virus siRNA sense strand
gaaucuaagauuacuugacaa

SEQ ID NO: 9227 - RNA, 21 nt, Artificial Sequence
  Ebola virus siRNA sense strand
aaucuaagauuacuugacaaa

SEQ ID NO: 9228 - RNA, 21 nt, Artificial Sequence
  Ebola virus siRNA sense strand
aucuaagauuacuugacaaau

SEQ ID NO: 9229 - RNA, 21 nt, Artificial Sequence
  Ebola virus siRNA sense strand
ucuaagauuacuugacaaaug

SEQ ID NO: 9230 - RNA, 21 nt, Artificial Sequence
  Ebola virus siRNA sense strand
cuaagauuacuugacaaauga

SEQ ID NO: 9231 - RNA, 21 nt, Artificial Sequence
  Ebola virus siRNA sense strand
uaagauuacuugacaaaugau

SEQ ID NO: 9232 - RNA, 21 nt, Artificial Sequence
  Ebola virus siRNA sense strand
aagauuacuugacaaaugaua

SEQ ID NO: 9233 - RNA, 21 nt, Artificial Sequence
  Ebola virus siRNA sense strand
agauuacuugacaaaugauaa

SEQ ID NO: 9234 - RNA, 21 nt, Artificial Sequence
  Ebola virus siRNA sense strand
gauuacuugacaaaugauaau

SEQ ID NO: 9235 - RNA, 21 nt, Artificial Sequence
  Ebola virus siRNA sense strand
auuacuugacaaaugauaaua

SEQ ID NO: 9236 - RNA, 21 nt, Artificial Sequence
  Ebola virus siRNA sense strand
uuacuugacaaaugauaauau

SEQ ID NO: 9237 - RNA, 21 nt, Artificial Sequence
  Ebola virus siRNA sense strand
uacuugacaaaugauaauaua

SEQ ID NO: 9238 - RNA, 21 nt, Artificial Sequence
  Ebola virus siRNA sense strand
acuugacaaaugauaauauaa

SEQ ID NO: 9239 - RNA, 21 nt, Artificial Sequence
  Ebola virus siRNA sense strand
cuugacaaaugauaauauaau

SEQ ID NO: 9240 - RNA, 21 nt, Artificial Sequence
  Ebola virus siRNA sense strand
uugacaaaugauaauauaaua

SEQ ID NO: 9241 - RNA, 21 nt, Artificial Sequence
  Ebola virus siRNA sense strand
ugacaaaugauaauauaauac

SEQ ID NO: 9242 - RNA, 21 nt, Artificial Sequence
  Ebola virus siRNA sense strand
gacaaaugauaauauaauaca

SEQ ID NO: 9243 - RNA, 21 nt, Artificial Sequence
  Ebola virus siRNA sense strand
acaaaugauaauauaauacac

SEQ ID NO: 9244 - RNA, 21 nt, Artificial Sequence
  Ebola virus siRNA sense strand
caaaugauaauauaauacacu

SEQ ID NO: 9245 - RNA, 21 nt, Artificial Sequence
  Ebola virus siRNA sense strand
aaaugauaauauaauacacug

SEQ ID NO: 9246 - RNA, 21 nt, Artificial Sequence
  Ebola virus siRNA sense strand
aaugauaauauaauacacugg

SEQ ID NO: 9247 - RNA, 21 nt, Artificial Sequence
  Ebola virus siRNA sense strand
augauaauauaauacacugga

SEQ ID NO: 9248 - RNA, 21 nt, Artificial Sequence
  Ebola virus siRNA sense strand
ugauaauauaauacacuggag

SEQ ID NO: 9249 - RNA, 21 nt, Artificial Sequence
  Ebola virus siRNA sense strand
gauaauauaauacacuggagc

SEQ ID NO: 9250 - RNA, 21 nt, Artificial Sequence
  Ebola virus siRNA sense strand
auaauauaauacacuggagcu

SEQ ID NO: 9251 - RNA, 21 nt, Artificial Sequence
  Ebola virus siRNA sense strand
uaauauaauacacuggagcuu

SEQ ID NO: 9252 - RNA, 21 nt, Artificial Sequence
  Ebola virus siRNA sense strand
aauauaauacacuggagcuuu

SEQ ID NO: 9253 - RNA, 21 nt, Artificial Sequence
  Ebola virus siRNA sense strand
auauaauacacuggagcuuua

SEQ ID NO: 9254 - RNA, 21 nt, Artificial Sequence
  Ebola virus siRNA sense strand
uauaauacacuggagcuuuaa

SEQ ID NO: 9255 - RNA, 21 nt, Artificial Sequence
  Ebola virus siRNA sense strand
auaauacacuggagcuuuaaa

SEQ ID NO: 9256 - RNA, 21 nt, Artificial Sequence
  Ebola virus siRNA sense strand
uaauacacuggagcuuuaaac

SEQ ID NO: 9257 - RNA, 21 nt, Artificial Sequence
  Ebola virus siRNA sense strand
aauacacuggagcuuuaaaca

SEQ ID NO: 9258 - RNA, 21 nt, Artificial Sequence
  Ebola virus siRNA sense strand
auacacuggagcuuuaaacau

SEQ ID NO: 9259 - RNA, 21 nt, Artificial Sequence
  Ebola virus siRNA sense strand
uacacuggagcuuuaaacaua

SEQ ID NO: 9260 - RNA, 21 nt, Artificial Sequence
  Ebola virus siRNA sense strand
acacuggagcuuuaaacauag

SEQ ID NO: 9261 - RNA, 21 nt, Artificial Sequence
  Ebola virus siRNA sense strand
cacuggagcuuuaaacauagc

SEQ ID NO: 9262 - RNA, 21 nt, Artificial Sequence
  Ebola virus siRNA sense strand
acuggagcuuuaaacauagcc

SEQ ID NO: 9263 - RNA, 21 nt, Artificial Sequence
  Ebola virus siRNA sense strand
cuggagcuuuaaacauagcca

SEQ ID NO: 9264 - RNA, 21 nt, Artificial Sequence
  Ebola virus siRNA sense strand
uggagcuuuaaacauagccaa

SEQ ID NO: 9265 - RNA, 21 nt, Artificial Sequence
  Ebola virus siRNA sense strand
ggagcuuuaaacauagccaau

SEQ ID NO: 9266 - RNA, 21 nt, Artificial Sequence
  Ebola virus siRNA sense strand
gagcuuuaaacauagccaaug

SEQ ID NO: 9267 - RNA, 21 nt, Artificial Sequence
  Ebola virus siRNA sense strand
agcuuuaaacauagccaaugu

SEQ ID NO: 9268 - RNA, 21 nt, Artificial Sequence
  Ebola virus siRNA sense strand
gcuuuaaacauagccaaugug

SEQ ID NO: 9269 - RNA, 21 nt, Artificial Sequence
  Ebola virus siRNA sense strand
cuuuaaacauagccaauguga

SEQ ID NO: 9270 - RNA, 21 nt, Artificial Sequence
  Ebola virus siRNA sense strand
uuuaaacauagccaaugugau

SEQ ID NO: 9271 - RNA, 21 nt, Artificial Sequence
  Ebola virus siRNA sense strand
uuaaacauagccaaugugauu

SEQ ID NO: 9272 - RNA, 21 nt, Artificial Sequence
  Ebola virus siRNA sense strand
uaaacauagccaaugugauuc

SEQ ID NO: 9273 - RNA, 21 nt, Artificial Sequence
  Ebola virus siRNA sense strand
aaacauagccaaugugauucu

SEQ ID NO: 9274 - RNA, 21 nt, Artificial Sequence
  Ebola virus siRNA sense strand
aacauagccaaugugauucua

SEQ ID NO: 9275 - RNA, 21 nt, Artificial Sequence
  Ebola virus siRNA sense strand
acauagccaaugugauucuaa

SEQ ID NO: 9276 - RNA, 21 nt, Artificial Sequence
  Ebola virus siRNA sense strand
cauagccaaugugauucuaac

SEQ ID NO: 9277 - RNA, 21 nt, Artificial Sequence
  Ebola virus siRNA sense strand
auagccaaugugauucuaacu

SEQ ID NO: 9278 - RNA, 21 nt, Artificial Sequence
  Ebola virus siRNA sense strand
uagccaaugugauucuaacuc

SEQ ID NO: 9279 - RNA, 21 nt, Artificial Sequence
  Ebola virus siRNA sense strand
agccaaugugauucuaacucc

SEQ ID NO: 9280 - RNA, 21 nt, Artificial Sequence
  Ebola virus siRNA sense strand
gccaaugugauucuaacuccu

SEQ ID NO: 9281 - RNA, 21 nt, Artificial Sequence
  Ebola virus siRNA sense strand
ccaaugugauucuaacuccuu

SEQ ID NO: 9282 - RNA, 21 nt, Artificial Sequence
  Ebola virus siRNA sense strand
caaugugauucuaacuccuuu

SEQ ID NO: 9283 - RNA, 21 nt, Artificial Sequence
  Ebola virus siRNA sense strand
aaugugauucuaacuccuuua

SEQ ID NO: 9284 - RNA, 21 nt, Artificial Sequence
  Ebola virus siRNA sense strand
augugauucuaacuccuuuaa

SEQ ID NO: 9285 - RNA, 21 nt, Artificial Sequence
  Ebola virus siRNA sense strand
ugugauucuaacuccuuuaaa

SEQ ID NO: 9286 - RNA, 21 nt, Artificial Sequence
  Ebola virus siRNA sense strand
gugauucuaacuccuuuaaac

SEQ ID NO: 9287 - RNA, 21 nt, Artificial Sequence
  Ebola virus siRNA sense strand
ugauucuaacuccuuuaaacu

SEQ ID NO: 9288 - RNA, 21 nt, Artificial Sequence
  Ebola virus siRNA sense strand
gauucuaacuccuuuaaacuc

SEQ ID NO: 9289 - RNA, 21 nt, Artificial Sequence
  Ebola virus siRNA sense strand
auucuaacuccuuuaaacuca

SEQ ID NO: 9290 - RNA, 21 nt, Artificial Sequence
  Ebola virus siRNA sense strand
uucuaacuccuuuaaacucac

SEQ ID NO: 9291 - RNA, 21 nt, Artificial Sequence
  Ebola virus siRNA sense strand
ucuaacuccuuuaaacucaca

SEQ ID NO: 9292 - RNA, 21 nt, Artificial Sequence
  Ebola virus siRNA sense strand
cuaacuccuuuaaacucacag

SEQ ID NO: 9293 - RNA, 21 nt, Artificial Sequence
  Ebola virus siRNA sense strand
uaacuccuuuaaacucacagu

SEQ ID NO: 9294 - RNA, 21 nt, Artificial Sequence
  Ebola virus siRNA sense strand
aacuccuuuaaacucacaguu

SEQ ID NO: 9295 - RNA, 21 nt, Artificial Sequence
  Ebola virus siRNA sense strand
acuccuuuaaacucacaguua

SEQ ID NO: 9296 - RNA, 21 nt, Artificial Sequence
  Ebola virus siRNA sense strand
cuccuuuaaacucacaguuaa

SEQ ID NO: 9297 - RNA, 21 nt, Artificial Sequence
  Ebola virus siRNA sense strand
uccuuuaaacucacaguuaau

SEQ ID NO: 9298 - RNA, 21 nt, Artificial Sequence
  Ebola virus siRNA sense strand
ccuuuaaacucacaguuaauc

SEQ ID NO: 9299 - RNA, 21 nt, Artificial Sequence
  Ebola virus siRNA sense strand
cuuuaaacucacaguuaauca

SEQ ID NO: 9300 - RNA, 21 nt, Artificial Sequence
  Ebola virus siRNA sense strand
uuuaaacucacaguuaaucau

SEQ ID NO: 9301 - RNA, 21 nt, Artificial Sequence
  Ebola virus siRNA sense strand
uuaaacucacaguuaaucaua

SEQ ID NO: 9302 - RNA, 21 nt, Artificial Sequence
  Ebola virus siRNA sense strand
uaaacucacaguuaaucauaa

SEQ ID NO: 9303 - RNA, 21 nt, Artificial Sequence
  Ebola virus siRNA sense strand
aaacucacaguuaaucauaaa

SEQ ID NO: 9304 - RNA, 21 nt, Artificial Sequence
  Ebola virus siRNA sense strand
aacucacaguuaaucauaaac

SEQ ID NO: 9305 - RNA, 21 nt, Artificial Sequence
  Ebola virus siRNA sense strand
acucacaguuaaucauaaaca

SEQ ID NO: 9306 - RNA, 21 nt, Artificial Sequence
  Ebola virus siRNA sense strand
cucacaguuaaucauaaacaa

SEQ ID NO: 9307 - RNA, 21 nt, Artificial Sequence
  Ebola virus siRNA sense strand
ucacaguuaaucauaaacaag

SEQ ID NO: 9308 - RNA, 21 nt, Artificial Sequence
  Ebola virus siRNA sense strand
cacaguuaaucauaaacaagg

SEQ ID NO: 9309 - RNA, 21 nt, Artificial Sequence
  Ebola virus siRNA sense strand
acaguuaaucauaaacaaggu

SEQ ID NO: 9310 - RNA, 21 nt, Artificial Sequence
  Ebola virus siRNA sense strand
caguuaaucauaaacaagguu

SEQ ID NO: 9311 - RNA, 21 nt, Artificial Sequence
  Ebola virus siRNA sense strand
aguuaaucauaaacaagguuu

SEQ ID NO: 9312 - RNA, 21 nt, Artificial Sequence
  Ebola virus siRNA sense strand
guuaaucauaaacaagguuug

SEQ ID NO: 9313 - RNA, 21 nt, Artificial Sequence
  Ebola virus siRNA sense strand
uuaaucauaaacaagguuuga

SEQ ID NO: 9314 - RNA, 21 nt, Artificial Sequence
  Ebola virus siRNA sense strand
uaaucauaaacaagguuugac

SEQ ID NO: 9315 - RNA, 21 nt, Artificial Sequence
  Ebola virus siRNA sense strand
aaucauaaacaagguuugaca

SEQ ID NO: 9316 - RNA, 21 nt, Artificial Sequence
  Ebola virus siRNA sense strand
aucauaaacaagguuugacau

SEQ ID NO: 9317 - RNA, 21 nt, Artificial Sequence
  Ebola virus siRNA sense strand
ucauaaacaagguuugacauc

SEQ ID NO: 9318 - RNA, 21 nt, Artificial Sequence
  Ebola virus siRNA sense strand
cauaaacaagguuugacauca

SEQ ID NO: 9319 - RNA, 21 nt, Artificial Sequence
  Ebola virus siRNA sense strand
auaaacaagguuugacaucaa

SEQ ID NO: 9320 - RNA, 21 nt, Artificial Sequence
  Ebola virus siRNA sense strand
uaaacaagguuugacaucaau

SEQ ID NO: 9321 - RNA, 21 nt, Artificial Sequence
  Ebola virus siRNA sense strand
aaacaagguuugacaucaauc

SEQ ID NO: 9322 - RNA, 21 nt, Artificial Sequence
  Ebola virus siRNA sense strand
aacaagguuugacaucaaucu

SEQ ID NO: 9323 - RNA, 21 nt, Artificial Sequence
  Ebola virus siRNA sense strand
acaagguuugacaucaaucua

SEQ ID NO: 9324 - RNA, 21 nt, Artificial Sequence
  Ebola virus siRNA sense strand
caagguuugacaucaaucuag

SEQ ID NO: 9325 - RNA, 21 nt, Artificial Sequence
  Ebola virus siRNA sense strand
aagguuugacaucaaucuagu

SEQ ID NO: 9326 - RNA, 21 nt, Artificial Sequence
  Ebola virus siRNA sense strand
agguuugacaucaaucuaguu

SEQ ID NO: 9327 - RNA, 21 nt, Artificial Sequence
  Ebola virus siRNA sense strand
gguuugacaucaaucuaguua

SEQ ID NO: 9328 - RNA, 21 nt, Artificial Sequence
  Ebola virus siRNA sense strand
guuugacaucaaucuaguuau

SEQ ID NO: 9329 - RNA, 21 nt, Artificial Sequence
  Ebola virus siRNA sense strand
uuugacaucaaucuaguuauc

SEQ ID NO: 9330 - RNA, 21 nt, Artificial Sequence
  Ebola virus siRNA sense strand
uugacaucaaucuaguuaucu

SEQ ID NO: 9331 - RNA, 21 nt, Artificial Sequence
  Ebola virus siRNA sense strand
ugacaucaaucuaguuaucuc

SEQ ID NO: 9332 - RNA, 21 nt, Artificial Sequence
  Ebola virus siRNA sense strand
gacaucaaucuaguuaucucu

SEQ ID NO: 9333 - RNA, 21 nt, Artificial Sequence
  Ebola virus siRNA sense strand
acaucaaucuaguuaucucuu

SEQ ID NO: 9334 - RNA, 21 nt, Artificial Sequence
  Ebola virus siRNA sense strand
caucaaucuaguuaucucuuu

SEQ ID NO: 9335 - RNA, 21 nt, Artificial Sequence
  Ebola virus siRNA sense strand
aucaaucuaguuaucucuuug

SEQ ID NO: 9336 - RNA, 21 nt, Artificial Sequence
  Ebola virus siRNA sense strand
ucaaucuaguuaucucuuuga

SEQ ID NO: 9337 - RNA, 21 nt, Artificial Sequence
  Ebola virus siRNA sense strand
caaucuaguuaucucuuugag

SEQ ID NO: 9338 - RNA, 21 nt, Artificial Sequence
  Ebola virus siRNA sense strand
aaucuaguuaucucuuugaga

SEQ ID NO: 9339 - RNA, 21 nt, Artificial Sequence
  Ebola virus siRNA sense strand
aucuaguuaucucuuugagaa

SEQ ID NO: 9340 - RNA, 21 nt, Artificial Sequence
  Ebola virus siRNA sense strand
ucuaguuaucucuuugagaau

SEQ ID NO: 9341 - RNA, 21 nt, Artificial Sequence
  Ebola virus siRNA sense strand
cuaguuaucucuuugagaaug

SEQ ID NO: 9342 - RNA, 21 nt, Artificial Sequence
  Ebola virus siRNA sense strand
uaguuaucucuuugagaauga

SEQ ID NO: 9343 - RNA, 21 nt, Artificial Sequence
  Ebola virus siRNA sense strand
aguuaucucuuugagaaugau

SEQ ID NO: 9344 - RNA, 21 nt, Artificial Sequence
  Ebola virus siRNA sense strand
guuaucucuuugagaaugaua

SEQ ID NO: 9345 - RNA, 21 nt, Artificial Sequence
  Ebola virus siRNA sense strand
uuaucucuuugagaaugauaa

SEQ ID NO: 9346 - RNA, 21 nt, Artificial Sequence
  Ebola virus siRNA sense strand
uaucucuuugagaaugauaaa

SEQ ID NO: 9347 - RNA, 21 nt, Artificial Sequence
  Ebola virus siRNA sense strand
aucucuuugagaaugauaaac

SEQ ID NO: 9348 - RNA, 21 nt, Artificial Sequence
  Ebola virus siRNA sense strand
ucucuuugagaaugauaaacu

SEQ ID NO: 9349 - RNA, 21 nt, Artificial Sequence
  Ebola virus siRNA sense strand
cucuuugagaaugauaaacuu

SEQ ID NO: 9350 - RNA, 21 nt, Artificial Sequence
  Ebola virus siRNA sense strand
ucuuugagaaugauaaacuug

SEQ ID NO: 9351 - RNA, 21 nt, Artificial Sequence
  Ebola virus siRNA sense strand
cuuugagaaugauaaacuuga

SEQ ID NO: 9352 - RNA, 21 nt, Artificial Sequence
  Ebola virus siRNA sense strand
uuugagaaugauaaacuugau

SEQ ID NO: 9353 - RNA, 21 nt, Artificial Sequence
  Ebola virus siRNA sense strand
uugagaaugauaaacuugaug

SEQ ID NO: 9354 - RNA, 21 nt, Artificial Sequence
  Ebola virus siRNA sense strand
ugagaaugauaaacuugauga

SEQ ID NO: 9355 - RNA, 21 nt, Artificial Sequence
  Ebola virus siRNA sense strand
gagaaugauaaacuugaugaa

SEQ ID NO: 9356 - RNA, 21 nt, Artificial Sequence
  Ebola virus siRNA sense strand
agaaugauaaacuugaugaag

SEQ ID NO: 9357 - RNA, 21 nt, Artificial Sequence
  Ebola virus siRNA sense strand
gaaugauaaacuugaugaaga

SEQ ID NO: 9358 - RNA, 21 nt, Artificial Sequence
  Ebola virus siRNA sense strand
aaugauaaacuugaugaagau

SEQ ID NO: 9359 - RNA, 21 nt, Artificial Sequence
  Ebola virus siRNA sense strand
augauaaacuugaugaagauu

SEQ ID NO: 9360 - RNA, 21 nt, Artificial Sequence
  Ebola virus siRNA sense strand
ugauaaacuugaugaagauua

SEQ ID NO: 9361 - RNA, 21 nt, Artificial Sequence
  Ebola virus siRNA sense strand
gauaaacuugaugaagauuaa

SEQ ID NO: 9362 - RNA, 21 nt, Artificial Sequence
  Ebola virus siRNA sense strand
auaaacuugaugaagauuaag

SEQ ID NO: 9363 - RNA, 21 nt, Artificial Sequence
  Ebola virus siRNA sense strand
uaaacuugaugaagauuaaga

SEQ ID NO: 9364 - RNA, 21 nt, Artificial Sequence
  Ebola virus siRNA sense strand
aaacuugaugaagauuaagaa

SEQ ID NO: 9365 - RNA, 21 nt, Artificial Sequence
  Ebola virus siRNA sense strand
aacuugaugaagauuaagaaa

SEQ ID NO: 9366 - RNA, 21 nt, Artificial Sequence
  Ebola virus siRNA sense strand
acuugaugaagauuaagaaaa

SEQ ID NO: 9367 - RNA, 21 nt, Artificial Sequence
  Ebola virus siRNA sense strand
cuugaugaagauuaagaaaaa

SEQ ID NO: 9368 - RNA, 21 nt, Artificial Sequence
  Ebola virus siRNA sense strand
uugaugaagauuaagaaaaag

SEQ ID NO: 9369 - RNA, 21 nt, Artificial Sequence
  Ebola virus siRNA sense strand
ugaugaagauuaagaaaaagg

SEQ ID NO: 9370 - RNA, 21 nt, Artificial Sequence
  Ebola virus siRNA sense strand
gaugaagauuaagaaaaaggu

SEQ ID NO: 9371 - RNA, 21 nt, Artificial Sequence
  Ebola virus siRNA sense strand
augaagauuaagaaaaaggua

SEQ ID NO: 9372 - RNA, 21 nt, Artificial Sequence
  Ebola virus siRNA sense strand
ugaagauuaagaaaaagguaa

SEQ ID NO: 9373 - RNA, 21 nt, Artificial Sequence
  Ebola virus siRNA sense strand
gaagauuaagaaaaagguaau

SEQ ID NO: 9374 - RNA, 21 nt, Artificial Sequence
  Ebola virus siRNA sense strand
aagauuaagaaaaagguaauc

SEQ ID NO: 9375 - RNA, 21 nt, Artificial Sequence
  Ebola virus siRNA sense strand
agauuaagaaaaagguaaucu

SEQ ID NO: 9376 - RNA, 21 nt, Artificial Sequence
  Ebola virus siRNA sense strand
gauuaagaaaaagguaaucuu

SEQ ID NO: 9377 - RNA, 21 nt, Artificial Sequence
  Ebola virus siRNA sense strand
auuaagaaaaagguaaucuuu

SEQ ID NO: 9378 - RNA, 21 nt, Artificial Sequence
  Ebola virus siRNA sense strand
uuaagaaaaagguaaucuuuc

SEQ ID NO: 9379 - RNA, 21 nt, Artificial Sequence
  Ebola virus siRNA sense strand
uaagaaaaagguaaucuuucg

SEQ ID NO: 9380 - RNA, 21 nt, Artificial Sequence
  Ebola virus siRNA sense strand
aagaaaaagguaaucuuucga

SEQ ID NO: 9381 - RNA, 21 nt, Artificial Sequence
  Ebola virus siRNA sense strand
agaaaaagguaaucuuucgau

SEQ ID NO: 9382 - RNA, 21 nt, Artificial Sequence
  Ebola virus siRNA sense strand
gaaaaagguaaucuuucgauu

SEQ ID NO: 9383 - RNA, 21 nt, Artificial Sequence
  Ebola virus siRNA sense strand
aaaaagguaaucuuucgauua

SEQ ID NO: 9384 - RNA, 21 nt, Artificial Sequence
  Ebola virus siRNA sense strand
aaaagguaaucuuucgauuau

SEQ ID NO: 9385 - RNA, 21 nt, Artificial Sequence
  Ebola virus siRNA sense strand
aaagguaaucuuucgauuauc

SEQ ID NO: 9386 - RNA, 21 nt, Artificial Sequence
  Ebola virus siRNA sense strand
aagguaaucuuucgauuaucu

SEQ ID NO: 9387 - RNA, 21 nt, Artificial Sequence
  Ebola virus siRNA sense strand
agguaaucuuucgauuaucuu

SEQ ID NO: 9388 - RNA, 21 nt, Artificial Sequence
  Ebola virus siRNA sense strand
gguaaucuuucgauuaucuuu

SEQ ID NO: 9389 - RNA, 21 nt, Artificial Sequence
  Ebola virus siRNA sense strand
guaaucuuucgauuaucuuua

SEQ ID NO: 9390 - RNA, 21 nt, Artificial Sequence
  Ebola virus siRNA sense strand
uaaucuuucgauuaucuuuaa

SEQ ID NO: 9391 - RNA, 21 nt, Artificial Sequence
  Ebola virus siRNA sense strand
aaucuuucgauuaucuuuaau

SEQ ID NO: 9392 - RNA, 21 nt, Artificial Sequence
  Ebola virus siRNA sense strand
aucuuucgauuaucuuuaauc

SEQ ID NO: 9393 - RNA, 21 nt, Artificial Sequence
  Ebola virus siRNA sense strand
ucuuucgauuaucuuuaaucu

SEQ ID NO: 9394 - RNA, 21 nt, Artificial Sequence
  Ebola virus siRNA sense strand
cuuucgauuaucuuuaaucuu

SEQ ID NO: 9395 - RNA, 21 nt, Artificial Sequence
  Ebola virus siRNA sense strand
uuucgauuaucuuuaaucuuc

SEQ ID NO: 9396 - RNA, 21 nt, Artificial Sequence
  Ebola virus siRNA sense strand
uucgauuaucuuuaaucuuca

SEQ ID NO: 9397 - RNA, 21 nt, Artificial Sequence
  Ebola virus siRNA sense strand
ucgauuaucuuuaaucuucau

SEQ ID NO: 9398 - RNA, 21 nt, Artificial Sequence
  Ebola virus siRNA sense strand
cgauuaucuuuaaucuucauc

SEQ ID NO: 9399 - RNA, 21 nt, Artificial Sequence
  Ebola virus siRNA sense strand
gauuaucuuuaaucuucaucc

SEQ ID NO: 9400 - RNA, 21 nt, Artificial Sequence
  Ebola virus siRNA sense strand
auuaucuuuaaucuucauccu

SEQ ID NO: 9401 - RNA, 21 nt, Artificial Sequence
  Ebola virus siRNA sense strand
uuaucuuuaaucuucauccuu

SEQ ID NO: 9402 - RNA, 21 nt, Artificial Sequence
  Ebola virus siRNA sense strand
uaucuuuaaucuucauccuug

SEQ ID NO: 9403 - RNA, 21 nt, Artificial Sequence
  Ebola virus siRNA sense strand
aucuuuaaucuucauccuuga

SEQ ID NO: 9404 - RNA, 21 nt, Artificial Sequence
  Ebola virus siRNA sense strand
ucuuuaaucuucauccuugau

SEQ ID NO: 9405 - RNA, 21 nt, Artificial Sequence
  Ebola virus siRNA sense strand
cuuuaaucuucauccuugauu

SEQ ID NO: 9406 - RNA, 21 nt, Artificial Sequence
  Ebola virus siRNA sense strand
uuuaaucuucauccuugauuc

SEQ ID NO: 9407 - RNA, 21 nt, Artificial Sequence
  Ebola virus siRNA sense strand
uuaaucuucauccuugauucu

SEQ ID NO: 9408 - RNA, 21 nt, Artificial Sequence
  Ebola virus siRNA sense strand
uaaucuucauccuugauucua

SEQ ID NO: 9409 - RNA, 21 nt, Artificial Sequence
  Ebola virus siRNA sense strand
aaucuucauccuugauucuac

SEQ ID NO: 9410 - RNA, 21 nt, Artificial Sequence
  Ebola virus siRNA sense strand
aucuucauccuugauucuaca

SEQ ID NO: 9411 - RNA, 21 nt, Artificial Sequence
  Ebola virus siRNA sense strand
ucuucauccuugauucuacaa

SEQ ID NO: 9412 - RNA, 21 nt, Artificial Sequence
  Ebola virus siRNA sense strand
cuucauccuugauucuacaau

SEQ ID NO: 9413 - RNA, 21 nt, Artificial Sequence
  Ebola virus siRNA sense strand
uucauccuugauucuacaauc

SEQ ID NO: 9414 - RNA, 21 nt, Artificial Sequence
  Ebola virus siRNA sense strand
ucauccuugauucuacaauca

SEQ ID NO: 9415 - RNA, 21 nt, Artificial Sequence
  Ebola virus siRNA sense strand
cauccuugauucuacaaucau

SEQ ID NO: 9416 - RNA, 21 nt, Artificial Sequence
  Ebola virus siRNA sense strand
auccuugauucuacaaucaug

SEQ ID NO: 9417 - RNA, 21 nt, Artificial Sequence
  Ebola virus siRNA sense strand
uccuugauucuacaaucauga

SEQ ID NO: 9418 - RNA, 21 nt, Artificial Sequence
  Ebola virus siRNA sense strand
ccuugauucuacaaucaugac

SEQ ID NO: 9419 - RNA, 21 nt, Artificial Sequence
  Ebola virus siRNA sense strand
cuugauucuacaaucaugaca

SEQ ID NO: 9420 - RNA, 21 nt, Artificial Sequence
  Ebola virus siRNA sense strand
uugauucuacaaucaugacag

SEQ ID NO: 9421 - RNA, 21 nt, Artificial Sequence
  Ebola virus siRNA sense strand
ugauucuacaaucaugacagu

SEQ ID NO: 9422 - RNA, 21 nt, Artificial Sequence
  Ebola virus siRNA sense strand
gauucuacaaucaugacaguu

SEQ ID NO: 9423 - RNA, 21 nt, Artificial Sequence
  Ebola virus siRNA sense strand
auucuacaaucaugacaguug

SEQ ID NO: 9424 - RNA, 21 nt, Artificial Sequence
  Ebola virus siRNA sense strand
uucuacaaucaugacaguugu

SEQ ID NO: 9425 - RNA, 21 nt, Artificial Sequence
  Ebola virus siRNA sense strand
ucuacaaucaugacaguuguc

SEQ ID NO: 9426 - RNA, 21 nt, Artificial Sequence
  Ebola virus siRNA sense strand
cuacaaucaugacaguugucu

SEQ ID NO: 9427 - RNA, 21 nt, Artificial Sequence
  Ebola virus siRNA sense strand
uacaaucaugacaguugucuu

SEQ ID NO: 9428 - RNA, 21 nt, Artificial Sequence
  Ebola virus siRNA sense strand
acaaucaugacaguugucuuu

SEQ ID NO: 9429 - RNA, 21 nt, Artificial Sequence
  Ebola virus siRNA sense strand
caaucaugacaguugucuuua

SEQ ID NO: 9430 - RNA, 21 nt, Artificial Sequence
  Ebola virus siRNA sense strand
aaucaugacaguugucuuuag

SEQ ID NO: 9431 - RNA, 21 nt, Artificial Sequence
  Ebola virus siRNA sense strand
aucaugacaguugucuuuagu

SEQ ID NO: 9432 - RNA, 21 nt, Artificial Sequence
  Ebola virus siRNA sense strand
ucaugacaguugucuuuagug

SEQ ID NO: 9433 - RNA, 21 nt, Artificial Sequence
  Ebola virus siRNA sense strand
caugacaguugucuuuaguga

SEQ ID NO: 9434 - RNA, 21 nt, Artificial Sequence
  Ebola virus siRNA sense strand
augacaguugucuuuagugac

SEQ ID NO: 9435 - RNA, 21 nt, Artificial Sequence
  Ebola virus siRNA sense strand
ugacaguugucuuuagugaca

SEQ ID NO: 9436 - RNA, 21 nt, Artificial Sequence
  Ebola virus siRNA sense strand
gacaguugucuuuagugacaa

SEQ ID NO: 9437 - RNA, 21 nt, Artificial Sequence
  Ebola virus siRNA sense strand
acaguugucuuuagugacaag

SEQ ID NO: 9438 - RNA, 21 nt, Artificial Sequence
  Ebola virus siRNA sense strand
caguugucuuuagugacaagg

SEQ ID NO: 9439 - RNA, 21 nt, Artificial Sequence
  Ebola virus siRNA sense strand
aguugucuuuagugacaaggg

SEQ ID NO: 9440 - RNA, 21 nt, Artificial Sequence
  Ebola virus siRNA sense strand
guugucuuuagugacaaggga

SEQ ID NO: 9441 - RNA, 21 nt, Artificial Sequence
  Ebola virus siRNA sense strand
uugucuuuagugacaagggaa

SEQ ID NO: 9442 - RNA, 21 nt, Artificial Sequence
  Ebola virus siRNA sense strand
ugucuuuagugacaagggaaa

SEQ ID NO: 9443 - RNA, 21 nt, Artificial Sequence
  Ebola virus siRNA sense strand
gucuuuagugacaagggaaag

SEQ ID NO: 9444 - RNA, 21 nt, Artificial Sequence
  Ebola virus siRNA sense strand
ucuuuagugacaagggaaaga

SEQ ID NO: 9445 - RNA, 21 nt, Artificial Sequence
  Ebola virus siRNA sense strand
cuuuagugacaagggaaagaa

SEQ ID NO: 9446 - RNA, 21 nt, Artificial Sequence
  Ebola virus siRNA sense strand
uuuagugacaagggaaagaag

SEQ ID NO: 9447 - RNA, 21 nt, Artificial Sequence
  Ebola virus siRNA sense strand
uuagugacaagggaaagaagc

SEQ ID NO: 9448 - RNA, 21 nt, Artificial Sequence
  Ebola virus siRNA sense strand
uagugacaagggaaagaagcc

SEQ ID NO: 9449 - RNA, 21 nt, Artificial Sequence
  Ebola virus siRNA sense strand
agugacaagggaaagaagccu

SEQ ID NO: 9450 - RNA, 21 nt, Artificial Sequence
  Ebola virus siRNA sense strand
gugacaagggaaagaagccuu

SEQ ID NO: 9451 - RNA, 21 nt, Artificial Sequence
  Ebola virus siRNA sense strand
ugacaagggaaagaagccuuu

SEQ ID NO: 9452 - RNA, 21 nt, Artificial Sequence
  Ebola virus siRNA sense strand
gacaagggaaagaagccuuuu

SEQ ID NO: 9453 - RNA, 21 nt, Artificial Sequence
  Ebola virus siRNA sense strand
acaagggaaagaagccuuuuu

SEQ ID NO: 9454 - RNA, 21 nt, Artificial Sequence
  Ebola virus siRNA sense strand
caagggaaagaagccuuuuua

SEQ ID NO: 9455 - RNA, 21 nt, Artificial Sequence
  Ebola virus siRNA sense strand
aagggaaagaagccuuuuuau

SEQ ID NO: 9456 - RNA, 21 nt, Artificial Sequence
  Ebola virus siRNA sense strand
agggaaagaagccuuuuuauu

SEQ ID NO: 9457 - RNA, 21 nt, Artificial Sequence
  Ebola virus siRNA sense strand
gggaaagaagccuuuuuauua

SEQ ID NO: 9458 - RNA, 21 nt, Artificial Sequence
  Ebola virus siRNA sense strand
ggaaagaagccuuuuuauuaa

SEQ ID NO: 9459 - RNA, 21 nt, Artificial Sequence
  Ebola virus siRNA sense strand
gaaagaagccuuuuuauuaag

SEQ ID NO: 9460 - RNA, 21 nt, Artificial Sequence
  Ebola virus siRNA sense strand
aaagaagccuuuuuauuaagu

SEQ ID NO: 9461 - RNA, 21 nt, Artificial Sequence
  Ebola virus siRNA sense strand
aagaagccuuuuuauuaaguu

SEQ ID NO: 9462 - RNA, 21 nt, Artificial Sequence
  Ebola virus siRNA sense strand
agaagccuuuuuauuaaguug

SEQ ID NO: 9463 - RNA, 21 nt, Artificial Sequence
  Ebola virus siRNA sense strand
gaagccuuuuuauuaaguugu

SEQ ID NO: 9464 - RNA, 21 nt, Artificial Sequence
  Ebola virus siRNA sense strand
aagccuuuuuauuaaguugua

SEQ ID NO: 9465 - RNA, 21 nt, Artificial Sequence
  Ebola virus siRNA sense strand
agccuuuuuauuaaguuguaa

SEQ ID NO: 9466 - RNA, 21 nt, Artificial Sequence
  Ebola virus siRNA sense strand
gccuuuuuauuaaguuguaau

SEQ ID NO: 9467 - RNA, 21 nt, Artificial Sequence
  Ebola virus siRNA sense strand
ccuuuuuauuaaguuguaaua

SEQ ID NO: 9468 - RNA, 21 nt, Artificial Sequence
  Ebola virus siRNA sense strand
cuuuuuauuaaguuguaauaa

SEQ ID NO: 9469 - RNA, 21 nt, Artificial Sequence
  Ebola virus siRNA sense strand
uuuuuauuaaguuguaauaau

SEQ ID NO: 9470 - RNA, 21 nt, Artificial Sequence
  Ebola virus siRNA sense strand
uuuuauuaaguuguaauaauc

SEQ ID NO: 9471 - RNA, 21 nt, Artificial Sequence
  Ebola virus siRNA sense strand
uuuauuaaguuguaauaauca

SEQ ID NO: 9472 - RNA, 21 nt, Artificial Sequence
  Ebola virus siRNA sense strand
uuauuaaguuguaauaaucag

SEQ ID NO: 9473 - RNA, 21 nt, Artificial Sequence
  Ebola virus siRNA sense strand
uauuaaguuguaauaaucaga

SEQ ID NO: 9474 - RNA, 21 nt, Artificial Sequence
  Ebola virus siRNA sense strand
auuaaguuguaauaaucagau

SEQ ID NO: 9475 - RNA, 21 nt, Artificial Sequence
  Ebola virus siRNA sense strand
uuaaguuguaauaaucagauc

SEQ ID NO: 9476 - RNA, 21 nt, Artificial Sequence
  Ebola virus siRNA sense strand
uaaguuguaauaaucagaucu

SEQ ID NO: 9477 - RNA, 21 nt, Artificial Sequence
  Ebola virus siRNA sense strand
aaguuguaauaaucagaucug

SEQ ID NO: 9478 - RNA, 21 nt, Artificial Sequence
  Ebola virus siRNA sense strand
aguuguaauaaucagaucugc

SEQ ID NO: 9479 - RNA, 21 nt, Artificial Sequence
  Ebola virus siRNA sense strand
guuguaauaaucagaucugcg

SEQ ID NO: 9480 - RNA, 21 nt, Artificial Sequence
  Ebola virus siRNA sense strand
uuguaauaaucagaucugcga

SEQ ID NO: 9481 - RNA, 21 nt, Artificial Sequence
  Ebola virus siRNA sense strand
uguaauaaucagaucugcgaa

SEQ ID NO: 9482 - RNA, 21 nt, Artificial Sequence
  Ebola virus siRNA sense strand
guaauaaucagaucugcgaac

SEQ ID NO: 9483 - RNA, 21 nt, Artificial Sequence
  Ebola virus siRNA sense strand
uaauaaucagaucugcgaacc

SEQ ID NO: 9484 - RNA, 21 nt, Artificial Sequence
  Ebola virus siRNA sense strand
aauaaucagaucugcgaaccg

SEQ ID NO: 9485 - RNA, 21 nt, Artificial Sequence
  Ebola virus siRNA sense strand
auaaucagaucugcgaaccgg

SEQ ID NO: 9486 - RNA, 21 nt, Artificial Sequence
  Ebola virus siRNA sense strand
uaaucagaucugcgaaccggu

SEQ ID NO: 9487 - RNA, 21 nt, Artificial Sequence
  Ebola virus siRNA sense strand
aaucagaucugcgaaccggua

SEQ ID NO: 9488 - RNA, 21 nt, Artificial Sequence
  Ebola virus siRNA sense strand
aucagaucugcgaaccgguag

SEQ ID NO: 9489 - RNA, 21 nt, Artificial Sequence
  Ebola virus siRNA sense strand
ucagaucugcgaaccgguaga

SEQ ID NO: 9490 - RNA, 21 nt, Artificial Sequence
  Ebola virus siRNA sense strand
cagaucugcgaaccgguagag

SEQ ID NO: 9491 - RNA, 21 nt, Artificial Sequence
  Ebola virus siRNA sense strand
agaucugcgaaccgguagagu

SEQ ID NO: 9492 - RNA, 21 nt, Artificial Sequence
  Ebola virus siRNA sense strand
gaucugcgaaccgguagaguu

SEQ ID NO: 9493 - RNA, 21 nt, Artificial Sequence
  Ebola virus siRNA sense strand
aucugcgaaccgguagaguuu

SEQ ID NO: 9494 - RNA, 21 nt, Artificial Sequence
  Ebola virus siRNA sense strand
ucugcgaaccgguagaguuua

SEQ ID NO: 9495 - RNA, 21 nt, Artificial Sequence
  Ebola virus siRNA sense strand
cugcgaaccgguagaguuuag

SEQ ID NO: 9496 - RNA, 21 nt, Artificial Sequence
  Ebola virus siRNA sense strand
ugcgaaccgguagaguuuagu

SEQ ID NO: 9497 - RNA, 21 nt, Artificial Sequence
  Ebola virus siRNA sense strand
gcgaaccgguagaguuuaguu

SEQ ID NO: 9498 - RNA, 21 nt, Artificial Sequence
  Ebola virus siRNA sense strand
cgaaccgguagaguuuaguug

SEQ ID NO: 9499 - RNA, 21 nt, Artificial Sequence
  Ebola virus siRNA sense strand
gaaccgguagaguuuaguugc

SEQ ID NO: 9500 - RNA, 21 nt, Artificial Sequence
  Ebola virus siRNA sense strand
aaccgguagaguuuaguugca

SEQ ID NO: 9501 - RNA, 21 nt, Artificial Sequence
  Ebola virus siRNA sense strand
accgguagaguuuaguugcaa

SEQ ID NO: 9502 - RNA, 21 nt, Artificial Sequence
  Ebola virus siRNA sense strand
ccgguagaguuuaguugcaac

SEQ ID NO: 9503 - RNA, 21 nt, Artificial Sequence
  Ebola virus siRNA sense strand
cgguagaguuuaguugcaacc

SEQ ID NO: 9504 - RNA, 21 nt, Artificial Sequence
  Ebola virus siRNA sense strand
gguagaguuuaguugcaaccu

SEQ ID NO: 9505 - RNA, 21 nt, Artificial Sequence
  Ebola virus siRNA sense strand
guagaguuuaguugcaaccua

SEQ ID NO: 9506 - RNA, 21 nt, Artificial Sequence
  Ebola virus siRNA sense strand
uagaguuuaguugcaaccuaa

SEQ ID NO: 9507 - RNA, 21 nt, Artificial Sequence
  Ebola virus siRNA sense strand
agaguuuaguugcaaccuaac

SEQ ID NO: 9508 - RNA, 21 nt, Artificial Sequence
  Ebola virus siRNA sense strand
gaguuuaguugcaaccuaaca

SEQ ID NO: 9509 - RNA, 21 nt, Artificial Sequence
  Ebola virus siRNA sense strand
aguuuaguugcaaccuaacac

SEQ ID NO: 9510 - RNA, 21 nt, Artificial Sequence
  Ebola virus siRNA sense strand
guuuaguugcaaccuaacaca

SEQ ID NO: 9511 - RNA, 21 nt, Artificial Sequence
  Ebola virus siRNA sense strand
uuuaguugcaaccuaacacac

SEQ ID NO: 9512 - RNA, 21 nt, Artificial Sequence
  Ebola virus siRNA sense strand
uuaguugcaaccuaacacaca

SEQ ID NO: 9513 - RNA, 21 nt, Artificial Sequence
  Ebola virus siRNA sense strand
uaguugcaaccuaacacacau

SEQ ID NO: 9514 - RNA, 21 nt, Artificial Sequence
  Ebola virus siRNA sense strand
aguugcaaccuaacacacaua

SEQ ID NO: 9515 - RNA, 21 nt, Artificial Sequence
  Ebola virus siRNA sense strand
guugcaaccuaacacacauaa

SEQ ID NO: 9516 - RNA, 21 nt, Artificial Sequence
  Ebola virus siRNA sense strand
uugcaaccuaacacacauaaa

SEQ ID NO: 9517 - RNA, 21 nt, Artificial Sequence
  Ebola virus siRNA sense strand
ugcaaccuaacacacauaaag

SEQ ID NO: 9518 - RNA, 21 nt, Artificial Sequence
  Ebola virus siRNA sense strand
gcaaccuaacacacauaaagc

SEQ ID NO: 9519 - RNA, 21 nt, Artificial Sequence
  Ebola virus siRNA sense strand
caaccuaacacacauaaagca

SEQ ID NO: 9520 - RNA, 21 nt, Artificial Sequence
  Ebola virus siRNA sense strand
aaccuaacacacauaaagcau

SEQ ID NO: 9521 - RNA, 21 nt, Artificial Sequence
  Ebola virus siRNA sense strand
accuaacacacauaaagcauu

SEQ ID NO: 9522 - RNA, 21 nt, Artificial Sequence
  Ebola virus siRNA sense strand
ccuaacacacauaaagcauug

SEQ ID NO: 9523 - RNA, 21 nt, Artificial Sequence
  Ebola virus siRNA sense strand
cuaacacacauaaagcauugg

SEQ ID NO: 9524 - RNA, 21 nt, Artificial Sequence
  Ebola virus siRNA sense strand
uaacacacauaaagcauuggu

SEQ ID NO: 9525 - RNA, 21 nt, Artificial Sequence
  Ebola virus siRNA sense strand
aacacacauaaagcauugguc

SEQ ID NO: 9526 - RNA, 21 nt, Artificial Sequence
  Ebola virus siRNA sense strand
acacacauaaagcauugguca

SEQ ID NO: 9527 - RNA, 21 nt, Artificial Sequence
  Ebola virus siRNA sense strand
cacacauaaagcauuggucaa

SEQ ID NO: 9528 - RNA, 21 nt, Artificial Sequence
  Ebola virus siRNA sense strand
acacauaaagcauuggucaaa

SEQ ID NO: 9529 - RNA, 21 nt, Artificial Sequence
  Ebola virus siRNA sense strand
cacauaaagcauuggucaaaa

SEQ ID NO: 9530 - RNA, 21 nt, Artificial Sequence
  Ebola virus siRNA sense strand
acauaaagcauuggucaaaaa

SEQ ID NO: 9531 - RNA, 21 nt, Artificial Sequence
  Ebola virus siRNA sense strand
cauaaagcauuggucaaaaag

SEQ ID NO: 9532 - RNA, 21 nt, Artificial Sequence
  Ebola virus siRNA sense strand
auaaagcauuggucaaaaagu

SEQ ID NO: 9533 - RNA, 21 nt, Artificial Sequence
  Ebola virus siRNA sense strand
uaaagcauuggucaaaaaguc

SEQ ID NO: 9534 - RNA, 21 nt, Artificial Sequence
  Ebola virus siRNA sense strand
aaagcauuggucaaaaaguca

SEQ ID NO: 9535 - RNA, 21 nt, Artificial Sequence
  Ebola virus siRNA sense strand
aagcauuggucaaaaagucaa

SEQ ID NO: 9536 - RNA, 21 nt, Artificial Sequence
  Ebola virus siRNA sense strand
agcauuggucaaaaagucaau

SEQ ID NO: 9537 - RNA, 21 nt, Artificial Sequence
  Ebola virus siRNA sense strand
gcauuggucaaaaagucaaua

SEQ ID NO: 9538 - RNA, 21 nt, Artificial Sequence
  Ebola virus siRNA sense strand
cauuggucaaaaagucaauag

SEQ ID NO: 9539 - RNA, 21 nt, Artificial Sequence
  Ebola virus siRNA sense strand
auuggucaaaaagucaauaga

SEQ ID NO: 9540 - RNA, 21 nt, Artificial Sequence
  Ebola virus siRNA sense strand
uuggucaaaaagucaauagaa

SEQ ID NO: 9541 - RNA, 21 nt, Artificial Sequence
  Ebola virus siRNA sense strand
uggucaaaaagucaauagaaa

SEQ ID NO: 9542 - RNA, 21 nt, Artificial Sequence
  Ebola virus siRNA sense strand
ggucaaaaagucaauagaaau

SEQ ID NO: 9543 - RNA, 21 nt, Artificial Sequence
  Ebola virus siRNA sense strand
gucaaaaagucaauagaaauu

SEQ ID NO: 9544 - RNA, 21 nt, Artificial Sequence
  Ebola virus siRNA sense strand
ucaaaaagucaauagaaauuu

SEQ ID NO: 9545 - RNA, 21 nt, Artificial Sequence
  Ebola virus siRNA sense strand
caaaaagucaauagaaauuua

SEQ ID NO: 9546 - RNA, 21 nt, Artificial Sequence
  Ebola virus siRNA sense strand
aaaaagucaauagaaauuuaa

SEQ ID NO: 9547 - RNA, 21 nt, Artificial Sequence
  Ebola virus siRNA sense strand
aaaagucaauagaaauuuaaa

SEQ ID NO: 9548 - RNA, 21 nt, Artificial Sequence
  Ebola virus siRNA sense strand
aaagucaauagaaauuuaaac

SEQ ID NO: 9549 - RNA, 21 nt, Artificial Sequence
  Ebola virus siRNA sense strand
aagucaauagaaauuuaaaca

SEQ ID NO: 9550 - RNA, 21 nt, Artificial Sequence
  Ebola virus siRNA sense strand
agucaauagaaauuuaaacag

SEQ ID NO: 9551 - RNA, 21 nt, Artificial Sequence
  Ebola virus siRNA sense strand
gucaauagaaauuuaaacagu

SEQ ID NO: 9552 - RNA, 21 nt, Artificial Sequence
  Ebola virus siRNA sense strand
ucaauagaaauuuaaacagug

SEQ ID NO: 9553 - RNA, 21 nt, Artificial Sequence
  Ebola virus siRNA sense strand
caauagaaauuuaaacaguga

SEQ ID NO: 9554 - RNA, 21 nt, Artificial Sequence
  Ebola virus siRNA sense strand
aauagaaauuuaaacagugag

SEQ ID NO: 9555 - RNA, 21 nt, Artificial Sequence
  Ebola virus siRNA sense strand
auagaaauuuaaacagugagu

SEQ ID NO: 9556 - RNA, 21 nt, Artificial Sequence
  Ebola virus siRNA sense strand
uagaaauuuaaacagugagug

SEQ ID NO: 9557 - RNA, 21 nt, Artificial Sequence
  Ebola virus siRNA sense strand
agaaauuuaaacagugagugg

SEQ ID NO: 9558 - RNA, 21 nt, Artificial Sequence
  Ebola virus siRNA sense strand
gaaauuuaaacagugagugga

SEQ ID NO: 9559 - RNA, 21 nt, Artificial Sequence
  Ebola virus siRNA sense strand
aaauuuaaacagugaguggag

SEQ ID NO: 9560 - RNA, 21 nt, Artificial Sequence
  Ebola virus siRNA sense strand
aauuuaaacagugaguggaga

SEQ ID NO: 9561 - RNA, 21 nt, Artificial Sequence
  Ebola virus siRNA sense strand
auuuaaacagugaguggagac

SEQ ID NO: 9562 - RNA, 21 nt, Artificial Sequence
  Ebola virus siRNA sense strand
uuuaaacagugaguggagaca

SEQ ID NO: 9563 - RNA, 21 nt, Artificial Sequence
  Ebola virus siRNA sense strand
uuaaacagugaguggagacaa

SEQ ID NO: 9564 - RNA, 21 nt, Artificial Sequence
  Ebola virus siRNA sense strand
uaaacagugaguggagacaac

SEQ ID NO: 9565 - RNA, 21 nt, Artificial Sequence
  Ebola virus siRNA sense strand
aaacagugaguggagacaacu

SEQ ID NO: 9566 - RNA, 21 nt, Artificial Sequence
  Ebola virus siRNA sense strand
aacagugaguggagacaacuu

SEQ ID NO: 9567 - RNA, 21 nt, Artificial Sequence
  Ebola virus siRNA sense strand
acagugaguggagacaacuuu

SEQ ID NO: 9568 - RNA, 21 nt, Artificial Sequence
  Ebola virus siRNA sense strand
cagugaguggagacaacuuuu

SEQ ID NO: 9569 - RNA, 21 nt, Artificial Sequence
  Ebola virus siRNA sense strand
agugaguggagacaacuuuua

SEQ ID NO: 9570 - RNA, 21 nt, Artificial Sequence
  Ebola virus siRNA sense strand
gugaguggagacaacuuuuaa

SEQ ID NO: 9571 - RNA, 21 nt, Artificial Sequence
  Ebola virus siRNA sense strand
ugaguggagacaacuuuuaaa

SEQ ID NO: 9572 - RNA, 21 nt, Artificial Sequence
  Ebola virus siRNA sense strand
gaguggagacaacuuuuaaau

SEQ ID NO: 9573 - RNA, 21 nt, Artificial Sequence
  Ebola virus siRNA sense strand
aguggagacaacuuuuaaaug

SEQ ID NO: 9574 - RNA, 21 nt, Artificial Sequence
  Ebola virus siRNA sense strand
guggagacaacuuuuaaaugg

SEQ ID NO: 9575 - RNA, 21 nt, Artificial Sequence
  Ebola virus siRNA sense strand
uggagacaacuuuuaaaugga

SEQ ID NO: 9576 - RNA, 21 nt, Artificial Sequence
  Ebola virus siRNA sense strand
ggagacaacuuuuaaauggaa

SEQ ID NO: 9577 - RNA, 21 nt, Artificial Sequence
  Ebola virus siRNA sense strand
gagacaacuuuuaaauggaag

SEQ ID NO: 9578 - RNA, 21 nt, Artificial Sequence
  Ebola virus siRNA sense strand
agacaacuuuuaaauggaagc

SEQ ID NO: 9579 - RNA, 21 nt, Artificial Sequence
  Ebola virus siRNA sense strand
gacaacuuuuaaauggaagcu

SEQ ID NO: 9580 - RNA, 21 nt, Artificial Sequence
  Ebola virus siRNA sense strand
acaacuuuuaaauggaagcuu

SEQ ID NO: 9581 - RNA, 21 nt, Artificial Sequence
  Ebola virus siRNA sense strand
caacuuuuaaauggaagcuuc

SEQ ID NO: 9582 - RNA, 21 nt, Artificial Sequence
  Ebola virus siRNA sense strand
aacuuuuaaauggaagcuuca

SEQ ID NO: 9583 - RNA, 21 nt, Artificial Sequence
  Ebola virus siRNA sense strand
acuuuuaaauggaagcuucau

SEQ ID NO: 9584 - RNA, 21 nt, Artificial Sequence
  Ebola virus siRNA sense strand
cuuuuaaauggaagcuucaua

SEQ ID NO: 9585 - RNA, 21 nt, Artificial Sequence
  Ebola virus siRNA sense strand
uuuuaaauggaagcuucauau

SEQ ID NO: 9586 - RNA, 21 nt, Artificial Sequence
  Ebola virus siRNA sense strand
uuuaaauggaagcuucauaug

SEQ ID NO: 9587 - RNA, 21 nt, Artificial Sequence
  Ebola virus siRNA sense strand
uuaaauggaagcuucauauga

SEQ ID NO: 9588 - RNA, 21 nt, Artificial Sequence
  Ebola virus siRNA sense strand
uaaauggaagcuucauaugag

SEQ ID NO: 9589 - RNA, 21 nt, Artificial Sequence
  Ebola virus siRNA sense strand
aaauggaagcuucauaugaga

SEQ ID NO: 9590 - RNA, 21 nt, Artificial Sequence
  Ebola virus siRNA sense strand
aauggaagcuucauaugagag

SEQ ID NO: 9591 - RNA, 21 nt, Artificial Sequence
  Ebola virus siRNA sense strand
auggaagcuucauaugagaga

SEQ ID NO: 9592 - RNA, 21 nt, Artificial Sequence
  Ebola virus siRNA sense strand
uggaagcuucauaugagagag

SEQ ID NO: 9593 - RNA, 21 nt, Artificial Sequence
  Ebola virus siRNA sense strand
ggaagcuucauaugagagagg

SEQ ID NO: 9594 - RNA, 21 nt, Artificial Sequence
  Ebola virus siRNA sense strand
gaagcuucauaugagagagga

SEQ ID NO: 9595 - RNA, 21 nt, Artificial Sequence
  Ebola virus siRNA sense strand
aagcuucauaugagagaggac

SEQ ID NO: 9596 - RNA, 21 nt, Artificial Sequence
  Ebola virus siRNA sense strand
agcuucauaugagagaggacg

SEQ ID NO: 9597 - RNA, 21 nt, Artificial Sequence
  Ebola virus siRNA sense strand
gcuucauaugagagaggacgc

SEQ ID NO: 9598 - RNA, 21 nt, Artificial Sequence
  Ebola virus siRNA sense strand
cuucauaugagagaggacgcc

SEQ ID NO: 9599 - RNA, 21 nt, Artificial Sequence
  Ebola virus siRNA sense strand
uucauaugagagaggacgccc

SEQ ID NO: 9600 - RNA, 21 nt, Artificial Sequence
  Ebola virus siRNA sense strand
ucauaugagagaggacgccca

SEQ ID NO: 9601 - RNA, 21 nt, Artificial Sequence
  Ebola virus siRNA sense strand
cauaugagagaggacgcccac

SEQ ID NO: 9602 - RNA, 21 nt, Artificial Sequence
  Ebola virus siRNA sense strand
auaugagagaggacgcccacg

SEQ ID NO: 9603 - RNA, 21 nt, Artificial Sequence
  Ebola virus siRNA sense strand
uaugagagaggacgcccacga

SEQ ID NO: 9604 - RNA, 21 nt, Artificial Sequence
  Ebola virus siRNA sense strand
augagagaggacgcccacgag

SEQ ID NO: 9605 - RNA, 21 nt, Artificial Sequence
  Ebola virus siRNA sense strand
ugagagaggacgcccacgagc

SEQ ID NO: 9606 - RNA, 21 nt, Artificial Sequence
  Ebola virus siRNA sense strand
gagagaggacgcccacgagcu

SEQ ID NO: 9607 - RNA, 21 nt, Artificial Sequence
  Ebola virus siRNA sense strand
agagaggacgcccacgagcug

SEQ ID NO: 9608 - RNA, 21 nt, Artificial Sequence
  Ebola virus siRNA sense strand
gagaggacgcccacgagcugc

SEQ ID NO: 9609 - RNA, 21 nt, Artificial Sequence
  Ebola virus siRNA sense strand
agaggacgcccacgagcugcc

SEQ ID NO: 9610 - RNA, 21 nt, Artificial Sequence
  Ebola virus siRNA sense strand
gaggacgcccacgagcugcca

SEQ ID NO: 9611 - RNA, 21 nt, Artificial Sequence
  Ebola virus siRNA sense strand
aggacgcccacgagcugccag

SEQ ID NO: 9612 - RNA, 21 nt, Artificial Sequence
  Ebola virus siRNA sense strand
ggacgcccacgagcugccaga

SEQ ID NO: 9613 - RNA, 21 nt, Artificial Sequence
  Ebola virus siRNA sense strand
gacgcccacgagcugccagac

SEQ ID NO: 9614 - RNA, 21 nt, Artificial Sequence
  Ebola virus siRNA sense strand
acgcccacgagcugccagaca

SEQ ID NO: 9615 - RNA, 21 nt, Artificial Sequence
  Ebola virus siRNA sense strand
cgcccacgagcugccagacag

SEQ ID NO: 9616 - RNA, 21 nt, Artificial Sequence
  Ebola virus siRNA sense strand
gcccacgagcugccagacagc

SEQ ID NO: 9617 - RNA, 21 nt, Artificial Sequence
  Ebola virus siRNA sense strand
cccacgagcugccagacagca

SEQ ID NO: 9618 - RNA, 21 nt, Artificial Sequence
  Ebola virus siRNA sense strand
ccacgagcugccagacagcau

SEQ ID NO: 9619 - RNA, 21 nt, Artificial Sequence
  Ebola virus siRNA sense strand
cacgagcugccagacagcauu

SEQ ID NO: 9620 - RNA, 21 nt, Artificial Sequence
  Ebola virus siRNA sense strand
acgagcugccagacagcauuc

SEQ ID NO: 9621 - RNA, 21 nt, Artificial Sequence
  Ebola virus siRNA sense strand
cgagcugccagacagcauuca

SEQ ID NO: 9622 - RNA, 21 nt, Artificial Sequence
  Ebola virus siRNA sense strand
gagcugccagacagcauucaa

SEQ ID NO: 9623 - RNA, 21 nt, Artificial Sequence
  Ebola virus siRNA sense strand
agcugccagacagcauucaag

SEQ ID NO: 9624 - RNA, 21 nt, Artificial Sequence
  Ebola virus siRNA sense strand
gcugccagacagcauucaagg

SEQ ID NO: 9625 - RNA, 21 nt, Artificial Sequence
  Ebola virus siRNA sense strand
cugccagacagcauucaaggg

SEQ ID NO: 9626 - RNA, 21 nt, Artificial Sequence
  Ebola virus siRNA sense strand
ugccagacagcauucaaggga

SEQ ID NO: 9627 - RNA, 21 nt, Artificial Sequence
  Ebola virus siRNA sense strand
gccagacagcauucaagggau

SEQ ID NO: 9628 - RNA, 21 nt, Artificial Sequence
  Ebola virus siRNA sense strand
ccagacagcauucaagggaug

SEQ ID NO: 9629 - RNA, 21 nt, Artificial Sequence
  Ebola virus siRNA sense strand
cagacagcauucaagggaugg

SEQ ID NO: 9630 - RNA, 21 nt, Artificial Sequence
  Ebola virus siRNA sense strand
agacagcauucaagggaugga

SEQ ID NO: 9631 - RNA, 21 nt, Artificial Sequence
  Ebola virus siRNA sense strand
gacagcauucaagggauggac

SEQ ID NO: 9632 - RNA, 21 nt, Artificial Sequence
  Ebola virus siRNA sense strand
acagcauucaagggauggaca

SEQ ID NO: 9633 - RNA, 21 nt, Artificial Sequence
  Ebola virus siRNA sense strand
cagcauucaagggauggacac

SEQ ID NO: 9634 - RNA, 21 nt, Artificial Sequence
  Ebola virus siRNA sense strand
agcauucaagggauggacacg

SEQ ID NO: 9635 - RNA, 21 nt, Artificial Sequence
  Ebola virus siRNA sense strand
gcauucaagggauggacacga

SEQ ID NO: 9636 - RNA, 21 nt, Artificial Sequence
  Ebola virus siRNA sense strand
cauucaagggauggacacgac

SEQ ID NO: 9637 - RNA, 21 nt, Artificial Sequence
  Ebola virus siRNA sense strand
auucaagggauggacacgacc

SEQ ID NO: 9638 - RNA, 21 nt, Artificial Sequence
  Ebola virus siRNA sense strand
uucaagggauggacacgacca

SEQ ID NO: 9639 - RNA, 21 nt, Artificial Sequence
  Ebola virus siRNA sense strand
ucaagggauggacacgaccac

SEQ ID NO: 9640 - RNA, 21 nt, Artificial Sequence
  Ebola virus siRNA sense strand
caagggauggacacgaccacc

SEQ ID NO: 9641 - RNA, 21 nt, Artificial Sequence
  Ebola virus siRNA sense strand
aagggauggacacgaccacca

SEQ ID NO: 9642 - RNA, 21 nt, Artificial Sequence
  Ebola virus siRNA sense strand
agggauggacacgaccaccau

SEQ ID NO: 9643 - RNA, 21 nt, Artificial Sequence
  Ebola virus siRNA sense strand
gggauggacacgaccaccaug

SEQ ID NO: 9644 - RNA, 21 nt, Artificial Sequence
  Ebola virus siRNA sense strand
ggauggacacgaccaccaugu

SEQ ID NO: 9645 - RNA, 21 nt, Artificial Sequence
  Ebola virus siRNA sense strand
gauggacacgaccaccauguu

SEQ ID NO: 9646 - RNA, 21 nt, Artificial Sequence
  Ebola virus siRNA sense strand
auggacacgaccaccauguuc

SEQ ID NO: 9647 - RNA, 21 nt, Artificial Sequence
  Ebola virus siRNA sense strand
uggacacgaccaccauguucg

SEQ ID NO: 9648 - RNA, 21 nt, Artificial Sequence
  Ebola virus siRNA sense strand
ggacacgaccaccauguucga

SEQ ID NO: 9649 - RNA, 21 nt, Artificial Sequence
  Ebola virus siRNA sense strand
gacacgaccaccauguucgag

SEQ ID NO: 9650 - RNA, 21 nt, Artificial Sequence
  Ebola virus siRNA sense strand
acacgaccaccauguucgagc

SEQ ID NO: 9651 - RNA, 21 nt, Artificial Sequence
  Ebola virus siRNA sense strand
cacgaccaccauguucgagca

SEQ ID NO: 9652 - RNA, 21 nt, Artificial Sequence
  Ebola virus siRNA sense strand
acgaccaccauguucgagcac

SEQ ID NO: 9653 - RNA, 21 nt, Artificial Sequence
  Ebola virus siRNA sense strand
cgaccaccauguucgagcacg

SEQ ID NO: 9654 - RNA, 21 nt, Artificial Sequence
  Ebola virus siRNA sense strand
gaccaccauguucgagcacga

SEQ ID NO: 9655 - RNA, 21 nt, Artificial Sequence
  Ebola virus siRNA sense strand
accaccauguucgagcacgau

SEQ ID NO: 9656 - RNA, 21 nt, Artificial Sequence
  Ebola virus siRNA sense strand
ccaccauguucgagcacgauc

SEQ ID NO: 9657 - RNA, 21 nt, Artificial Sequence
  Ebola virus siRNA sense strand
caccauguucgagcacgauca

SEQ ID NO: 9658 - RNA, 21 nt, Artificial Sequence
  Ebola virus siRNA sense strand
accauguucgagcacgaucau

SEQ ID NO: 9659 - RNA, 21 nt, Artificial Sequence
  Ebola virus siRNA sense strand
ccauguucgagcacgaucauc

SEQ ID NO: 9660 - RNA, 21 nt, Artificial Sequence
  Ebola virus siRNA sense strand
cauguucgagcacgaucauca

SEQ ID NO: 9661 - RNA, 21 nt, Artificial Sequence
  Ebola virus siRNA sense strand
auguucgagcacgaucaucau

SEQ ID NO: 9662 - RNA, 21 nt, Artificial Sequence
  Ebola virus siRNA sense strand
uguucgagcacgaucaucauc

SEQ ID NO: 9663 - RNA, 21 nt, Artificial Sequence
  Ebola virus siRNA sense strand
guucgagcacgaucaucaucc

SEQ ID NO: 9664 - RNA, 21 nt, Artificial Sequence
  Ebola virus siRNA sense strand
uucgagcacgaucaucaucca

SEQ ID NO: 9665 - RNA, 21 nt, Artificial Sequence
  Ebola virus siRNA sense strand
ucgagcacgaucaucauccag

SEQ ID NO: 9666 - RNA, 21 nt, Artificial Sequence
  Ebola virus siRNA sense strand
cgagcacgaucaucauccaga

SEQ ID NO: 9667 - RNA, 21 nt, Artificial Sequence
  Ebola virus siRNA sense strand
gagcacgaucaucauccagag

SEQ ID NO: 9668 - RNA, 21 nt, Artificial Sequence
  Ebola virus siRNA sense strand
agcacgaucaucauccagaga

SEQ ID NO: 9669 - RNA, 21 nt, Artificial Sequence
  Ebola virus siRNA sense strand
gcacgaucaucauccagagag

SEQ ID NO: 9670 - RNA, 21 nt, Artificial Sequence
  Ebola virus siRNA sense strand
cacgaucaucauccagagaga

SEQ ID NO: 9671 - RNA, 21 nt, Artificial Sequence
  Ebola virus siRNA sense strand
acgaucaucauccagagagaa

SEQ ID NO: 9672 - RNA, 21 nt, Artificial Sequence
  Ebola virus siRNA sense strand
cgaucaucauccagagagaau

SEQ ID NO: 9673 - RNA, 21 nt, Artificial Sequence
  Ebola virus siRNA sense strand
gaucaucauccagagagaauu

SEQ ID NO: 9674 - RNA, 21 nt, Artificial Sequence
  Ebola virus siRNA sense strand
aucaucauccagagagaauua

SEQ ID NO: 9675 - RNA, 21 nt, Artificial Sequence
  Ebola virus siRNA sense strand
ucaucauccagagagaauuau

SEQ ID NO: 9676 - RNA, 21 nt, Artificial Sequence
  Ebola virus siRNA sense strand
caucauccagagagaauuauc

SEQ ID NO: 9677 - RNA, 21 nt, Artificial Sequence
  Ebola virus siRNA sense strand
aucauccagagagaauuaucg

SEQ ID NO: 9678 - RNA, 21 nt, Artificial Sequence
  Ebola virus siRNA sense strand
ucauccagagagaauuaucga

SEQ ID NO: 9679 - RNA, 21 nt, Artificial Sequence
  Ebola virus siRNA sense strand
cauccagagagaauuaucgag

SEQ ID NO: 9680 - RNA, 21 nt, Artificial Sequence
  Ebola virus siRNA sense strand
auccagagagaauuaucgagg

SEQ ID NO: 9681 - RNA, 21 nt, Artificial Sequence
  Ebola virus siRNA sense strand
uccagagagaauuaucgaggu

SEQ ID NO: 9682 - RNA, 21 nt, Artificial Sequence
  Ebola virus siRNA sense strand
ccagagagaauuaucgaggug

SEQ ID NO: 9683 - RNA, 21 nt, Artificial Sequence
  Ebola virus siRNA sense strand
cagagagaauuaucgagguga

SEQ ID NO: 9684 - RNA, 21 nt, Artificial Sequence
  Ebola virus siRNA sense strand
agagagaauuaucgaggugag

SEQ ID NO: 9685 - RNA, 21 nt, Artificial Sequence
  Ebola virus siRNA sense strand
gagagaauuaucgaggugagu

SEQ ID NO: 9686 - RNA, 21 nt, Artificial Sequence
  Ebola virus siRNA sense strand
agagaauuaucgaggugagua

SEQ ID NO: 9687 - RNA, 21 nt, Artificial Sequence
  Ebola virus siRNA sense strand
gagaauuaucgaggugaguac

SEQ ID NO: 9688 - RNA, 21 nt, Artificial Sequence
  Ebola virus siRNA sense strand
agaauuaucgaggugaguacc

SEQ ID NO: 9689 - RNA, 21 nt, Artificial Sequence
  Ebola virus siRNA sense strand
gaauuaucgaggugaguaccg

SEQ ID NO: 9690 - RNA, 21 nt, Artificial Sequence
  Ebola virus siRNA sense strand
aauuaucgaggugaguaccgu

SEQ ID NO: 9691 - RNA, 21 nt, Artificial Sequence
  Ebola virus siRNA sense strand
auuaucgaggugaguaccguc

SEQ ID NO: 9692 - RNA, 21 nt, Artificial Sequence
  Ebola virus siRNA sense strand
uuaucgaggugaguaccguca

SEQ ID NO: 9693 - RNA, 21 nt, Artificial Sequence
  Ebola virus siRNA sense strand
uaucgaggugaguaccgucaa

SEQ ID NO: 9694 - RNA, 21 nt, Artificial Sequence
  Ebola virus siRNA sense strand
aucgaggugaguaccgucaau

SEQ ID NO: 9695 - RNA, 21 nt, Artificial Sequence
  Ebola virus siRNA sense strand
ucgaggugaguaccgucaauc

SEQ ID NO: 9696 - RNA, 21 nt, Artificial Sequence
  Ebola virus siRNA sense strand
cgaggugaguaccgucaauca

SEQ ID NO: 9697 - RNA, 21 nt, Artificial Sequence
  Ebola virus siRNA sense strand
gaggugaguaccgucaaucaa

SEQ ID NO: 9698 - RNA, 21 nt, Artificial Sequence
  Ebola virus siRNA sense strand
aggugaguaccgucaaucaag

SEQ ID NO: 9699 - RNA, 21 nt, Artificial Sequence
  Ebola virus siRNA sense strand
ggugaguaccgucaaucaagg

SEQ ID NO: 9700 - RNA, 21 nt, Artificial Sequence
  Ebola virus siRNA sense strand
gugaguaccgucaaucaagga

SEQ ID NO: 9701 - RNA, 21 nt, Artificial Sequence
  Ebola virus siRNA sense strand
ugaguaccgucaaucaaggag

SEQ ID NO: 9702 - RNA, 21 nt, Artificial Sequence
  Ebola virus siRNA sense strand
gaguaccgucaaucaaggagc

SEQ ID NO: 9703 - RNA, 21 nt, Artificial Sequence
  Ebola virus siRNA sense strand
aguaccgucaaucaaggagcg

SEQ ID NO: 9704 - RNA, 21 nt, Artificial Sequence
  Ebola virus siRNA sense strand
guaccgucaaucaaggagcgc

SEQ ID NO: 9705 - RNA, 21 nt, Artificial Sequence
  Ebola virus siRNA sense strand
uaccgucaaucaaggagcgcc

SEQ ID NO: 9706 - RNA, 21 nt, Artificial Sequence
  Ebola virus siRNA sense strand
accgucaaucaaggagcgccu

SEQ ID NO: 9707 - RNA, 21 nt, Artificial Sequence
  Ebola virus siRNA sense strand
ccgucaaucaaggagcgccuc

SEQ ID NO: 9708 - RNA, 21 nt, Artificial Sequence
  Ebola virus siRNA sense strand
cgucaaucaaggagcgccuca

SEQ ID NO: 9709 - RNA, 21 nt, Artificial Sequence
  Ebola virus siRNA sense strand
gucaaucaaggagcgccucac

SEQ ID NO: 9710 - RNA, 21 nt, Artificial Sequence
  Ebola virus siRNA sense strand
ucaaucaaggagcgccucaca

SEQ ID NO: 9711 - RNA, 21 nt, Artificial Sequence
  Ebola virus siRNA sense strand
caaucaaggagcgccucacaa

SEQ ID NO: 9712 - RNA, 21 nt, Artificial Sequence
  Ebola virus siRNA sense strand
aaucaaggagcgccucacaag

SEQ ID NO: 9713 - RNA, 21 nt, Artificial Sequence
  Ebola virus siRNA sense strand
aucaaggagcgccucacaagu

SEQ ID NO: 9714 - RNA, 21 nt, Artificial Sequence
  Ebola virus siRNA sense strand
ucaaggagcgccucacaagug

SEQ ID NO: 9715 - RNA, 21 nt, Artificial Sequence
  Ebola virus siRNA sense strand
caaggagcgccucacaagugc

SEQ ID NO: 9716 - RNA, 21 nt, Artificial Sequence
  Ebola virus siRNA sense strand
aaggagcgccucacaagugcg

SEQ ID NO: 9717 - RNA, 21 nt, Artificial Sequence
  Ebola virus siRNA sense strand
aggagcgccucacaagugcgc

SEQ ID NO: 9718 - RNA, 21 nt, Artificial Sequence
  Ebola virus siRNA sense strand
ggagcgccucacaagugcgcg

SEQ ID NO: 9719 - RNA, 21 nt, Artificial Sequence
  Ebola virus siRNA sense strand
gagcgccucacaagugcgcgu

SEQ ID NO: 9720 - RNA, 21 nt, Artificial Sequence
  Ebola virus siRNA sense strand
agcgccucacaagugcgcguu

SEQ ID NO: 9721 - RNA, 21 nt, Artificial Sequence
  Ebola virus siRNA sense strand
gcgccucacaagugcgcguuc

SEQ ID NO: 9722 - RNA, 21 nt, Artificial Sequence
  Ebola virus siRNA sense strand
cgccucacaagugcgcguucc

SEQ ID NO: 9723 - RNA, 21 nt, Artificial Sequence
  Ebola virus siRNA sense strand
gccucacaagugcgcguuccu

SEQ ID NO: 9724 - RNA, 21 nt, Artificial Sequence
  Ebola virus siRNA sense strand
ccucacaagugcgcguuccua

SEQ ID NO: 9725 - RNA, 21 nt, Artificial Sequence
  Ebola virus siRNA sense strand
cucacaagugcgcguuccuac

SEQ ID NO: 9726 - RNA, 21 nt, Artificial Sequence
  Ebola virus siRNA sense strand
ucacaagugcgcguuccuacu

SEQ ID NO: 9727 - RNA, 21 nt, Artificial Sequence
  Ebola virus siRNA sense strand
cacaagugcgcguuccuacug

SEQ ID NO: 9728 - RNA, 21 nt, Artificial Sequence
  Ebola virus siRNA sense strand
acaagugcgcguuccuacugu

SEQ ID NO: 9729 - RNA, 21 nt, Artificial Sequence
  Ebola virus siRNA sense strand
caagugcgcguuccuacugua

SEQ ID NO: 9730 - RNA, 21 nt, Artificial Sequence
  Ebola virus siRNA sense strand
aagugcgcguuccuacuguau

SEQ ID NO: 9731 - RNA, 21 nt, Artificial Sequence
  Ebola virus siRNA sense strand
agugcgcguuccuacuguauu

SEQ ID NO: 9732 - RNA, 21 nt, Artificial Sequence
  Ebola virus siRNA sense strand
gugcgcguuccuacuguauuu

SEQ ID NO: 9733 - RNA, 21 nt, Artificial Sequence
  Ebola virus siRNA sense strand
ugcgcguuccuacuguauuuc

SEQ ID NO: 9734 - RNA, 21 nt, Artificial Sequence
  Ebola virus siRNA sense strand
gcgcguuccuacuguauuuca

SEQ ID NO: 9735 - RNA, 21 nt, Artificial Sequence
  Ebola virus siRNA sense strand
cgcguuccuacuguauuucau

SEQ ID NO: 9736 - RNA, 21 nt, Artificial Sequence
  Ebola virus siRNA sense strand
gcguuccuacuguauuucaua

SEQ ID NO: 9737 - RNA, 21 nt, Artificial Sequence
  Ebola virus siRNA sense strand
cguuccuacuguauuucauaa

SEQ ID NO: 9738 - RNA, 21 nt, Artificial Sequence
  Ebola virus siRNA sense strand
guuccuacuguauuucauaag

SEQ ID NO: 9739 - RNA, 21 nt, Artificial Sequence
  Ebola virus siRNA sense strand
uuccuacuguauuucauaaga

SEQ ID NO: 9740 - RNA, 21 nt, Artificial Sequence
  Ebola virus siRNA sense strand
uccuacuguauuucauaagaa

SEQ ID NO: 9741 - RNA, 21 nt, Artificial Sequence
  Ebola virus siRNA sense strand
ccuacuguauuucauaagaag

SEQ ID NO: 9742 - RNA, 21 nt, Artificial Sequence
  Ebola virus siRNA sense strand
cuacuguauuucauaagaaga

SEQ ID NO: 9743 - RNA, 21 nt, Artificial Sequence
  Ebola virus siRNA sense strand
uacuguauuucauaagaagag

SEQ ID NO: 9744 - RNA, 21 nt, Artificial Sequence
  Ebola virus siRNA sense strand
acuguauuucauaagaagaga

SEQ ID NO: 9745 - RNA, 21 nt, Artificial Sequence
  Ebola virus siRNA sense strand
cuguauuucauaagaagagag

SEQ ID NO: 9746 - RNA, 21 nt, Artificial Sequence
  Ebola virus siRNA sense strand
uguauuucauaagaagagagu

SEQ ID NO: 9747 - RNA, 21 nt, Artificial Sequence
  Ebola virus siRNA sense strand
guauuucauaagaagagaguu

SEQ ID NO: 9748 - RNA, 21 nt, Artificial Sequence
  Ebola virus siRNA sense strand
uauuucauaagaagagaguug

SEQ ID NO: 9749 - RNA, 21 nt, Artificial Sequence
  Ebola virus siRNA sense strand
auuucauaagaagagaguuga

SEQ ID NO: 9750 - RNA, 21 nt, Artificial Sequence
  Ebola virus siRNA sense strand
uuucauaagaagagaguugaa

SEQ ID NO: 9751 - RNA, 21 nt, Artificial Sequence
  Ebola virus siRNA sense strand
uucauaagaagagaguugaac

SEQ ID NO: 9752 - RNA, 21 nt, Artificial Sequence
  Ebola virus siRNA sense strand
ucauaagaagagaguugaacc

SEQ ID NO: 9753 - RNA, 21 nt, Artificial Sequence
  Ebola virus siRNA sense strand
cauaagaagagaguugaacca

SEQ ID NO: 9754 - RNA, 21 nt, Artificial Sequence
  Ebola virus siRNA sense strand
auaagaagagaguugaaccau

SEQ ID NO: 9755 - RNA, 21 nt, Artificial Sequence
  Ebola virus siRNA sense strand
uaagaagagaguugaaccauu

SEQ ID NO: 9756 - RNA, 21 nt, Artificial Sequence
  Ebola virus siRNA sense strand
aagaagagaguugaaccauua

SEQ ID NO: 9757 - RNA, 21 nt, Artificial Sequence
  Ebola virus siRNA sense strand
agaagagaguugaaccauuaa

SEQ ID NO: 9758 - RNA, 21 nt, Artificial Sequence
  Ebola virus siRNA sense strand
gaagagaguugaaccauuaac

SEQ ID NO: 9759 - RNA, 21 nt, Artificial Sequence
  Ebola virus siRNA sense strand
aagagaguugaaccauuaaca

SEQ ID NO: 9760 - RNA, 21 nt, Artificial Sequence
  Ebola virus siRNA sense strand
agagaguugaaccauuaacag

SEQ ID NO: 9761 - RNA, 21 nt, Artificial Sequence
  Ebola virus siRNA sense strand
gagaguugaaccauuaacagu

SEQ ID NO: 9762 - RNA, 21 nt, Artificial Sequence
  Ebola virus siRNA sense strand
agaguugaaccauuaacaguu

SEQ ID NO: 9763 - RNA, 21 nt, Artificial Sequence
  Ebola virus siRNA sense strand
gaguugaaccauuaacaguuc

SEQ ID NO: 9764 - RNA, 21 nt, Artificial Sequence
  Ebola virus siRNA sense strand
aguugaaccauuaacaguucc

SEQ ID NO: 9765 - RNA, 21 nt, Artificial Sequence
  Ebola virus siRNA sense strand
guugaaccauuaacaguuccu

SEQ ID NO: 9766 - RNA, 21 nt, Artificial Sequence
  Ebola virus siRNA sense strand
uugaaccauuaacaguuccuc

SEQ ID NO: 9767 - RNA, 21 nt, Artificial Sequence
  Ebola virus siRNA sense strand
ugaaccauuaacaguuccucc

SEQ ID NO: 9768 - RNA, 21 nt, Artificial Sequence
  Ebola virus siRNA sense strand
gaaccauuaacaguuccucca

SEQ ID NO: 9769 - RNA, 21 nt, Artificial Sequence
  Ebola virus siRNA sense strand
aaccauuaacaguuccuccag

SEQ ID NO: 9770 - RNA, 21 nt, Artificial Sequence
  Ebola virus siRNA sense strand
accauuaacaguuccuccagc

SEQ ID NO: 9771 - RNA, 21 nt, Artificial Sequence
  Ebola virus siRNA sense strand
ccauuaacaguuccuccagca

SEQ ID NO: 9772 - RNA, 21 nt, Artificial Sequence
  Ebola virus siRNA sense strand
cauuaacaguuccuccagcac

SEQ ID NO: 9773 - RNA, 21 nt, Artificial Sequence
  Ebola virus siRNA sense strand
auuaacaguuccuccagcacc

SEQ ID NO: 9774 - RNA, 21 nt, Artificial Sequence
  Ebola virus siRNA sense strand
uuaacaguuccuccagcaccu

SEQ ID NO: 9775 - RNA, 21 nt, Artificial Sequence
  Ebola virus siRNA sense strand
uaacaguuccuccagcaccua

SEQ ID NO: 9776 - RNA, 21 nt, Artificial Sequence
  Ebola virus siRNA sense strand
aacaguuccuccagcaccuaa

SEQ ID NO: 9777 - RNA, 21 nt, Artificial Sequence
  Ebola virus siRNA sense strand
acaguuccuccagcaccuaaa

SEQ ID NO: 9778 - RNA, 21 nt, Artificial Sequence
  Ebola virus siRNA sense strand
caguuccuccagcaccuaaag

SEQ ID NO: 9779 - RNA, 21 nt, Artificial Sequence
  Ebola virus siRNA sense strand
aguuccuccagcaccuaaaga

SEQ ID NO: 9780 - RNA, 21 nt, Artificial Sequence
  Ebola virus siRNA sense strand
guuccuccagcaccuaaagac

SEQ ID NO: 9781 - RNA, 21 nt, Artificial Sequence
  Ebola virus siRNA sense strand
uuccuccagcaccuaaagaca

SEQ ID NO: 9782 - RNA, 21 nt, Artificial Sequence
  Ebola virus siRNA sense strand
uccuccagcaccuaaagacau

SEQ ID NO: 9783 - RNA, 21 nt, Artificial Sequence
  Ebola virus siRNA sense strand
ccuccagcaccuaaagacaua

SEQ ID NO: 9784 - RNA, 21 nt, Artificial Sequence
  Ebola virus siRNA sense strand
cuccagcaccuaaagacauau

SEQ ID NO: 9785 - RNA, 21 nt, Artificial Sequence
  Ebola virus siRNA sense strand
uccagcaccuaaagacauaug

SEQ ID NO: 9786 - RNA, 21 nt, Artificial Sequence
  Ebola virus siRNA sense strand
ccagcaccuaaagacauaugu

SEQ ID NO: 9787 - RNA, 21 nt, Artificial Sequence
  Ebola virus siRNA sense strand
cagcaccuaaagacauauguc

SEQ ID NO: 9788 - RNA, 21 nt, Artificial Sequence
  Ebola virus siRNA sense strand
agcaccuaaagacauaugucc

SEQ ID NO: 9789 - RNA, 21 nt, Artificial Sequence
  Ebola virus siRNA sense strand
gcaccuaaagacauauguccg

SEQ ID NO: 9790 - RNA, 21 nt, Artificial Sequence
  Ebola virus siRNA sense strand
caccuaaagacauauguccga

SEQ ID NO: 9791 - RNA, 21 nt, Artificial Sequence
  Ebola virus siRNA sense strand
accuaaagacauauguccgac

SEQ ID NO: 9792 - RNA, 21 nt, Artificial Sequence
  Ebola virus siRNA sense strand
ccuaaagacauauguccgacc

SEQ ID NO: 9793 - RNA, 21 nt, Artificial Sequence
  Ebola virus siRNA sense strand
cuaaagacauauguccgaccu

SEQ ID NO: 9794 - RNA, 21 nt, Artificial Sequence
  Ebola virus siRNA sense strand
uaaagacauauguccgaccuu

SEQ ID NO: 9795 - RNA, 21 nt, Artificial Sequence
  Ebola virus siRNA sense strand
aaagacauauguccgaccuug

SEQ ID NO: 9796 - RNA, 21 nt, Artificial Sequence
  Ebola virus siRNA sense strand
aagacauauguccgaccuuga

SEQ ID NO: 9797 - RNA, 21 nt, Artificial Sequence
  Ebola virus siRNA sense strand
agacauauguccgaccuugaa

SEQ ID NO: 9798 - RNA, 21 nt, Artificial Sequence
  Ebola virus siRNA sense strand
gacauauguccgaccuugaaa

SEQ ID NO: 9799 - RNA, 21 nt, Artificial Sequence
  Ebola virus siRNA sense strand
acauauguccgaccuugaaaa

SEQ ID NO: 9800 - RNA, 21 nt, Artificial Sequence
  Ebola virus siRNA sense strand
cauauguccgaccuugaaaaa

SEQ ID NO: 9801 - RNA, 21 nt, Artificial Sequence
  Ebola virus siRNA sense strand
auauguccgaccuugaaaaaa

SEQ ID NO: 9802 - RNA, 21 nt, Artificial Sequence
  Ebola virus siRNA sense strand
uauguccgaccuugaaaaaag

SEQ ID NO: 9803 - RNA, 21 nt, Artificial Sequence
  Ebola virus siRNA sense strand
auguccgaccuugaaaaaagg

SEQ ID NO: 9804 - RNA, 21 nt, Artificial Sequence
  Ebola virus siRNA sense strand
uguccgaccuugaaaaaagga

SEQ ID NO: 9805 - RNA, 21 nt, Artificial Sequence
  Ebola virus siRNA sense strand
guccgaccuugaaaaaaggau

SEQ ID NO: 9806 - RNA, 21 nt, Artificial Sequence
  Ebola virus siRNA sense strand
uccgaccuugaaaaaaggauu

SEQ ID NO: 9807 - RNA, 21 nt, Artificial Sequence
  Ebola virus siRNA sense strand
ccgaccuugaaaaaaggauuu

SEQ ID NO: 9808 - RNA, 21 nt, Artificial Sequence
  Ebola virus siRNA sense strand
cgaccuugaaaaaaggauuuu

SEQ ID NO: 9809 - RNA, 21 nt, Artificial Sequence
  Ebola virus siRNA sense strand
gaccuugaaaaaaggauuuuu

SEQ ID NO: 9810 - RNA, 21 nt, Artificial Sequence
  Ebola virus siRNA sense strand
accuugaaaaaaggauuuuug

SEQ ID NO: 9811 - RNA, 21 nt, Artificial Sequence
  Ebola virus siRNA sense strand
ccuugaaaaaaggauuuuugu

SEQ ID NO: 9812 - RNA, 21 nt, Artificial Sequence
  Ebola virus siRNA sense strand
cuugaaaaaaggauuuuugug

SEQ ID NO: 9813 - RNA, 21 nt, Artificial Sequence
  Ebola virus siRNA sense strand
uugaaaaaaggauuuuugugu

SEQ ID NO: 9814 - RNA, 21 nt, Artificial Sequence
  Ebola virus siRNA sense strand
ugaaaaaaggauuuuugugug

SEQ ID NO: 9815 - RNA, 21 nt, Artificial Sequence
  Ebola virus siRNA sense strand
gaaaaaaggauuuuuguguga

SEQ ID NO: 9816 - RNA, 21 nt, Artificial Sequence
  Ebola virus siRNA sense strand
aaaaaaggauuuuugugugac

SEQ ID NO: 9817 - RNA, 21 nt, Artificial Sequence
  Ebola virus siRNA sense strand
aaaaaggauuuuugugugaca

SEQ ID NO: 9818 - RNA, 21 nt, Artificial Sequence
  Ebola virus siRNA sense strand
aaaaggauuuuugugugacag

SEQ ID NO: 9819 - RNA, 21 nt, Artificial Sequence
  Ebola virus siRNA sense strand
aaaggauuuuugugugacagu

SEQ ID NO: 9820 - RNA, 21 nt, Artificial Sequence
  Ebola virus siRNA sense strand
aaggauuuuugugugacagua

SEQ ID NO: 9821 - RNA, 21 nt, Artificial Sequence
  Ebola virus siRNA sense strand
aggauuuuugugugacaguag

SEQ ID NO: 9822 - RNA, 21 nt, Artificial Sequence
  Ebola virus siRNA sense strand
ggauuuuugugugacaguagu

SEQ ID NO: 9823 - RNA, 21 nt, Artificial Sequence
  Ebola virus siRNA sense strand
gauuuuugugugacaguaguu

SEQ ID NO: 9824 - RNA, 21 nt, Artificial Sequence
  Ebola virus siRNA sense strand
auuuuugugugacaguaguuu

SEQ ID NO: 9825 - RNA, 21 nt, Artificial Sequence
  Ebola virus siRNA sense strand
uuuuugugugacaguaguuuu

SEQ ID NO: 9826 - RNA, 21 nt, Artificial Sequence
  Ebola virus siRNA sense strand
uuuugugugacaguaguuuuu

SEQ ID NO: 9827 - RNA, 21 nt, Artificial Sequence
  Ebola virus siRNA sense strand
uuugugugacaguaguuuuug

SEQ ID NO: 9828 - RNA, 21 nt, Artificial Sequence
  Ebola virus siRNA sense strand
uugugugacaguaguuuuugc

SEQ ID NO: 9829 - RNA, 21 nt, Artificial Sequence
  Ebola virus siRNA sense strand
ugugugacaguaguuuuugca

SEQ ID NO: 9830 - RNA, 21 nt, Artificial Sequence
  Ebola virus siRNA sense strand
gugugacaguaguuuuugcaa

SEQ ID NO: 9831 - RNA, 21 nt, Artificial Sequence
  Ebola virus siRNA sense strand
ugugacaguaguuuuugcaaa

SEQ ID NO: 9832 - RNA, 21 nt, Artificial Sequence
  Ebola virus siRNA sense strand
gugacaguaguuuuugcaaaa

SEQ ID NO: 9833 - RNA, 21 nt, Artificial Sequence
  Ebola virus siRNA sense strand
ugacaguaguuuuugcaaaaa

SEQ ID NO: 9834 - RNA, 21 nt, Artificial Sequence
  Ebola virus siRNA sense strand
gacaguaguuuuugcaaaaaa

SEQ ID NO: 9835 - RNA, 21 nt, Artificial Sequence
  Ebola virus siRNA sense strand
acaguaguuuuugcaaaaaag

SEQ ID NO: 9836 - RNA, 21 nt, Artificial Sequence
  Ebola virus siRNA sense strand
caguaguuuuugcaaaaaaga

SEQ ID NO: 9837 - RNA, 21 nt, Artificial Sequence
  Ebola virus siRNA sense strand
aguaguuuuugcaaaaaagau

SEQ ID NO: 9838 - RNA, 21 nt, Artificial Sequence
  Ebola virus siRNA sense strand
guaguuuuugcaaaaaagauc

SEQ ID NO: 9839 - RNA, 21 nt, Artificial Sequence
  Ebola virus siRNA sense strand
uaguuuuugcaaaaaagauca

SEQ ID NO: 9840 - RNA, 21 nt, Artificial Sequence
  Ebola virus siRNA sense strand
aguuuuugcaaaaaagaucac

SEQ ID NO: 9841 - RNA, 21 nt, Artificial Sequence
  Ebola virus siRNA sense strand
guuuuugcaaaaaagaucacc

SEQ ID NO: 9842 - RNA, 21 nt, Artificial Sequence
  Ebola virus siRNA sense strand
uuuuugcaaaaaagaucacca

SEQ ID NO: 9843 - RNA, 21 nt, Artificial Sequence
  Ebola virus siRNA sense strand
uuuugcaaaaaagaucaccag

SEQ ID NO: 9844 - RNA, 21 nt, Artificial Sequence
  Ebola virus siRNA sense strand
uuugcaaaaaagaucaccagu

SEQ ID NO: 9845 - RNA, 21 nt, Artificial Sequence
  Ebola virus siRNA sense strand
uugcaaaaaagaucaccaguu

SEQ ID NO: 9846 - RNA, 21 nt, Artificial Sequence
  Ebola virus siRNA sense strand
ugcaaaaaagaucaccaguug

SEQ ID NO: 9847 - RNA, 21 nt, Artificial Sequence
  Ebola virus siRNA sense strand
gcaaaaaagaucaccaguugg

SEQ ID NO: 9848 - RNA, 21 nt, Artificial Sequence
  Ebola virus siRNA sense strand
caaaaaagaucaccaguugga

SEQ ID NO: 9849 - RNA, 21 nt, Artificial Sequence
  Ebola virus siRNA sense strand
aaaaaagaucaccaguuggag

SEQ ID NO: 9850 - RNA, 21 nt, Artificial Sequence
  Ebola virus siRNA sense strand
aaaaagaucaccaguuggaga

SEQ ID NO: 9851 - RNA, 21 nt, Artificial Sequence
  Ebola virus siRNA sense strand
aaaagaucaccaguuggagag

SEQ ID NO: 9852 - RNA, 21 nt, Artificial Sequence
  Ebola virus siRNA sense strand
aaagaucaccaguuggagagu

SEQ ID NO: 9853 - RNA, 21 nt, Artificial Sequence
  Ebola virus siRNA sense strand
aagaucaccaguuggagaguu

SEQ ID NO: 9854 - RNA, 21 nt, Artificial Sequence
  Ebola virus siRNA sense strand
agaucaccaguuggagaguuu

SEQ ID NO: 9855 - RNA, 21 nt, Artificial Sequence
  Ebola virus siRNA sense strand
gaucaccaguuggagaguuua

SEQ ID NO: 9856 - RNA, 21 nt, Artificial Sequence
  Ebola virus siRNA sense strand
aucaccaguuggagaguuuaa

SEQ ID NO: 9857 - RNA, 21 nt, Artificial Sequence
  Ebola virus siRNA sense strand
ucaccaguuggagaguuuaac

SEQ ID NO: 9858 - RNA, 21 nt, Artificial Sequence
  Ebola virus siRNA sense strand
caccaguuggagaguuuaacu

SEQ ID NO: 9859 - RNA, 21 nt, Artificial Sequence
  Ebola virus siRNA sense strand
accaguuggagaguuuaacug

SEQ ID NO: 9860 - RNA, 21 nt, Artificial Sequence
  Ebola virus siRNA sense strand
ccaguuggagaguuuaacuga

SEQ ID NO: 9861 - RNA, 21 nt, Artificial Sequence
  Ebola virus siRNA sense strand
caguuggagaguuuaacugau

SEQ ID NO: 9862 - RNA, 21 nt, Artificial Sequence
  Ebola virus siRNA sense strand
aguuggagaguuuaacugaua

SEQ ID NO: 9863 - RNA, 21 nt, Artificial Sequence
  Ebola virus siRNA sense strand
guuggagaguuuaacugauag

SEQ ID NO: 9864 - RNA, 21 nt, Artificial Sequence
  Ebola virus siRNA sense strand
uuggagaguuuaacugauagg

SEQ ID NO: 9865 - RNA, 21 nt, Artificial Sequence
  Ebola virus siRNA sense strand
uggagaguuuaacugauaggg

SEQ ID NO: 9866 - RNA, 21 nt, Artificial Sequence
  Ebola virus siRNA sense strand
ggagaguuuaacugauaggga

SEQ ID NO: 9867 - RNA, 21 nt, Artificial Sequence
  Ebola virus siRNA sense strand
gagaguuuaacugauagggaa

SEQ ID NO: 9868 - RNA, 21 nt, Artificial Sequence
  Ebola virus siRNA sense strand
agaguuuaacugauagggaau

SEQ ID NO: 9869 - RNA, 21 nt, Artificial Sequence
  Ebola virus siRNA sense strand
gaguuuaacugauagggaauu

SEQ ID NO: 9870 - RNA, 21 nt, Artificial Sequence
  Ebola virus siRNA sense strand
aguuuaacugauagggaauua

SEQ ID NO: 9871 - RNA, 21 nt, Artificial Sequence
  Ebola virus siRNA sense strand
guuuaacugauagggaauuac

SEQ ID NO: 9872 - RNA, 21 nt, Artificial Sequence
  Ebola virus siRNA sense strand
uuuaacugauagggaauuacu

SEQ ID NO: 9873 - RNA, 21 nt, Artificial Sequence
  Ebola virus siRNA sense strand
uuaacugauagggaauuacuc

SEQ ID NO: 9874 - RNA, 21 nt, Artificial Sequence
  Ebola virus siRNA sense strand
uaacugauagggaauuacucc

SEQ ID NO: 9875 - RNA, 21 nt, Artificial Sequence
  Ebola virus siRNA sense strand
aacugauagggaauuacuccu

SEQ ID NO: 9876 - RNA, 21 nt, Artificial Sequence
  Ebola virus siRNA sense strand
acugauagggaauuacuccua

SEQ ID NO: 9877 - RNA, 21 nt, Artificial Sequence
  Ebola virus siRNA sense strand
cugauagggaauuacuccuac

SEQ ID NO: 9878 - RNA, 21 nt, Artificial Sequence
  Ebola virus siRNA sense strand
ugauagggaauuacuccuacu

SEQ ID NO: 9879 - RNA, 21 nt, Artificial Sequence
  Ebola virus siRNA sense strand
gauagggaauuacuccuacua

SEQ ID NO: 9880 - RNA, 21 nt, Artificial Sequence
  Ebola virus siRNA sense strand
auagggaauuacuccuacuaa

SEQ ID NO: 9881 - RNA, 21 nt, Artificial Sequence
  Ebola virus siRNA sense strand
uagggaauuacuccuacuaau

SEQ ID NO: 9882 - RNA, 21 nt, Artificial Sequence
  Ebola virus siRNA sense strand
agggaauuacuccuacuaauc

SEQ ID NO: 9883 - RNA, 21 nt, Artificial Sequence
  Ebola virus siRNA sense strand
gggaauuacuccuacuaaucg

SEQ ID NO: 9884 - RNA, 21 nt, Artificial Sequence
  Ebola virus siRNA sense strand
ggaauuacuccuacuaaucgc

SEQ ID NO: 9885 - RNA, 21 nt, Artificial Sequence
  Ebola virus siRNA sense strand
gaauuacuccuacuaaucgcc

SEQ ID NO: 9886 - RNA, 21 nt, Artificial Sequence
  Ebola virus siRNA sense strand
aauuacuccuacuaaucgccc

SEQ ID NO: 9887 - RNA, 21 nt, Artificial Sequence
  Ebola virus siRNA sense strand
auuacuccuacuaaucgcccg

SEQ ID NO: 9888 - RNA, 21 nt, Artificial Sequence
  Ebola virus siRNA sense strand
uuacuccuacuaaucgcccgu

SEQ ID NO: 9889 - RNA, 21 nt, Artificial Sequence
  Ebola virus siRNA sense strand
uacuccuacuaaucgcccgua

SEQ ID NO: 9890 - RNA, 21 nt, Artificial Sequence
  Ebola virus siRNA sense strand
acuccuacuaaucgcccguaa

SEQ ID NO: 9891 - RNA, 21 nt, Artificial Sequence
  Ebola virus siRNA sense strand
cuccuacuaaucgcccguaag

SEQ ID NO: 9892 - RNA, 21 nt, Artificial Sequence
  Ebola virus siRNA sense strand
uccuacuaaucgcccguaaga

SEQ ID NO: 9893 - RNA, 21 nt, Artificial Sequence
  Ebola virus siRNA sense strand
ccuacuaaucgcccguaagac

SEQ ID NO: 9894 - RNA, 21 nt, Artificial Sequence
  Ebola virus siRNA sense strand
cuacuaaucgcccguaagacu

SEQ ID NO: 9895 - RNA, 21 nt, Artificial Sequence
  Ebola virus siRNA sense strand
uacuaaucgcccguaagacuu

SEQ ID NO: 9896 - RNA, 21 nt, Artificial Sequence
  Ebola virus siRNA sense strand
acuaaucgcccguaagacuug

SEQ ID NO: 9897 - RNA, 21 nt, Artificial Sequence
  Ebola virus siRNA sense strand
cuaaucgcccguaagacuugu

SEQ ID NO: 9898 - RNA, 21 nt, Artificial Sequence
  Ebola virus siRNA sense strand
uaaucgcccguaagacuugug

SEQ ID NO: 9899 - RNA, 21 nt, Artificial Sequence
  Ebola virus siRNA sense strand
aaucgcccguaagacuugugg

SEQ ID NO: 9900 - RNA, 21 nt, Artificial Sequence
  Ebola virus siRNA sense strand
aucgcccguaagacuugugga

SEQ ID NO: 9901 - RNA, 21 nt, Artificial Sequence
  Ebola virus siRNA sense strand
ucgcccguaagacuuguggau

SEQ ID NO: 9902 - RNA, 21 nt, Artificial Sequence
  Ebola virus siRNA sense strand
cgcccguaagacuuguggauc

SEQ ID NO: 9903 - RNA, 21 nt, Artificial Sequence
  Ebola virus siRNA sense strand
gcccguaagacuuguggauca

SEQ ID NO: 9904 - RNA, 21 nt, Artificial Sequence
  Ebola virus siRNA sense strand
cccguaagacuuguggaucag

SEQ ID NO: 9905 - RNA, 21 nt, Artificial Sequence
  Ebola virus siRNA sense strand
ccguaagacuuguggaucagu

SEQ ID NO: 9906 - RNA, 21 nt, Artificial Sequence
  Ebola virus siRNA sense strand
cguaagacuuguggaucagua

SEQ ID NO: 9907 - RNA, 21 nt, Artificial Sequence
  Ebola virus siRNA sense strand
guaagacuuguggaucaguag

SEQ ID NO: 9908 - RNA, 21 nt, Artificial Sequence
  Ebola virus siRNA sense strand
uaagacuuguggaucaguaga

SEQ ID NO: 9909 - RNA, 21 nt, Artificial Sequence
  Ebola virus siRNA sense strand
aagacuuguggaucaguagaa

SEQ ID NO: 9910 - RNA, 21 nt, Artificial Sequence
  Ebola virus siRNA sense strand
agacuuguggaucaguagaac

SEQ ID NO: 9911 - RNA, 21 nt, Artificial Sequence
  Ebola virus siRNA sense strand
gacuuguggaucaguagaaca

SEQ ID NO: 9912 - RNA, 21 nt, Artificial Sequence
  Ebola virus siRNA sense strand
acuuguggaucaguagaacaa

SEQ ID NO: 9913 - RNA, 21 nt, Artificial Sequence
  Ebola virus siRNA sense strand
cuuguggaucaguagaacaac

SEQ ID NO: 9914 - RNA, 21 nt, Artificial Sequence
  Ebola virus siRNA sense strand
uuguggaucaguagaacaaca

SEQ ID NO: 9915 - RNA, 21 nt, Artificial Sequence
  Ebola virus siRNA sense strand
uguggaucaguagaacaacaa

SEQ ID NO: 9916 - RNA, 21 nt, Artificial Sequence
  Ebola virus siRNA sense strand
guggaucaguagaacaacaau

SEQ ID NO: 9917 - RNA, 21 nt, Artificial Sequence
  Ebola virus siRNA sense strand
uggaucaguagaacaacaauu

SEQ ID NO: 9918 - RNA, 21 nt, Artificial Sequence
  Ebola virus siRNA sense strand
ggaucaguagaacaacaauua

SEQ ID NO: 9919 - RNA, 21 nt, Artificial Sequence
  Ebola virus siRNA sense strand
gaucaguagaacaacaauuaa

SEQ ID NO: 9920 - RNA, 21 nt, Artificial Sequence
  Ebola virus siRNA sense strand
aucaguagaacaacaauuaaa

SEQ ID NO: 9921 - RNA, 21 nt, Artificial Sequence
  Ebola virus siRNA sense strand
ucaguagaacaacaauuaaau

SEQ ID NO: 9922 - RNA, 21 nt, Artificial Sequence
  Ebola virus siRNA sense strand
caguagaacaacaauuaaaua

SEQ ID NO: 9923 - RNA, 21 nt, Artificial Sequence
  Ebola virus siRNA sense strand
aguagaacaacaauuaaauau

SEQ ID NO: 9924 - RNA, 21 nt, Artificial Sequence
  Ebola virus siRNA sense strand
guagaacaacaauuaaauaua

SEQ ID NO: 9925 - RNA, 21 nt, Artificial Sequence
  Ebola virus siRNA sense strand
uagaacaacaauuaaauauaa

SEQ ID NO: 9926 - RNA, 21 nt, Artificial Sequence
  Ebola virus siRNA sense strand
agaacaacaauuaaauauaac

SEQ ID NO: 9927 - RNA, 21 nt, Artificial Sequence
  Ebola virus siRNA sense strand
gaacaacaauuaaauauaacu

SEQ ID NO: 9928 - RNA, 21 nt, Artificial Sequence
  Ebola virus siRNA sense strand
aacaacaauuaaauauaacug

SEQ ID NO: 9929 - RNA, 21 nt, Artificial Sequence
  Ebola virus siRNA sense strand
acaacaauuaaauauaacugc

SEQ ID NO: 9930 - RNA, 21 nt, Artificial Sequence
  Ebola virus siRNA sense strand
caacaauuaaauauaacugca

SEQ ID NO: 9931 - RNA, 21 nt, Artificial Sequence
  Ebola virus siRNA sense strand
aacaauuaaauauaacugcac

SEQ ID NO: 9932 - RNA, 21 nt, Artificial Sequence
  Ebola virus siRNA sense strand
acaauuaaauauaacugcacc

SEQ ID NO: 9933 - RNA, 21 nt, Artificial Sequence
  Ebola virus siRNA sense strand
caauuaaauauaacugcaccc

SEQ ID NO: 9934 - RNA, 21 nt, Artificial Sequence
  Ebola virus siRNA sense strand
aauuaaauauaacugcaccca

SEQ ID NO: 9935 - RNA, 21 nt, Artificial Sequence
  Ebola virus siRNA sense strand
auuaaauauaacugcacccaa

SEQ ID NO: 9936 - RNA, 21 nt, Artificial Sequence
  Ebola virus siRNA sense strand
uuaaauauaacugcacccaag

SEQ ID NO: 9937 - RNA, 21 nt, Artificial Sequence
  Ebola virus siRNA sense strand
uaaauauaacugcacccaagg

SEQ ID NO: 9938 - RNA, 21 nt, Artificial Sequence
  Ebola virus siRNA sense strand
aaauauaacugcacccaagga

SEQ ID NO: 9939 - RNA, 21 nt, Artificial Sequence
  Ebola virus siRNA sense strand
aauauaacugcacccaaggac

SEQ ID NO: 9940 - RNA, 21 nt, Artificial Sequence
  Ebola virus siRNA sense strand
auauaacugcacccaaggacu

SEQ ID NO: 9941 - RNA, 21 nt, Artificial Sequence
  Ebola virus siRNA sense strand
uauaacugcacccaaggacuc

SEQ ID NO: 9942 - RNA, 21 nt, Artificial Sequence
  Ebola virus siRNA sense strand
auaacugcacccaaggacucg

SEQ ID NO: 9943 - RNA, 21 nt, Artificial Sequence
  Ebola virus siRNA sense strand
uaacugcacccaaggacucgc

SEQ ID NO: 9944 - RNA, 21 nt, Artificial Sequence
  Ebola virus siRNA sense strand
aacugcacccaaggacucgcg

SEQ ID NO: 9945 - RNA, 21 nt, Artificial Sequence
  Ebola virus siRNA sense strand
acugcacccaaggacucgcgc

SEQ ID NO: 9946 - RNA, 21 nt, Artificial Sequence
  Ebola virus siRNA sense strand
cugcacccaaggacucgcgcu

SEQ ID NO: 9947 - RNA, 21 nt, Artificial Sequence
  Ebola virus siRNA sense strand
ugcacccaaggacucgcgcuu

SEQ ID NO: 9948 - RNA, 21 nt, Artificial Sequence
  Ebola virus siRNA sense strand
gcacccaaggacucgcgcuua

SEQ ID NO: 9949 - RNA, 21 nt, Artificial Sequence
  Ebola virus siRNA sense strand
cacccaaggacucgcgcuuag

SEQ ID NO: 9950 - RNA, 21 nt, Artificial Sequence
  Ebola virus siRNA sense strand
acccaaggacucgcgcuuagc

SEQ ID NO: 9951 - RNA, 21 nt, Artificial Sequence
  Ebola virus siRNA sense strand
cccaaggacucgcgcuuagca

SEQ ID NO: 9952 - RNA, 21 nt, Artificial Sequence
  Ebola virus siRNA sense strand
ccaaggacucgcgcuuagcaa

SEQ ID NO: 9953 - RNA, 21 nt, Artificial Sequence
  Ebola virus siRNA sense strand
caaggacucgcgcuuagcaaa

SEQ ID NO: 9954 - RNA, 21 nt, Artificial Sequence
  Ebola virus siRNA sense strand
aaggacucgcgcuuagcaaau

SEQ ID NO: 9955 - RNA, 21 nt, Artificial Sequence
  Ebola virus siRNA sense strand
aggacucgcgcuuagcaaauc

SEQ ID NO: 9956 - RNA, 21 nt, Artificial Sequence
  Ebola virus siRNA sense strand
ggacucgcgcuuagcaaaucc

SEQ ID NO: 9957 - RNA, 21 nt, Artificial Sequence
  Ebola virus siRNA sense strand
gacucgcgcuuagcaaaucca

SEQ ID NO: 9958 - RNA, 21 nt, Artificial Sequence
  Ebola virus siRNA sense strand
acucgcgcuuagcaaauccaa

SEQ ID NO: 9959 - RNA, 21 nt, Artificial Sequence
  Ebola virus siRNA sense strand
cucgcgcuuagcaaauccaac

SEQ ID NO: 9960 - RNA, 21 nt, Artificial Sequence
  Ebola virus siRNA sense strand
ucgcgcuuagcaaauccaacg

SEQ ID NO: 9961 - RNA, 21 nt, Artificial Sequence
  Ebola virus siRNA sense strand
cgcgcuuagcaaauccaacgg

SEQ ID NO: 9962 - RNA, 21 nt, Artificial Sequence
  Ebola virus siRNA sense strand
gcgcuuagcaaauccaacggc

SEQ ID NO: 9963 - RNA, 21 nt, Artificial Sequence
  Ebola virus siRNA sense strand
cgcuuagcaaauccaacggcu

SEQ ID NO: 9964 - RNA, 21 nt, Artificial Sequence
  Ebola virus siRNA sense strand
gcuuagcaaauccaacggcug

SEQ ID NO: 9965 - RNA, 21 nt, Artificial Sequence
  Ebola virus siRNA sense strand
cuuagcaaauccaacggcuga

SEQ ID NO: 9966 - RNA, 21 nt, Artificial Sequence
  Ebola virus siRNA sense strand
uuagcaaauccaacggcugau

SEQ ID NO: 9967 - RNA, 21 nt, Artificial Sequence
  Ebola virus siRNA sense strand
uagcaaauccaacggcugaug

SEQ ID NO: 9968 - RNA, 21 nt, Artificial Sequence
  Ebola virus siRNA sense strand
agcaaauccaacggcugauga

SEQ ID NO: 9969 - RNA, 21 nt, Artificial Sequence
  Ebola virus siRNA sense strand
gcaaauccaacggcugaugau

SEQ ID NO: 9970 - RNA, 21 nt, Artificial Sequence
  Ebola virus siRNA sense strand
caaauccaacggcugaugauu

SEQ ID NO: 9971 - RNA, 21 nt, Artificial Sequence
  Ebola virus siRNA sense strand
aaauccaacggcugaugauuu

SEQ ID NO: 9972 - RNA, 21 nt, Artificial Sequence
  Ebola virus siRNA sense strand
aauccaacggcugaugauuuc

SEQ ID NO: 9973 - RNA, 21 nt, Artificial Sequence
  Ebola virus siRNA sense strand
auccaacggcugaugauuucc

SEQ ID NO: 9974 - RNA, 21 nt, Artificial Sequence
  Ebola virus siRNA sense strand
uccaacggcugaugauuucca

SEQ ID NO: 9975 - RNA, 21 nt, Artificial Sequence
  Ebola virus siRNA sense strand
ccaacggcugaugauuuccag

SEQ ID NO: 9976 - RNA, 21 nt, Artificial Sequence
  Ebola virus siRNA sense strand
caacggcugaugauuuccagc

SEQ ID NO: 9977 - RNA, 21 nt, Artificial Sequence
  Ebola virus siRNA sense strand
aacggcugaugauuuccagca

SEQ ID NO: 9978 - RNA, 21 nt, Artificial Sequence
  Ebola virus siRNA sense strand
acggcugaugauuuccagcaa

SEQ ID NO: 9979 - RNA, 21 nt, Artificial Sequence
  Ebola virus siRNA sense strand
cggcugaugauuuccagcaag

SEQ ID NO: 9980 - RNA, 21 nt, Artificial Sequence
  Ebola virus siRNA sense strand
ggcugaugauuuccagcaaga

SEQ ID NO: 9981 - RNA, 21 nt, Artificial Sequence
  Ebola virus siRNA sense strand
gcugaugauuuccagcaagag

SEQ ID NO: 9982 - RNA, 21 nt, Artificial Sequence
  Ebola virus siRNA sense strand
cugaugauuuccagcaagagg

SEQ ID NO: 9983 - RNA, 21 nt, Artificial Sequence
  Ebola virus siRNA sense strand
ugaugauuuccagcaagagga

SEQ ID NO: 9984 - RNA, 21 nt, Artificial Sequence
  Ebola virus siRNA sense strand
gaugauuuccagcaagaggaa

SEQ ID NO: 9985 - RNA, 21 nt, Artificial Sequence
  Ebola virus siRNA sense strand
augauuuccagcaagaggaag

SEQ ID NO: 9986 - RNA, 21 nt, Artificial Sequence
  Ebola virus siRNA sense strand
ugauuuccagcaagaggaagg

SEQ ID NO: 9987 - RNA, 21 nt, Artificial Sequence
  Ebola virus siRNA sense strand
gauuuccagcaagaggaaggu

SEQ ID NO: 9988 - RNA, 21 nt, Artificial Sequence
  Ebola virus siRNA sense strand
auuuccagcaagaggaagguc

SEQ ID NO: 9989 - RNA, 21 nt, Artificial Sequence
  Ebola virus siRNA sense strand
uuuccagcaagaggaaggucc

SEQ ID NO: 9990 - RNA, 21 nt, Artificial Sequence
  Ebola virus siRNA sense strand
uuccagcaagaggaaggucca

SEQ ID NO: 9991 - RNA, 21 nt, Artificial Sequence
  Ebola virus siRNA sense strand
uccagcaagaggaagguccaa

SEQ ID NO: 9992 - RNA, 21 nt, Artificial Sequence
  Ebola virus siRNA sense strand
ccagcaagaggaagguccaaa

SEQ ID NO: 9993 - RNA, 21 nt, Artificial Sequence
  Ebola virus siRNA sense strand
cagcaagaggaagguccaaaa

SEQ ID NO: 9994 - RNA, 21 nt, Artificial Sequence
  Ebola virus siRNA sense strand
agcaagaggaagguccaaaaa

SEQ ID NO: 9995 - RNA, 21 nt, Artificial Sequence
  Ebola virus siRNA sense strand
gcaagaggaagguccaaaaau

SEQ ID NO: 9996 - RNA, 21 nt, Artificial Sequence
  Ebola virus siRNA sense strand
caagaggaagguccaaaaauu

SEQ ID NO: 9997 - RNA, 21 nt, Artificial Sequence
  Ebola virus siRNA sense strand
aagaggaagguccaaaaauua

SEQ ID NO: 9998 - RNA, 21 nt, Artificial Sequence
  Ebola virus siRNA sense strand
agaggaagguccaaaaauuac

SEQ ID NO: 9999 - RNA, 21 nt, Artificial Sequence
  Ebola virus siRNA sense strand
gaggaagguccaaaaauuacc

SEQ ID NO: 10000 - RNA, 21 nt, Artificial Sequence
  Ebola virus siRNA sense strand
aggaagguccaaaaauuaccu

SEQ ID NO: 10001 - RNA, 21 nt, Artificial Sequence
  Ebola virus siRNA sense strand
ggaagguccaaaaauuaccuu

SEQ ID NO: 10002 - RNA, 21 nt, Artificial Sequence
  Ebola virus siRNA sense strand
gaagguccaaaaauuaccuug

SEQ ID NO: 10003 - RNA, 21 nt, Artificial Sequence
  Ebola virus siRNA sense strand
aagguccaaaaauuaccuugu

SEQ ID NO: 10004 - RNA, 21 nt, Artificial Sequence
  Ebola virus siRNA sense strand
agguccaaaaauuaccuuguu

SEQ ID NO: 10005 - RNA, 21 nt, Artificial Sequence
  Ebola virus siRNA sense strand
gguccaaaaauuaccuuguug

SEQ ID NO: 10006 - RNA, 21 nt, Artificial Sequence
  Ebola virus siRNA sense strand
guccaaaaauuaccuuguuga

SEQ ID NO: 10007 - RNA, 21 nt, Artificial Sequence
  Ebola virus siRNA sense strand
uccaaaaauuaccuuguugac

SEQ ID NO: 10008 - RNA, 21 nt, Artificial Sequence
  Ebola virus siRNA sense strand
ccaaaaauuaccuuguugaca

SEQ ID NO: 10009 - RNA, 21 nt, Artificial Sequence
  Ebola virus siRNA sense strand
caaaaauuaccuuguugacac

SEQ ID NO: 10010 - RNA, 21 nt, Artificial Sequence
  Ebola virus siRNA sense strand
aaaaauuaccuuguugacacu

SEQ ID NO: 10011 - RNA, 21 nt, Artificial Sequence
  Ebola virus siRNA sense strand
aaaauuaccuuguugacacug

SEQ ID NO: 10012 - RNA, 21 nt, Artificial Sequence
  Ebola virus siRNA sense strand
aaauuaccuuguugacacuga

SEQ ID NO: 10013 - RNA, 21 nt, Artificial Sequence
  Ebola virus siRNA sense strand
aauuaccuuguugacacugau

SEQ ID NO: 10014 - RNA, 21 nt, Artificial Sequence
  Ebola virus siRNA sense strand
auuaccuuguugacacugauc

SEQ ID NO: 10015 - RNA, 21 nt, Artificial Sequence
  Ebola virus siRNA sense strand
uuaccuuguugacacugauca

SEQ ID NO: 10016 - RNA, 21 nt, Artificial Sequence
  Ebola virus siRNA sense strand
uaccuuguugacacugaucaa

SEQ ID NO: 10017 - RNA, 21 nt, Artificial Sequence
  Ebola virus siRNA sense strand
accuuguugacacugaucaag

SEQ ID NO: 10018 - RNA, 21 nt, Artificial Sequence
  Ebola virus siRNA sense strand
ccuuguugacacugaucaaga

SEQ ID NO: 10019 - RNA, 21 nt, Artificial Sequence
  Ebola virus siRNA sense strand
cuuguugacacugaucaagac

SEQ ID NO: 10020 - RNA, 21 nt, Artificial Sequence
  Ebola virus siRNA sense strand
uuguugacacugaucaagacg

SEQ ID NO: 10021 - RNA, 21 nt, Artificial Sequence
  Ebola virus siRNA sense strand
uguugacacugaucaagacgg

SEQ ID NO: 10022 - RNA, 21 nt, Artificial Sequence
  Ebola virus siRNA sense strand
guugacacugaucaagacggc

SEQ ID NO: 10023 - RNA, 21 nt, Artificial Sequence
  Ebola virus siRNA sense strand
uugacacugaucaagacggca

SEQ ID NO: 10024 - RNA, 21 nt, Artificial Sequence
  Ebola virus siRNA sense strand
ugacacugaucaagacggcag

SEQ ID NO: 10025 - RNA, 21 nt, Artificial Sequence
  Ebola virus siRNA sense strand
gacacugaucaagacggcaga

SEQ ID NO: 10026 - RNA, 21 nt, Artificial Sequence
  Ebola virus siRNA sense strand
acacugaucaagacggcagaa

SEQ ID NO: 10027 - RNA, 21 nt, Artificial Sequence
  Ebola virus siRNA sense strand
cacugaucaagacggcagaac

SEQ ID NO: 10028 - RNA, 21 nt, Artificial Sequence
  Ebola virus siRNA sense strand
acugaucaagacggcagaaca

SEQ ID NO: 10029 - RNA, 21 nt, Artificial Sequence
  Ebola virus siRNA sense strand
cugaucaagacggcagaacac

SEQ ID NO: 10030 - RNA, 21 nt, Artificial Sequence
  Ebola virus siRNA sense strand
ugaucaagacggcagaacacu

SEQ ID NO: 10031 - RNA, 21 nt, Artificial Sequence
  Ebola virus siRNA sense strand
gaucaagacggcagaacacug

SEQ ID NO: 10032 - RNA, 21 nt, Artificial Sequence
  Ebola virus siRNA sense strand
aucaagacggcagaacacugg

SEQ ID NO: 10033 - RNA, 21 nt, Artificial Sequence
  Ebola virus siRNA sense strand
ucaagacggcagaacacuggg

SEQ ID NO: 10034 - RNA, 21 nt, Artificial Sequence
  Ebola virus siRNA sense strand
caagacggcagaacacugggc

SEQ ID NO: 10035 - RNA, 21 nt, Artificial Sequence
  Ebola virus siRNA sense strand
aagacggcagaacacugggcg

SEQ ID NO: 10036 - RNA, 21 nt, Artificial Sequence
  Ebola virus siRNA sense strand
agacggcagaacacugggcga

SEQ ID NO: 10037 - RNA, 21 nt, Artificial Sequence
  Ebola virus siRNA sense strand
gacggcagaacacugggcgag

SEQ ID NO: 10038 - RNA, 21 nt, Artificial Sequence
  Ebola virus siRNA sense strand
acggcagaacacugggcgaga

SEQ ID NO: 10039 - RNA, 21 nt, Artificial Sequence
  Ebola virus siRNA sense strand
cggcagaacacugggcgagac

SEQ ID NO: 10040 - RNA, 21 nt, Artificial Sequence
  Ebola virus siRNA sense strand
ggcagaacacugggcgagaca

SEQ ID NO: 10041 - RNA, 21 nt, Artificial Sequence
  Ebola virus siRNA sense strand
gcagaacacugggcgagacaa

SEQ ID NO: 10042 - RNA, 21 nt, Artificial Sequence
  Ebola virus siRNA sense strand
cagaacacugggcgagacaag

SEQ ID NO: 10043 - RNA, 21 nt, Artificial Sequence
  Ebola virus siRNA sense strand
agaacacugggcgagacaaga

SEQ ID NO: 10044 - RNA, 21 nt, Artificial Sequence
  Ebola virus siRNA sense strand
gaacacugggcgagacaagac

SEQ ID NO: 10045 - RNA, 21 nt, Artificial Sequence
  Ebola virus siRNA sense strand
aacacugggcgagacaagaca

SEQ ID NO: 10046 - RNA, 21 nt, Artificial Sequence
  Ebola virus siRNA sense strand
acacugggcgagacaagacau

SEQ ID NO: 10047 - RNA, 21 nt, Artificial Sequence
  Ebola virus siRNA sense strand
cacugggcgagacaagacauc

SEQ ID NO: 10048 - RNA, 21 nt, Artificial Sequence
  Ebola virus siRNA sense strand
acugggcgagacaagacauca

SEQ ID NO: 10049 - RNA, 21 nt, Artificial Sequence
  Ebola virus siRNA sense strand
cugggcgagacaagacaucag

SEQ ID NO: 10050 - RNA, 21 nt, Artificial Sequence
  Ebola virus siRNA sense strand
ugggcgagacaagacaucaga

SEQ ID NO: 10051 - RNA, 21 nt, Artificial Sequence
  Ebola virus siRNA sense strand
gggcgagacaagacaucagaa

SEQ ID NO: 10052 - RNA, 21 nt, Artificial Sequence
  Ebola virus siRNA sense strand
ggcgagacaagacaucagaac

SEQ ID NO: 10053 - RNA, 21 nt, Artificial Sequence
  Ebola virus siRNA sense strand
gcgagacaagacaucagaacc

SEQ ID NO: 10054 - RNA, 21 nt, Artificial Sequence
  Ebola virus siRNA sense strand
cgagacaagacaucagaacca

SEQ ID NO: 10055 - RNA, 21 nt, Artificial Sequence
  Ebola virus siRNA sense strand
gagacaagacaucagaaccau

SEQ ID NO: 10056 - RNA, 21 nt, Artificial Sequence
  Ebola virus siRNA sense strand
agacaagacaucagaaccaua

SEQ ID NO: 10057 - RNA, 21 nt, Artificial Sequence
  Ebola virus siRNA sense strand
gacaagacaucagaaccauag

SEQ ID NO: 10058 - RNA, 21 nt, Artificial Sequence
  Ebola virus siRNA sense strand
acaagacaucagaaccauaga

SEQ ID NO: 10059 - RNA, 21 nt, Artificial Sequence
  Ebola virus siRNA sense strand
caagacaucagaaccauagag

SEQ ID NO: 10060 - RNA, 21 nt, Artificial Sequence
  Ebola virus siRNA sense strand
aagacaucagaaccauagagg

SEQ ID NO: 10061 - RNA, 21 nt, Artificial Sequence
  Ebola virus siRNA sense strand
agacaucagaaccauagagga

SEQ ID NO: 10062 - RNA, 21 nt, Artificial Sequence
  Ebola virus siRNA sense strand
gacaucagaaccauagaggau

SEQ ID NO: 10063 - RNA, 21 nt, Artificial Sequence
  Ebola virus siRNA sense strand
acaucagaaccauagaggauu

SEQ ID NO: 10064 - RNA, 21 nt, Artificial Sequence
  Ebola virus siRNA sense strand
caucagaaccauagaggauuc

SEQ ID NO: 10065 - RNA, 21 nt, Artificial Sequence
  Ebola virus siRNA sense strand
aucagaaccauagaggauuca

SEQ ID NO: 10066 - RNA, 21 nt, Artificial Sequence
  Ebola virus siRNA sense strand
ucagaaccauagaggauucaa

SEQ ID NO: 10067 - RNA, 21 nt, Artificial Sequence
  Ebola virus siRNA sense strand
cagaaccauagaggauucaaa

SEQ ID NO: 10068 - RNA, 21 nt, Artificial Sequence
  Ebola virus siRNA sense strand
agaaccauagaggauucaaaa

SEQ ID NO: 10069 - RNA, 21 nt, Artificial Sequence
  Ebola virus siRNA sense strand
gaaccauagaggauucaaaau

SEQ ID NO: 10070 - RNA, 21 nt, Artificial Sequence
  Ebola virus siRNA sense strand
aaccauagaggauucaaaauu

SEQ ID NO: 10071 - RNA, 21 nt, Artificial Sequence
  Ebola virus siRNA sense strand
accauagaggauucaaaauua

SEQ ID NO: 10072 - RNA, 21 nt, Artificial Sequence
  Ebola virus siRNA sense strand
ccauagaggauucaaaauuaa

SEQ ID NO: 10073 - RNA, 21 nt, Artificial Sequence
  Ebola virus siRNA sense strand
cauagaggauucaaaauuaag

SEQ ID NO: 10074 - RNA, 21 nt, Artificial Sequence
  Ebola virus siRNA sense strand
auagaggauucaaaauuaaga

SEQ ID NO: 10075 - RNA, 21 nt, Artificial Sequence
  Ebola virus siRNA sense strand
uagaggauucaaaauuaagag

SEQ ID NO: 10076 - RNA, 21 nt, Artificial Sequence
  Ebola virus siRNA sense strand
agaggauucaaaauuaagagc

SEQ ID NO: 10077 - RNA, 21 nt, Artificial Sequence
  Ebola virus siRNA sense strand
gaggauucaaaauuaagagca

SEQ ID NO: 10078 - RNA, 21 nt, Artificial Sequence
  Ebola virus siRNA sense strand
aggauucaaaauuaagagcau

SEQ ID NO: 10079 - RNA, 21 nt, Artificial Sequence
  Ebola virus siRNA sense strand
ggauucaaaauuaagagcauu

SEQ ID NO: 10080 - RNA, 21 nt, Artificial Sequence
  Ebola virus siRNA sense strand
gauucaaaauuaagagcauug

SEQ ID NO: 10081 - RNA, 21 nt, Artificial Sequence
  Ebola virus siRNA sense strand
auucaaaauuaagagcauugu

SEQ ID NO: 10082 - RNA, 21 nt, Artificial Sequence
  Ebola virus siRNA sense strand
uucaaaauuaagagcauuguu

SEQ ID NO: 10083 - RNA, 21 nt, Artificial Sequence
  Ebola virus siRNA sense strand
ucaaaauuaagagcauuguug

SEQ ID NO: 10084 - RNA, 21 nt, Artificial Sequence
  Ebola virus siRNA sense strand
caaaauuaagagcauuguuga

SEQ ID NO: 10085 - RNA, 21 nt, Artificial Sequence
  Ebola virus siRNA sense strand
aaaauuaagagcauuguugac

SEQ ID NO: 10086 - RNA, 21 nt, Artificial Sequence
  Ebola virus siRNA sense strand
aaauuaagagcauuguugacu

SEQ ID NO: 10087 - RNA, 21 nt, Artificial Sequence
  Ebola virus siRNA sense strand
aauuaagagcauuguugacuc

SEQ ID NO: 10088 - RNA, 21 nt, Artificial Sequence
  Ebola virus siRNA sense strand
auuaagagcauuguugacucu

SEQ ID NO: 10089 - RNA, 21 nt, Artificial Sequence
  Ebola virus siRNA sense strand
uuaagagcauuguugacucua

SEQ ID NO: 10090 - RNA, 21 nt, Artificial Sequence
  Ebola virus siRNA sense strand
uaagagcauuguugacucuau

SEQ ID NO: 10091 - RNA, 21 nt, Artificial Sequence
  Ebola virus siRNA sense strand
aagagcauuguugacucuaug

SEQ ID NO: 10092 - RNA, 21 nt, Artificial Sequence
  Ebola virus siRNA sense strand
agagcauuguugacucuaugu

SEQ ID NO: 10093 - RNA, 21 nt, Artificial Sequence
  Ebola virus siRNA sense strand
gagcauuguugacucuaugug

SEQ ID NO: 10094 - RNA, 21 nt, Artificial Sequence
  Ebola virus siRNA sense strand
agcauuguugacucuaugugc

SEQ ID NO: 10095 - RNA, 21 nt, Artificial Sequence
  Ebola virus siRNA sense strand
gcauuguugacucuaugugcu

SEQ ID NO: 10096 - RNA, 21 nt, Artificial Sequence
  Ebola virus siRNA sense strand
cauuguugacucuaugugcug

SEQ ID NO: 10097 - RNA, 21 nt, Artificial Sequence
  Ebola virus siRNA sense strand
auuguugacucuaugugcugu

SEQ ID NO: 10098 - RNA, 21 nt, Artificial Sequence
  Ebola virus siRNA sense strand
uuguugacucuaugugcugug

SEQ ID NO: 10099 - RNA, 21 nt, Artificial Sequence
  Ebola virus siRNA sense strand
uguugacucuaugugcuguga

SEQ ID NO: 10100 - RNA, 21 nt, Artificial Sequence
  Ebola virus siRNA sense strand
guugacucuaugugcugugau

SEQ ID NO: 10101 - RNA, 21 nt, Artificial Sequence
  Ebola virus siRNA sense strand
uugacucuaugugcugugaug

SEQ ID NO: 10102 - RNA, 21 nt, Artificial Sequence
  Ebola virus siRNA sense strand
ugacucuaugugcugugauga

SEQ ID NO: 10103 - RNA, 21 nt, Artificial Sequence
  Ebola virus siRNA sense strand
gacucuaugugcugugaugac

SEQ ID NO: 10104 - RNA, 21 nt, Artificial Sequence
  Ebola virus siRNA sense strand
acucuaugugcugugaugacg

SEQ ID NO: 10105 - RNA, 21 nt, Artificial Sequence
  Ebola virus siRNA sense strand
cucuaugugcugugaugacga

SEQ ID NO: 10106 - RNA, 21 nt, Artificial Sequence
  Ebola virus siRNA sense strand
ucuaugugcugugaugacgag

SEQ ID NO: 10107 - RNA, 21 nt, Artificial Sequence
  Ebola virus siRNA sense strand
cuaugugcugugaugacgagg

SEQ ID NO: 10108 - RNA, 21 nt, Artificial Sequence
  Ebola virus siRNA sense strand
uaugugcugugaugacgagga

SEQ ID NO: 10109 - RNA, 21 nt, Artificial Sequence
  Ebola virus siRNA sense strand
augugcugugaugacgaggaa

SEQ ID NO: 10110 - RNA, 21 nt, Artificial Sequence
  Ebola virus siRNA sense strand
ugugcugugaugacgaggaaa

SEQ ID NO: 10111 - RNA, 21 nt, Artificial Sequence
  Ebola virus siRNA sense strand
gugcugugaugacgaggaaau

SEQ ID NO: 10112 - RNA, 21 nt, Artificial Sequence
  Ebola virus siRNA sense strand
ugcugugaugacgaggaaauu

SEQ ID NO: 10113 - RNA, 21 nt, Artificial Sequence
  Ebola virus siRNA sense strand
gcugugaugacgaggaaauuc

SEQ ID NO: 10114 - RNA, 21 nt, Artificial Sequence
  Ebola virus siRNA sense strand
cugugaugacgaggaaauucu

SEQ ID NO: 10115 - RNA, 21 nt, Artificial Sequence
  Ebola virus siRNA sense strand
ugugaugacgaggaaauucuc

SEQ ID NO: 10116 - RNA, 21 nt, Artificial Sequence
  Ebola virus siRNA sense strand
gugaugacgaggaaauucuca

SEQ ID NO: 10117 - RNA, 21 nt, Artificial Sequence
  Ebola virus siRNA sense strand
ugaugacgaggaaauucucaa

SEQ ID NO: 10118 - RNA, 21 nt, Artificial Sequence
  Ebola virus siRNA sense strand
gaugacgaggaaauucucaaa

SEQ ID NO: 10119 - RNA, 21 nt, Artificial Sequence
  Ebola virus siRNA sense strand
augacgaggaaauucucaaaa

SEQ ID NO: 10120 - RNA, 21 nt, Artificial Sequence
  Ebola virus siRNA sense strand
ugacgaggaaauucucaaaau

SEQ ID NO: 10121 - RNA, 21 nt, Artificial Sequence
  Ebola virus siRNA sense strand
gacgaggaaauucucaaaauc

SEQ ID NO: 10122 - RNA, 21 nt, Artificial Sequence
  Ebola virus siRNA sense strand
acgaggaaauucucaaaaucc

SEQ ID NO: 10123 - RNA, 21 nt, Artificial Sequence
  Ebola virus siRNA sense strand
cgaggaaauucucaaaauccc

SEQ ID NO: 10124 - RNA, 21 nt, Artificial Sequence
  Ebola virus siRNA sense strand
gaggaaauucucaaaauccca

SEQ ID NO: 10125 - RNA, 21 nt, Artificial Sequence
  Ebola virus siRNA sense strand
aggaaauucucaaaaucccag

SEQ ID NO: 10126 - RNA, 21 nt, Artificial Sequence
  Ebola virus siRNA sense strand
ggaaauucucaaaaucccagc

SEQ ID NO: 10127 - RNA, 21 nt, Artificial Sequence
  Ebola virus siRNA sense strand
gaaauucucaaaaucccagcu

SEQ ID NO: 10128 - RNA, 21 nt, Artificial Sequence
  Ebola virus siRNA sense strand
aaauucucaaaaucccagcug

SEQ ID NO: 10129 - RNA, 21 nt, Artificial Sequence
  Ebola virus siRNA sense strand
aauucucaaaaucccagcuga

SEQ ID NO: 10130 - RNA, 21 nt, Artificial Sequence
  Ebola virus siRNA sense strand
auucucaaaaucccagcugag

SEQ ID NO: 10131 - RNA, 21 nt, Artificial Sequence
  Ebola virus siRNA sense strand
uucucaaaaucccagcugagu

SEQ ID NO: 10132 - RNA, 21 nt, Artificial Sequence
  Ebola virus siRNA sense strand
ucucaaaaucccagcugaguc

SEQ ID NO: 10133 - RNA, 21 nt, Artificial Sequence
  Ebola virus siRNA sense strand
cucaaaaucccagcugagucu

SEQ ID NO: 10134 - RNA, 21 nt, Artificial Sequence
  Ebola virus siRNA sense strand
ucaaaaucccagcugagucuu

SEQ ID NO: 10135 - RNA, 21 nt, Artificial Sequence
  Ebola virus siRNA sense strand
caaaaucccagcugagucuuu

SEQ ID NO: 10136 - RNA, 21 nt, Artificial Sequence
  Ebola virus siRNA sense strand
aaaaucccagcugagucuuuu

SEQ ID NO: 10137 - RNA, 21 nt, Artificial Sequence
  Ebola virus siRNA sense strand
aaaucccagcugagucuuuua

SEQ ID NO: 10138 - RNA, 21 nt, Artificial Sequence
  Ebola virus siRNA sense strand
aaucccagcugagucuuuuau

SEQ ID NO: 10139 - RNA, 21 nt, Artificial Sequence
  Ebola virus siRNA sense strand
aucccagcugagucuuuuaug

SEQ ID NO: 10140 - RNA, 21 nt, Artificial Sequence
  Ebola virus siRNA sense strand
ucccagcugagucuuuuaugu

SEQ ID NO: 10141 - RNA, 21 nt, Artificial Sequence
  Ebola virus siRNA sense strand
cccagcugagucuuuuaugug

SEQ ID NO: 10142 - RNA, 21 nt, Artificial Sequence
  Ebola virus siRNA sense strand
ccagcugagucuuuuauguga

SEQ ID NO: 10143 - RNA, 21 nt, Artificial Sequence
  Ebola virus siRNA sense strand
cagcugagucuuuuaugugag

SEQ ID NO: 10144 - RNA, 21 nt, Artificial Sequence
  Ebola virus siRNA sense strand
agcugagucuuuuaugugaga

SEQ ID NO: 10145 - RNA, 21 nt, Artificial Sequence
  Ebola virus siRNA sense strand
gcugagucuuuuaugugagac

SEQ ID NO: 10146 - RNA, 21 nt, Artificial Sequence
  Ebola virus siRNA sense strand
cugagucuuuuaugugagaca

SEQ ID NO: 10147 - RNA, 21 nt, Artificial Sequence
  Ebola virus siRNA sense strand
ugagucuuuuaugugagacac

SEQ ID NO: 10148 - RNA, 21 nt, Artificial Sequence
  Ebola virus siRNA sense strand
gagucuuuuaugugagacaca

SEQ ID NO: 10149 - RNA, 21 nt, Artificial Sequence
  Ebola virus siRNA sense strand
agucuuuuaugugagacacac

SEQ ID NO: 10150 - RNA, 21 nt, Artificial Sequence
  Ebola virus siRNA sense strand
gucuuuuaugugagacacacc

SEQ ID NO: 10151 - RNA, 21 nt, Artificial Sequence
  Ebola virus siRNA sense strand
ucuuuuaugugagacacaccu

SEQ ID NO: 10152 - RNA, 21 nt, Artificial Sequence
  Ebola virus siRNA sense strand
cuuuuaugugagacacaccua

SEQ ID NO: 10153 - RNA, 21 nt, Artificial Sequence
  Ebola virus siRNA sense strand
uuuuaugugagacacaccuaa

SEQ ID NO: 10154 - RNA, 21 nt, Artificial Sequence
  Ebola virus siRNA sense strand
uuuaugugagacacaccuaag

SEQ ID NO: 10155 - RNA, 21 nt, Artificial Sequence
  Ebola virus siRNA sense strand
uuaugugagacacaccuaagg

SEQ ID NO: 10156 - RNA, 21 nt, Artificial Sequence
  Ebola virus siRNA sense strand
uaugugagacacaccuaaggc

SEQ ID NO: 10157 - RNA, 21 nt, Artificial Sequence
  Ebola virus siRNA sense strand
augugagacacaccuaaggcg

SEQ ID NO: 10158 - RNA, 21 nt, Artificial Sequence
  Ebola virus siRNA sense strand
ugugagacacaccuaaggcgc

SEQ ID NO: 10159 - RNA, 21 nt, Artificial Sequence
  Ebola virus siRNA sense strand
gugagacacaccuaaggcgcg

SEQ ID NO: 10160 - RNA, 21 nt, Artificial Sequence
  Ebola virus siRNA sense strand
ugagacacaccuaaggcgcga

SEQ ID NO: 10161 - RNA, 21 nt, Artificial Sequence
  Ebola virus siRNA sense strand
gagacacaccuaaggcgcgag

SEQ ID NO: 10162 - RNA, 21 nt, Artificial Sequence
  Ebola virus siRNA sense strand
agacacaccuaaggcgcgagg

SEQ ID NO: 10163 - RNA, 21 nt, Artificial Sequence
  Ebola virus siRNA sense strand
gacacaccuaaggcgcgaggg

SEQ ID NO: 10164 - RNA, 21 nt, Artificial Sequence
  Ebola virus siRNA sense strand
acacaccuaaggcgcgagggg

SEQ ID NO: 10165 - RNA, 21 nt, Artificial Sequence
  Ebola virus siRNA sense strand
cacaccuaaggcgcgaggggc

SEQ ID NO: 10166 - RNA, 21 nt, Artificial Sequence
  Ebola virus siRNA sense strand
acaccuaaggcgcgaggggcu

SEQ ID NO: 10167 - RNA, 21 nt, Artificial Sequence
  Ebola virus siRNA sense strand
caccuaaggcgcgaggggcuu

SEQ ID NO: 10168 - RNA, 21 nt, Artificial Sequence
  Ebola virus siRNA sense strand
accuaaggcgcgaggggcuug

SEQ ID NO: 10169 - RNA, 21 nt, Artificial Sequence
  Ebola virus siRNA sense strand
ccuaaggcgcgaggggcuugg

SEQ ID NO: 10170 - RNA, 21 nt, Artificial Sequence
  Ebola virus siRNA sense strand
cuaaggcgcgaggggcuuggg

SEQ ID NO: 10171 - RNA, 21 nt, Artificial Sequence
  Ebola virus siRNA sense strand
uaaggcgcgaggggcuugggc

SEQ ID NO: 10172 - RNA, 21 nt, Artificial Sequence
  Ebola virus siRNA sense strand
aaggcgcgaggggcuugggca

SEQ ID NO: 10173 - RNA, 21 nt, Artificial Sequence
  Ebola virus siRNA sense strand
aggcgcgaggggcuugggcaa

SEQ ID NO: 10174 - RNA, 21 nt, Artificial Sequence
  Ebola virus siRNA sense strand
ggcgcgaggggcuugggcaag

SEQ ID NO: 10175 - RNA, 21 nt, Artificial Sequence
  Ebola virus siRNA sense strand
gcgcgaggggcuugggcaaga

SEQ ID NO: 10176 - RNA, 21 nt, Artificial Sequence
  Ebola virus siRNA sense strand
cgcgaggggcuugggcaagau

SEQ ID NO: 10177 - RNA, 21 nt, Artificial Sequence
  Ebola virus siRNA sense strand
gcgaggggcuugggcaagauc

SEQ ID NO: 10178 - RNA, 21 nt, Artificial Sequence
  Ebola virus siRNA sense strand
cgaggggcuugggcaagauca

SEQ ID NO: 10179 - RNA, 21 nt, Artificial Sequence
  Ebola virus siRNA sense strand
gaggggcuugggcaagaucag

SEQ ID NO: 10180 - RNA, 21 nt, Artificial Sequence
  Ebola virus siRNA sense strand
aggggcuugggcaagaucagg

SEQ ID NO: 10181 - RNA, 21 nt, Artificial Sequence
  Ebola virus siRNA sense strand
ggggcuugggcaagaucaggc

SEQ ID NO: 10182 - RNA, 21 nt, Artificial Sequence
  Ebola virus siRNA sense strand
gggcuugggcaagaucaggca

SEQ ID NO: 10183 - RNA, 21 nt, Artificial Sequence
  Ebola virus siRNA sense strand
ggcuugggcaagaucaggcag

SEQ ID NO: 10184 - RNA, 21 nt, Artificial Sequence
  Ebola virus siRNA sense strand
gcuugggcaagaucaggcaga

SEQ ID NO: 10185 - RNA, 21 nt, Artificial Sequence
  Ebola virus siRNA sense strand
cuugggcaagaucaggcagaa

SEQ ID NO: 10186 - RNA, 21 nt, Artificial Sequence
  Ebola virus siRNA sense strand
uugggcaagaucaggcagaac

SEQ ID NO: 10187 - RNA, 21 nt, Artificial Sequence
  Ebola virus siRNA sense strand
ugggcaagaucaggcagaacc

SEQ ID NO: 10188 - RNA, 21 nt, Artificial Sequence
  Ebola virus siRNA sense strand
gggcaagaucaggcagaaccc

SEQ ID NO: 10189 - RNA, 21 nt, Artificial Sequence
  Ebola virus siRNA sense strand
ggcaagaucaggcagaacccg

SEQ ID NO: 10190 - RNA, 21 nt, Artificial Sequence
  Ebola virus siRNA sense strand
gcaagaucaggcagaacccgu

SEQ ID NO: 10191 - RNA, 21 nt, Artificial Sequence
  Ebola virus siRNA sense strand
caagaucaggcagaacccguu

SEQ ID NO: 10192 - RNA, 21 nt, Artificial Sequence
  Ebola virus siRNA sense strand
aagaucaggcagaacccguuc

SEQ ID NO: 10193 - RNA, 21 nt, Artificial Sequence
  Ebola virus siRNA sense strand
agaucaggcagaacccguucu

SEQ ID NO: 10194 - RNA, 21 nt, Artificial Sequence
  Ebola virus siRNA sense strand
gaucaggcagaacccguucuc

SEQ ID NO: 10195 - RNA, 21 nt, Artificial Sequence
  Ebola virus siRNA sense strand
aucaggcagaacccguucucg

SEQ ID NO: 10196 - RNA, 21 nt, Artificial Sequence
  Ebola virus siRNA sense strand
ucaggcagaacccguucucga

SEQ ID NO: 10197 - RNA, 21 nt, Artificial Sequence
  Ebola virus siRNA sense strand
caggcagaacccguucucgaa

SEQ ID NO: 10198 - RNA, 21 nt, Artificial Sequence
  Ebola virus siRNA sense strand
aggcagaacccguucucgaag

SEQ ID NO: 10199 - RNA, 21 nt, Artificial Sequence
  Ebola virus siRNA sense strand
ggcagaacccguucucgaagu

SEQ ID NO: 10200 - RNA, 21 nt, Artificial Sequence
  Ebola virus siRNA sense strand
gcagaacccguucucgaagua

SEQ ID NO: 10201 - RNA, 21 nt, Artificial Sequence
  Ebola virus siRNA sense strand
cagaacccguucucgaaguau

SEQ ID NO: 10202 - RNA, 21 nt, Artificial Sequence
  Ebola virus siRNA sense strand
agaacccguucucgaaguaua

SEQ ID NO: 10203 - RNA, 21 nt, Artificial Sequence
  Ebola virus siRNA sense strand
gaacccguucucgaaguauau

SEQ ID NO: 10204 - RNA, 21 nt, Artificial Sequence
  Ebola virus siRNA sense strand
aacccguucucgaaguauauc

SEQ ID NO: 10205 - RNA, 21 nt, Artificial Sequence
  Ebola virus siRNA sense strand
acccguucucgaaguauauca

SEQ ID NO: 10206 - RNA, 21 nt, Artificial Sequence
  Ebola virus siRNA sense strand
cccguucucgaaguauaucaa

SEQ ID NO: 10207 - RNA, 21 nt, Artificial Sequence
  Ebola virus siRNA sense strand
ccguucucgaaguauaucaac

SEQ ID NO: 10208 - RNA, 21 nt, Artificial Sequence
  Ebola virus siRNA sense strand
cguucucgaaguauaucaacg

SEQ ID NO: 10209 - RNA, 21 nt, Artificial Sequence
  Ebola virus siRNA sense strand
guucucgaaguauaucaacga

SEQ ID NO: 10210 - RNA, 21 nt, Artificial Sequence
  Ebola virus siRNA sense strand
uucucgaaguauaucaacgau

SEQ ID NO: 10211 - RNA, 21 nt, Artificial Sequence
  Ebola virus siRNA sense strand
ucucgaaguauaucaacgauu

SEQ ID NO: 10212 - RNA, 21 nt, Artificial Sequence
  Ebola virus siRNA sense strand
cucgaaguauaucaacgauua

SEQ ID NO: 10213 - RNA, 21 nt, Artificial Sequence
  Ebola virus siRNA sense strand
ucgaaguauaucaacgauuac

SEQ ID NO: 10214 - RNA, 21 nt, Artificial Sequence
  Ebola virus siRNA sense strand
cgaaguauaucaacgauuaca

SEQ ID NO: 10215 - RNA, 21 nt, Artificial Sequence
  Ebola virus siRNA sense strand
gaaguauaucaacgauuacac

SEQ ID NO: 10216 - RNA, 21 nt, Artificial Sequence
  Ebola virus siRNA sense strand
aaguauaucaacgauuacaca

SEQ ID NO: 10217 - RNA, 21 nt, Artificial Sequence
  Ebola virus siRNA sense strand
aguauaucaacgauuacacag

SEQ ID NO: 10218 - RNA, 21 nt, Artificial Sequence
  Ebola virus siRNA sense strand
guauaucaacgauuacacagu

SEQ ID NO: 10219 - RNA, 21 nt, Artificial Sequence
  Ebola virus siRNA sense strand
uauaucaacgauuacacagug

SEQ ID NO: 10220 - RNA, 21 nt, Artificial Sequence
  Ebola virus siRNA sense strand
auaucaacgauuacacaguga

SEQ ID NO: 10221 - RNA, 21 nt, Artificial Sequence
  Ebola virus siRNA sense strand
uaucaacgauuacacagugau

SEQ ID NO: 10222 - RNA, 21 nt, Artificial Sequence
  Ebola virus siRNA sense strand
aucaacgauuacacagugaua

SEQ ID NO: 10223 - RNA, 21 nt, Artificial Sequence
  Ebola virus siRNA sense strand
ucaacgauuacacagugauaa

SEQ ID NO: 10224 - RNA, 21 nt, Artificial Sequence
  Ebola virus siRNA sense strand
caacgauuacacagugauaaa

SEQ ID NO: 10225 - RNA, 21 nt, Artificial Sequence
  Ebola virus siRNA sense strand
aacgauuacacagugauaaag

SEQ ID NO: 10226 - RNA, 21 nt, Artificial Sequence
  Ebola virus siRNA sense strand
acgauuacacagugauaaagg

SEQ ID NO: 10227 - RNA, 21 nt, Artificial Sequence
  Ebola virus siRNA sense strand
cgauuacacagugauaaagga

SEQ ID NO: 10228 - RNA, 21 nt, Artificial Sequence
  Ebola virus siRNA sense strand
gauuacacagugauaaaggag

SEQ ID NO: 10229 - RNA, 21 nt, Artificial Sequence
  Ebola virus siRNA sense strand
auuacacagugauaaaggagg

SEQ ID NO: 10230 - RNA, 21 nt, Artificial Sequence
  Ebola virus siRNA sense strand
uuacacagugauaaaggaggc

SEQ ID NO: 10231 - RNA, 21 nt, Artificial Sequence
  Ebola virus siRNA sense strand
uacacagugauaaaggaggca

SEQ ID NO: 10232 - RNA, 21 nt, Artificial Sequence
  Ebola virus siRNA sense strand
acacagugauaaaggaggcag

SEQ ID NO: 10233 - RNA, 21 nt, Artificial Sequence
  Ebola virus siRNA sense strand
cacagugauaaaggaggcagu

SEQ ID NO: 10234 - RNA, 21 nt, Artificial Sequence
  Ebola virus siRNA sense strand
acagugauaaaggaggcaguu

SEQ ID NO: 10235 - RNA, 21 nt, Artificial Sequence
  Ebola virus siRNA sense strand
cagugauaaaggaggcaguuu

SEQ ID NO: 10236 - RNA, 21 nt, Artificial Sequence
  Ebola virus siRNA sense strand
agugauaaaggaggcaguuuu

SEQ ID NO: 10237 - RNA, 21 nt, Artificial Sequence
  Ebola virus siRNA sense strand
gugauaaaggaggcaguuuug

SEQ ID NO: 10238 - RNA, 21 nt, Artificial Sequence
  Ebola virus siRNA sense strand
ugauaaaggaggcaguuuuga

SEQ ID NO: 10239 - RNA, 21 nt, Artificial Sequence
  Ebola virus siRNA sense strand
gauaaaggaggcaguuuugaa

SEQ ID NO: 10240 - RNA, 21 nt, Artificial Sequence
  Ebola virus siRNA sense strand
auaaaggaggcaguuuugaag

SEQ ID NO: 10241 - RNA, 21 nt, Artificial Sequence
  Ebola virus siRNA sense strand
uaaaggaggcaguuuugaagc

SEQ ID NO: 10242 - RNA, 21 nt, Artificial Sequence
  Ebola virus siRNA sense strand
aaaggaggcaguuuugaagcu

SEQ ID NO: 10243 - RNA, 21 nt, Artificial Sequence
  Ebola virus siRNA sense strand
aaggaggcaguuuugaagcug

SEQ ID NO: 10244 - RNA, 21 nt, Artificial Sequence
  Ebola virus siRNA sense strand
aggaggcaguuuugaagcugc

SEQ ID NO: 10245 - RNA, 21 nt, Artificial Sequence
  Ebola virus siRNA sense strand
ggaggcaguuuugaagcugca

SEQ ID NO: 10246 - RNA, 21 nt, Artificial Sequence
  Ebola virus siRNA sense strand
gaggcaguuuugaagcugcac

SEQ ID NO: 10247 - RNA, 21 nt, Artificial Sequence
  Ebola virus siRNA sense strand
aggcaguuuugaagcugcacu

SEQ ID NO: 10248 - RNA, 21 nt, Artificial Sequence
  Ebola virus siRNA sense strand
ggcaguuuugaagcugcacua

SEQ ID NO: 10249 - RNA, 21 nt, Artificial Sequence
  Ebola virus siRNA sense strand
gcaguuuugaagcugcacuau

SEQ ID NO: 10250 - RNA, 21 nt, Artificial Sequence
  Ebola virus siRNA sense strand
caguuuugaagcugcacuaug

SEQ ID NO: 10251 - RNA, 21 nt, Artificial Sequence
  Ebola virus siRNA sense strand
aguuuugaagcugcacuaugg

SEQ ID NO: 10252 - RNA, 21 nt, Artificial Sequence
  Ebola virus siRNA sense strand
guuuugaagcugcacuauggc

SEQ ID NO: 10253 - RNA, 21 nt, Artificial Sequence
  Ebola virus siRNA sense strand
uuuugaagcugcacuauggca

SEQ ID NO: 10254 - RNA, 21 nt, Artificial Sequence
  Ebola virus siRNA sense strand
uuugaagcugcacuauggcaa

SEQ ID NO: 10255 - RNA, 21 nt, Artificial Sequence
  Ebola virus siRNA sense strand
uugaagcugcacuauggcaac

SEQ ID NO: 10256 - RNA, 21 nt, Artificial Sequence
  Ebola virus siRNA sense strand
ugaagcugcacuauggcaaca

SEQ ID NO: 10257 - RNA, 21 nt, Artificial Sequence
  Ebola virus siRNA sense strand
gaagcugcacuauggcaacaa

SEQ ID NO: 10258 - RNA, 21 nt, Artificial Sequence
  Ebola virus siRNA sense strand
aagcugcacuauggcaacaau

SEQ ID NO: 10259 - RNA, 21 nt, Artificial Sequence
  Ebola virus siRNA sense strand
agcugcacuauggcaacaaug

SEQ ID NO: 10260 - RNA, 21 nt, Artificial Sequence
  Ebola virus siRNA sense strand
gcugcacuauggcaacaaugg

SEQ ID NO: 10261 - RNA, 21 nt, Artificial Sequence
  Ebola virus siRNA sense strand
cugcacuauggcaacaauggg

SEQ ID NO: 10262 - RNA, 21 nt, Artificial Sequence
  Ebola virus siRNA sense strand
ugcacuauggcaacaauggga

SEQ ID NO: 10263 - RNA, 21 nt, Artificial Sequence
  Ebola virus siRNA sense strand
gcacuauggcaacaaugggac

SEQ ID NO: 10264 - RNA, 21 nt, Artificial Sequence
  Ebola virus siRNA sense strand
cacuauggcaacaaugggacc

SEQ ID NO: 10265 - RNA, 21 nt, Artificial Sequence
  Ebola virus siRNA sense strand
acuauggcaacaaugggaccg

SEQ ID NO: 10266 - RNA, 21 nt, Artificial Sequence
  Ebola virus siRNA sense strand
cuauggcaacaaugggaccga

SEQ ID NO: 10267 - RNA, 21 nt, Artificial Sequence
  Ebola virus siRNA sense strand
uauggcaacaaugggaccgac

SEQ ID NO: 10268 - RNA, 21 nt, Artificial Sequence
  Ebola virus siRNA sense strand
auggcaacaaugggaccgaca

SEQ ID NO: 10269 - RNA, 21 nt, Artificial Sequence
  Ebola virus siRNA sense strand
uggcaacaaugggaccgacaa

SEQ ID NO: 10270 - RNA, 21 nt, Artificial Sequence
  Ebola virus siRNA sense strand
ggcaacaaugggaccgacaau

SEQ ID NO: 10271 - RNA, 21 nt, Artificial Sequence
  Ebola virus siRNA sense strand
gcaacaaugggaccgacaauc

SEQ ID NO: 10272 - RNA, 21 nt, Artificial Sequence
  Ebola virus siRNA sense strand
caacaaugggaccgacaaucc

SEQ ID NO: 10273 - RNA, 21 nt, Artificial Sequence
  Ebola virus siRNA sense strand
aacaaugggaccgacaauccc

SEQ ID NO: 10274 - RNA, 21 nt, Artificial Sequence
  Ebola virus siRNA sense strand
acaaugggaccgacaaucccu

SEQ ID NO: 10275 - RNA, 21 nt, Artificial Sequence
  Ebola virus siRNA sense strand
caaugggaccgacaaucccua

SEQ ID NO: 10276 - RNA, 21 nt, Artificial Sequence
  Ebola virus siRNA sense strand
aaugggaccgacaaucccuaa

SEQ ID NO: 10277 - RNA, 21 nt, Artificial Sequence
  Ebola virus siRNA sense strand
augggaccgacaaucccuaau

SEQ ID NO: 10278 - RNA, 21 nt, Artificial Sequence
  Ebola virus siRNA sense strand
ugggaccgacaaucccuaauu

SEQ ID NO: 10279 - RNA, 21 nt, Artificial Sequence
  Ebola virus siRNA sense strand
gggaccgacaaucccuaauua

SEQ ID NO: 10280 - RNA, 21 nt, Artificial Sequence
  Ebola virus siRNA sense strand
ggaccgacaaucccuaauuau

SEQ ID NO: 10281 - RNA, 21 nt, Artificial Sequence
  Ebola virus siRNA sense strand
gaccgacaaucccuaauuaug

SEQ ID NO: 10282 - RNA, 21 nt, Artificial Sequence
  Ebola virus siRNA sense strand
accgacaaucccuaauuaugu

SEQ ID NO: 10283 - RNA, 21 nt, Artificial Sequence
  Ebola virus siRNA sense strand
ccgacaaucccuaauuauguu

SEQ ID NO: 10284 - RNA, 21 nt, Artificial Sequence
  Ebola virus siRNA sense strand
cgacaaucccuaauuauguuu

SEQ ID NO: 10285 - RNA, 21 nt, Artificial Sequence
  Ebola virus siRNA sense strand
gacaaucccuaauuauguuua

SEQ ID NO: 10286 - RNA, 21 nt, Artificial Sequence
  Ebola virus siRNA sense strand
acaaucccuaauuauguuuau

SEQ ID NO: 10287 - RNA, 21 nt, Artificial Sequence
  Ebola virus siRNA sense strand
caaucccuaauuauguuuauc

SEQ ID NO: 10288 - RNA, 21 nt, Artificial Sequence
  Ebola virus siRNA sense strand
aaucccuaauuauguuuauca

SEQ ID NO: 10289 - RNA, 21 nt, Artificial Sequence
  Ebola virus siRNA sense strand
aucccuaauuauguuuaucac

SEQ ID NO: 10290 - RNA, 21 nt, Artificial Sequence
  Ebola virus siRNA sense strand
ucccuaauuauguuuaucacu

SEQ ID NO: 10291 - RNA, 21 nt, Artificial Sequence
  Ebola virus siRNA sense strand
cccuaauuauguuuaucacug

SEQ ID NO: 10292 - RNA, 21 nt, Artificial Sequence
  Ebola virus siRNA sense strand
ccuaauuauguuuaucacugc

SEQ ID NO: 10293 - RNA, 21 nt, Artificial Sequence
  Ebola virus siRNA sense strand
cuaauuauguuuaucacugca

SEQ ID NO: 10294 - RNA, 21 nt, Artificial Sequence
  Ebola virus siRNA sense strand
uaauuauguuuaucacugcau

SEQ ID NO: 10295 - RNA, 21 nt, Artificial Sequence
  Ebola virus siRNA sense strand
aauuauguuuaucacugcauu

SEQ ID NO: 10296 - RNA, 21 nt, Artificial Sequence
  Ebola virus siRNA sense strand
auuauguuuaucacugcauuc

SEQ ID NO: 10297 - RNA, 21 nt, Artificial Sequence
  Ebola virus siRNA sense strand
uuauguuuaucacugcauucu

SEQ ID NO: 10298 - RNA, 21 nt, Artificial Sequence
  Ebola virus siRNA sense strand
uauguuuaucacugcauucuu

SEQ ID NO: 10299 - RNA, 21 nt, Artificial Sequence
  Ebola virus siRNA sense strand
auguuuaucacugcauucuug

SEQ ID NO: 10300 - RNA, 21 nt, Artificial Sequence
  Ebola virus siRNA sense strand
uguuuaucacugcauucuuga

SEQ ID NO: 10301 - RNA, 21 nt, Artificial Sequence
  Ebola virus siRNA sense strand
guuuaucacugcauucuugaa

SEQ ID NO: 10302 - RNA, 21 nt, Artificial Sequence
  Ebola virus siRNA sense strand
uuuaucacugcauucuugaau

SEQ ID NO: 10303 - RNA, 21 nt, Artificial Sequence
  Ebola virus siRNA sense strand
uuaucacugcauucuugaaua

SEQ ID NO: 10304 - RNA, 21 nt, Artificial Sequence
  Ebola virus siRNA sense strand
uaucacugcauucuugaauau

SEQ ID NO: 10305 - RNA, 21 nt, Artificial Sequence
  Ebola virus siRNA sense strand
aucacugcauucuugaauauu

SEQ ID NO: 10306 - RNA, 21 nt, Artificial Sequence
  Ebola virus siRNA sense strand
ucacugcauucuugaauauug

SEQ ID NO: 10307 - RNA, 21 nt, Artificial Sequence
  Ebola virus siRNA sense strand
cacugcauucuugaauauugc

SEQ ID NO: 10308 - RNA, 21 nt, Artificial Sequence
  Ebola virus siRNA sense strand
acugcauucuugaauauugcu

SEQ ID NO: 10309 - RNA, 21 nt, Artificial Sequence
  Ebola virus siRNA sense strand
cugcauucuugaauauugcuc

SEQ ID NO: 10310 - RNA, 21 nt, Artificial Sequence
  Ebola virus siRNA sense strand
ugcauucuugaauauugcucu

SEQ ID NO: 10311 - RNA, 21 nt, Artificial Sequence
  Ebola virus siRNA sense strand
gcauucuugaauauugcucuc

SEQ ID NO: 10312 - RNA, 21 nt, Artificial Sequence
  Ebola virus siRNA sense strand
cauucuugaauauugcucucc

SEQ ID NO: 10313 - RNA, 21 nt, Artificial Sequence
  Ebola virus siRNA sense strand
auucuugaauauugcucucca

SEQ ID NO: 10314 - RNA, 21 nt, Artificial Sequence
  Ebola virus siRNA sense strand
uucuugaauauugcucuccag

SEQ ID NO: 10315 - RNA, 21 nt, Artificial Sequence
  Ebola virus siRNA sense strand
ucuugaauauugcucuccagu

SEQ ID NO: 10316 - RNA, 21 nt, Artificial Sequence
  Ebola virus siRNA sense strand
cuugaauauugcucuccaguu

SEQ ID NO: 10317 - RNA, 21 nt, Artificial Sequence
  Ebola virus siRNA sense strand
uugaauauugcucuccaguua

SEQ ID NO: 10318 - RNA, 21 nt, Artificial Sequence
  Ebola virus siRNA sense strand
ugaauauugcucuccaguuac

SEQ ID NO: 10319 - RNA, 21 nt, Artificial Sequence
  Ebola virus siRNA sense strand
gaauauugcucuccaguuacc

SEQ ID NO: 10320 - RNA, 21 nt, Artificial Sequence
  Ebola virus siRNA sense strand
aauauugcucuccaguuaccg

SEQ ID NO: 10321 - RNA, 21 nt, Artificial Sequence
  Ebola virus siRNA sense strand
auauugcucuccaguuaccgu

SEQ ID NO: 10322 - RNA, 21 nt, Artificial Sequence
  Ebola virus siRNA sense strand
uauugcucuccaguuaccgug

SEQ ID NO: 10323 - RNA, 21 nt, Artificial Sequence
  Ebola virus siRNA sense strand
auugcucuccaguuaccgugu

SEQ ID NO: 10324 - RNA, 21 nt, Artificial Sequence
  Ebola virus siRNA sense strand
uugcucuccaguuaccgugug

SEQ ID NO: 10325 - RNA, 21 nt, Artificial Sequence
  Ebola virus siRNA sense strand
ugcucuccaguuaccguguga

SEQ ID NO: 10326 - RNA, 21 nt, Artificial Sequence
  Ebola virus siRNA sense strand
gcucuccaguuaccgugugaa

SEQ ID NO: 10327 - RNA, 21 nt, Artificial Sequence
  Ebola virus siRNA sense strand
cucuccaguuaccgugugaaa

SEQ ID NO: 10328 - RNA, 21 nt, Artificial Sequence
  Ebola virus siRNA sense strand
ucuccaguuaccgugugaaag

SEQ ID NO: 10329 - RNA, 21 nt, Artificial Sequence
  Ebola virus siRNA sense strand
cuccaguuaccgugugaaagu

SEQ ID NO: 10330 - RNA, 21 nt, Artificial Sequence
  Ebola virus siRNA sense strand
uccaguuaccgugugaaaguu

SEQ ID NO: 10331 - RNA, 21 nt, Artificial Sequence
  Ebola virus siRNA sense strand
ccaguuaccgugugaaaguuc

SEQ ID NO: 10332 - RNA, 21 nt, Artificial Sequence
  Ebola virus siRNA sense strand
caguuaccgugugaaaguucu

SEQ ID NO: 10333 - RNA, 21 nt, Artificial Sequence
  Ebola virus siRNA sense strand
aguuaccgugugaaaguucug

SEQ ID NO: 10334 - RNA, 21 nt, Artificial Sequence
  Ebola virus siRNA sense strand
guuaccgugugaaaguucugc

SEQ ID NO: 10335 - RNA, 21 nt, Artificial Sequence
  Ebola virus siRNA sense strand
uuaccgugugaaaguucugcu

SEQ ID NO: 10336 - RNA, 21 nt, Artificial Sequence
  Ebola virus siRNA sense strand
uaccgugugaaaguucugcug

SEQ ID NO: 10337 - RNA, 21 nt, Artificial Sequence
  Ebola virus siRNA sense strand
accgugugaaaguucugcugu

SEQ ID NO: 10338 - RNA, 21 nt, Artificial Sequence
  Ebola virus siRNA sense strand
ccgugugaaaguucugcuguc

SEQ ID NO: 10339 - RNA, 21 nt, Artificial Sequence
  Ebola virus siRNA sense strand
cgugugaaaguucugcugucg

SEQ ID NO: 10340 - RNA, 21 nt, Artificial Sequence
  Ebola virus siRNA sense strand
gugugaaaguucugcugucgu

SEQ ID NO: 10341 - RNA, 21 nt, Artificial Sequence
  Ebola virus siRNA sense strand
ugugaaaguucugcugucguu

SEQ ID NO: 10342 - RNA, 21 nt, Artificial Sequence
  Ebola virus siRNA sense strand
gugaaaguucugcugucguug

SEQ ID NO: 10343 - RNA, 21 nt, Artificial Sequence
  Ebola virus siRNA sense strand
ugaaaguucugcugucguugu

SEQ ID NO: 10344 - RNA, 21 nt, Artificial Sequence
  Ebola virus siRNA sense strand
gaaaguucugcugucguuguu

SEQ ID NO: 10345 - RNA, 21 nt, Artificial Sequence
  Ebola virus siRNA sense strand
aaaguucugcugucguuguuu

SEQ ID NO: 10346 - RNA, 21 nt, Artificial Sequence
  Ebola virus siRNA sense strand
aaguucugcugucguuguuuc

SEQ ID NO: 10347 - RNA, 21 nt, Artificial Sequence
  Ebola virus siRNA sense strand
aguucugcugucguuguuuca

SEQ ID NO: 10348 - RNA, 21 nt, Artificial Sequence
  Ebola virus siRNA sense strand
guucugcugucguuguuucag

SEQ ID NO: 10349 - RNA, 21 nt, Artificial Sequence
  Ebola virus siRNA sense strand
uucugcugucguuguuucagg

SEQ ID NO: 10350 - RNA, 21 nt, Artificial Sequence
  Ebola virus siRNA sense strand
ucugcugucguuguuucaggg

SEQ ID NO: 10351 - RNA, 21 nt, Artificial Sequence
  Ebola virus siRNA sense strand
cugcugucguuguuucagggu

SEQ ID NO: 10352 - RNA, 21 nt, Artificial Sequence
  Ebola virus siRNA sense strand
ugcugucguuguuucaggguu

SEQ ID NO: 10353 - RNA, 21 nt, Artificial Sequence
  Ebola virus siRNA sense strand
gcugucguuguuucaggguua

SEQ ID NO: 10354 - RNA, 21 nt, Artificial Sequence
  Ebola virus siRNA sense strand
cugucguuguuucaggguuaa

SEQ ID NO: 10355 - RNA, 21 nt, Artificial Sequence
  Ebola virus siRNA sense strand
ugucguuguuucaggguuaag

SEQ ID NO: 10356 - RNA, 21 nt, Artificial Sequence
  Ebola virus siRNA sense strand
gucguuguuucaggguuaaga

SEQ ID NO: 10357 - RNA, 21 nt, Artificial Sequence
  Ebola virus siRNA sense strand
ucguuguuucaggguuaagaa

SEQ ID NO: 10358 - RNA, 21 nt, Artificial Sequence
  Ebola virus siRNA sense strand
cguuguuucaggguuaagaac

SEQ ID NO: 10359 - RNA, 21 nt, Artificial Sequence
  Ebola virus siRNA sense strand
guuguuucaggguuaagaaca

SEQ ID NO: 10360 - RNA, 21 nt, Artificial Sequence
  Ebola virus siRNA sense strand
uuguuucaggguuaagaacau

SEQ ID NO: 10361 - RNA, 21 nt, Artificial Sequence
  Ebola virus siRNA sense strand
uguuucaggguuaagaacauu

SEQ ID NO: 10362 - RNA, 21 nt, Artificial Sequence
  Ebola virus siRNA sense strand
guuucaggguuaagaacauug

SEQ ID NO: 10363 - RNA, 21 nt, Artificial Sequence
  Ebola virus siRNA sense strand
uuucaggguuaagaacauugg

SEQ ID NO: 10364 - RNA, 21 nt, Artificial Sequence
  Ebola virus siRNA sense strand
uucaggguuaagaacauuggu

SEQ ID NO: 10365 - RNA, 21 nt, Artificial Sequence
  Ebola virus siRNA sense strand
ucaggguuaagaacauugguu

SEQ ID NO: 10366 - RNA, 21 nt, Artificial Sequence
  Ebola virus siRNA sense strand
caggguuaagaacauugguuc

SEQ ID NO: 10367 - RNA, 21 nt, Artificial Sequence
  Ebola virus siRNA sense strand
aggguuaagaacauugguucc

SEQ ID NO: 10368 - RNA, 21 nt, Artificial Sequence
  Ebola virus siRNA sense strand
ggguuaagaacauugguuccu

SEQ ID NO: 10369 - RNA, 21 nt, Artificial Sequence
  Ebola virus siRNA sense strand
gguuaagaacauugguuccuc

SEQ ID NO: 10370 - RNA, 21 nt, Artificial Sequence
  Ebola virus siRNA sense strand
guuaagaacauugguuccuca

SEQ ID NO: 10371 - RNA, 21 nt, Artificial Sequence
  Ebola virus siRNA sense strand
uuaagaacauugguuccucaa

SEQ ID NO: 10372 - RNA, 21 nt, Artificial Sequence
  Ebola virus siRNA sense strand
uaagaacauugguuccucaau

SEQ ID NO: 10373 - RNA, 21 nt, Artificial Sequence
  Ebola virus siRNA sense strand
aagaacauugguuccucaauc

SEQ ID NO: 10374 - RNA, 21 nt, Artificial Sequence
  Ebola virus siRNA sense strand
agaacauugguuccucaauca

SEQ ID NO: 10375 - RNA, 21 nt, Artificial Sequence
  Ebola virus siRNA sense strand
gaacauugguuccucaaucag

SEQ ID NO: 10376 - RNA, 21 nt, Artificial Sequence
  Ebola virus siRNA sense strand
aacauugguuccucaaucaga

SEQ ID NO: 10377 - RNA, 21 nt, Artificial Sequence
  Ebola virus siRNA sense strand
acauugguuccucaaucagau

SEQ ID NO: 10378 - RNA, 21 nt, Artificial Sequence
  Ebola virus siRNA sense strand
cauugguuccucaaucagaua

SEQ ID NO: 10379 - RNA, 21 nt, Artificial Sequence
  Ebola virus siRNA sense strand
auugguuccucaaucagauaa

SEQ ID NO: 10380 - RNA, 21 nt, Artificial Sequence
  Ebola virus siRNA sense strand
uugguuccucaaucagauaau

SEQ ID NO: 10381 - RNA, 21 nt, Artificial Sequence
  Ebola virus siRNA sense strand
ugguuccucaaucagauaaug

SEQ ID NO: 10382 - RNA, 21 nt, Artificial Sequence
  Ebola virus siRNA sense strand
gguuccucaaucagauaauga

SEQ ID NO: 10383 - RNA, 21 nt, Artificial Sequence
  Ebola virus siRNA sense strand
guuccucaaucagauaaugag

SEQ ID NO: 10384 - RNA, 21 nt, Artificial Sequence
  Ebola virus siRNA sense strand
uuccucaaucagauaaugagg

SEQ ID NO: 10385 - RNA, 21 nt, Artificial Sequence
  Ebola virus siRNA sense strand
uccucaaucagauaaugagga

SEQ ID NO: 10386 - RNA, 21 nt, Artificial Sequence
  Ebola virus siRNA sense strand
ccucaaucagauaaugaggaa

SEQ ID NO: 10387 - RNA, 21 nt, Artificial Sequence
  Ebola virus siRNA sense strand
cucaaucagauaaugaggaag

SEQ ID NO: 10388 - RNA, 21 nt, Artificial Sequence
  Ebola virus siRNA sense strand
ucaaucagauaaugaggaagc

SEQ ID NO: 10389 - RNA, 21 nt, Artificial Sequence
  Ebola virus siRNA sense strand
caaucagauaaugaggaagcu

SEQ ID NO: 10390 - RNA, 21 nt, Artificial Sequence
  Ebola virus siRNA sense strand
aaucagauaaugaggaagcuu

SEQ ID NO: 10391 - RNA, 21 nt, Artificial Sequence
  Ebola virus siRNA sense strand
aucagauaaugaggaagcuuc

SEQ ID NO: 10392 - RNA, 21 nt, Artificial Sequence
  Ebola virus siRNA sense strand
ucagauaaugaggaagcuuca

SEQ ID NO: 10393 - RNA, 21 nt, Artificial Sequence
  Ebola virus siRNA sense strand
cagauaaugaggaagcuucaa

SEQ ID NO: 10394 - RNA, 21 nt, Artificial Sequence
  Ebola virus siRNA sense strand
agauaaugaggaagcuucaac

SEQ ID NO: 10395 - RNA, 21 nt, Artificial Sequence
  Ebola virus siRNA sense strand
gauaaugaggaagcuucaacc

SEQ ID NO: 10396 - RNA, 21 nt, Artificial Sequence
  Ebola virus siRNA sense strand
auaaugaggaagcuucaacca

SEQ ID NO: 10397 - RNA, 21 nt, Artificial Sequence
  Ebola virus siRNA sense strand
uaaugaggaagcuucaaccaa

SEQ ID NO: 10398 - RNA, 21 nt, Artificial Sequence
  Ebola virus siRNA sense strand
aaugaggaagcuucaaccaac

SEQ ID NO: 10399 - RNA, 21 nt, Artificial Sequence
  Ebola virus siRNA sense strand
augaggaagcuucaaccaacc

SEQ ID NO: 10400 - RNA, 21 nt, Artificial Sequence
  Ebola virus siRNA sense strand
ugaggaagcuucaaccaaccc

SEQ ID NO: 10401 - RNA, 21 nt, Artificial Sequence
  Ebola virus siRNA sense strand
gaggaagcuucaaccaacccg

SEQ ID NO: 10402 - RNA, 21 nt, Artificial Sequence
  Ebola virus siRNA sense strand
aggaagcuucaaccaacccgg

SEQ ID NO: 10403 - RNA, 21 nt, Artificial Sequence
  Ebola virus siRNA sense strand
ggaagcuucaaccaacccggg

SEQ ID NO: 10404 - RNA, 21 nt, Artificial Sequence
  Ebola virus siRNA sense strand
gaagcuucaaccaacccgggg

SEQ ID NO: 10405 - RNA, 21 nt, Artificial Sequence
  Ebola virus siRNA sense strand
aagcuucaaccaacccgggga

SEQ ID NO: 10406 - RNA, 21 nt, Artificial Sequence
  Ebola virus siRNA sense strand
agcuucaaccaacccggggac

SEQ ID NO: 10407 - RNA, 21 nt, Artificial Sequence
  Ebola virus siRNA sense strand
gcuucaaccaacccggggaca

SEQ ID NO: 10408 - RNA, 21 nt, Artificial Sequence
  Ebola virus siRNA sense strand
cuucaaccaacccggggacau

SEQ ID NO: 10409 - RNA, 21 nt, Artificial Sequence
  Ebola virus siRNA sense strand
uucaaccaacccggggacaug

SEQ ID NO: 10410 - RNA, 21 nt, Artificial Sequence
  Ebola virus siRNA sense strand
ucaaccaacccggggacaugc

SEQ ID NO: 10411 - RNA, 21 nt, Artificial Sequence
  Ebola virus siRNA sense strand
caaccaacccggggacaugcu

SEQ ID NO: 10412 - RNA, 21 nt, Artificial Sequence
  Ebola virus siRNA sense strand
aaccaacccggggacaugcuc

SEQ ID NO: 10413 - RNA, 21 nt, Artificial Sequence
  Ebola virus siRNA sense strand
accaacccggggacaugcuca

SEQ ID NO: 10414 - RNA, 21 nt, Artificial Sequence
  Ebola virus siRNA sense strand
ccaacccggggacaugcucau

SEQ ID NO: 10415 - RNA, 21 nt, Artificial Sequence
  Ebola virus siRNA sense strand
caacccggggacaugcucaug

SEQ ID NO: 10416 - RNA, 21 nt, Artificial Sequence
  Ebola virus siRNA sense strand
aacccggggacaugcucaugg

SEQ ID NO: 10417 - RNA, 21 nt, Artificial Sequence
  Ebola virus siRNA sense strand
acccggggacaugcucauggu

SEQ ID NO: 10418 - RNA, 21 nt, Artificial Sequence
  Ebola virus siRNA sense strand
cccggggacaugcucaugguc

SEQ ID NO: 10419 - RNA, 21 nt, Artificial Sequence
  Ebola virus siRNA sense strand
ccggggacaugcucauggucu

SEQ ID NO: 10420 - RNA, 21 nt, Artificial Sequence
  Ebola virus siRNA sense strand
cggggacaugcucauggucug

SEQ ID NO: 10421 - RNA, 21 nt, Artificial Sequence
  Ebola virus siRNA sense strand
ggggacaugcucauggucuga

SEQ ID NO: 10422 - RNA, 21 nt, Artificial Sequence
  Ebola virus siRNA sense strand
gggacaugcucauggucugau

SEQ ID NO: 10423 - RNA, 21 nt, Artificial Sequence
  Ebola virus siRNA sense strand
ggacaugcucauggucugaug

SEQ ID NO: 10424 - RNA, 21 nt, Artificial Sequence
  Ebola virus siRNA sense strand
gacaugcucauggucugauga

SEQ ID NO: 10425 - RNA, 21 nt, Artificial Sequence
  Ebola virus siRNA sense strand
acaugcucauggucugaugag

SEQ ID NO: 10426 - RNA, 21 nt, Artificial Sequence
  Ebola virus siRNA sense strand
caugcucauggucugaugagg

SEQ ID NO: 10427 - RNA, 21 nt, Artificial Sequence
  Ebola virus siRNA sense strand
augcucauggucugaugaggg

SEQ ID NO: 10428 - RNA, 21 nt, Artificial Sequence
  Ebola virus siRNA sense strand
ugcucauggucugaugagggu

SEQ ID NO: 10429 - RNA, 21 nt, Artificial Sequence
  Ebola virus siRNA sense strand
gcucauggucugaugagggua

SEQ ID NO: 10430 - RNA, 21 nt, Artificial Sequence
  Ebola virus siRNA sense strand
cucauggucugaugaggguac

SEQ ID NO: 10431 - RNA, 21 nt, Artificial Sequence
  Ebola virus siRNA sense strand
ucauggucugaugaggguacc

SEQ ID NO: 10432 - RNA, 21 nt, Artificial Sequence
  Ebola virus siRNA sense strand
cauggucugaugaggguaccc

SEQ ID NO: 10433 - RNA, 21 nt, Artificial Sequence
  Ebola virus siRNA sense strand
auggucugaugaggguacccc

SEQ ID NO: 10434 - RNA, 21 nt, Artificial Sequence
  Ebola virus siRNA sense strand
uggucugaugaggguaccccu

SEQ ID NO: 10435 - RNA, 21 nt, Artificial Sequence
  Ebola virus siRNA sense strand
ggucugaugaggguaccccuu

SEQ ID NO: 10436 - RNA, 21 nt, Artificial Sequence
  Ebola virus siRNA sense strand
gucugaugaggguaccccuua

SEQ ID NO: 10437 - RNA, 21 nt, Artificial Sequence
  Ebola virus siRNA sense strand
ucugaugaggguaccccuuaa

SEQ ID NO: 10438 - RNA, 21 nt, Artificial Sequence
  Ebola virus siRNA sense strand
cugaugaggguaccccuuaau

SEQ ID NO: 10439 - RNA, 21 nt, Artificial Sequence
  Ebola virus siRNA sense strand
ugaugaggguaccccuuaaua

SEQ ID NO: 10440 - RNA, 21 nt, Artificial Sequence
  Ebola virus siRNA sense strand
gaugaggguaccccuuaauaa

SEQ ID NO: 10441 - RNA, 21 nt, Artificial Sequence
  Ebola virus siRNA sense strand
augaggguaccccuuaauaag

SEQ ID NO: 10442 - RNA, 21 nt, Artificial Sequence
  Ebola virus siRNA sense strand
ugaggguaccccuuaauaagg

SEQ ID NO: 10443 - RNA, 21 nt, Artificial Sequence
  Ebola virus siRNA sense strand
gaggguaccccuuaauaaggc

SEQ ID NO: 10444 - RNA, 21 nt, Artificial Sequence
  Ebola virus siRNA sense strand
aggguaccccuuaauaaggcu

SEQ ID NO: 10445 - RNA, 21 nt, Artificial Sequence
  Ebola virus siRNA sense strand
ggguaccccuuaauaaggcug

SEQ ID NO: 10446 - RNA, 21 nt, Artificial Sequence
  Ebola virus siRNA sense strand
gguaccccuuaauaaggcuga

SEQ ID NO: 10447 - RNA, 21 nt, Artificial Sequence
  Ebola virus siRNA sense strand
guaccccuuaauaaggcugac

SEQ ID NO: 10448 - RNA, 21 nt, Artificial Sequence
  Ebola virus siRNA sense strand
uaccccuuaauaaggcugacu

SEQ ID NO: 10449 - RNA, 21 nt, Artificial Sequence
  Ebola virus siRNA sense strand
accccuuaauaaggcugacua

SEQ ID NO: 10450 - RNA, 21 nt, Artificial Sequence
  Ebola virus siRNA sense strand
ccccuuaauaaggcugacuaa

SEQ ID NO: 10451 - RNA, 21 nt, Artificial Sequence
  Ebola virus siRNA sense strand
cccuuaauaaggcugacuaaa

SEQ ID NO: 10452 - RNA, 21 nt, Artificial Sequence
  Ebola virus siRNA sense strand
ccuuaauaaggcugacuaaaa

SEQ ID NO: 10453 - RNA, 21 nt, Artificial Sequence
  Ebola virus siRNA sense strand
cuuaauaaggcugacuaaaac

SEQ ID NO: 10454 - RNA, 21 nt, Artificial Sequence
  Ebola virus siRNA sense strand
uuaauaaggcugacuaaaaca

SEQ ID NO: 10455 - RNA, 21 nt, Artificial Sequence
  Ebola virus siRNA sense strand
uaauaaggcugacuaaaacac

SEQ ID NO: 10456 - RNA, 21 nt, Artificial Sequence
  Ebola virus siRNA sense strand
aauaaggcugacuaaaacacu

SEQ ID NO: 10457 - RNA, 21 nt, Artificial Sequence
  Ebola virus siRNA sense strand
auaaggcugacuaaaacacua

SEQ ID NO: 10458 - RNA, 21 nt, Artificial Sequence
  Ebola virus siRNA sense strand
uaaggcugacuaaaacacuau

SEQ ID NO: 10459 - RNA, 21 nt, Artificial Sequence
  Ebola virus siRNA sense strand
aaggcugacuaaaacacuaua

SEQ ID NO: 10460 - RNA, 21 nt, Artificial Sequence
  Ebola virus siRNA sense strand
aggcugacuaaaacacuauau

SEQ ID NO: 10461 - RNA, 21 nt, Artificial Sequence
  Ebola virus siRNA sense strand
ggcugacuaaaacacuauaua

SEQ ID NO: 10462 - RNA, 21 nt, Artificial Sequence
  Ebola virus siRNA sense strand
gcugacuaaaacacuauauaa

SEQ ID NO: 10463 - RNA, 21 nt, Artificial Sequence
  Ebola virus siRNA sense strand
cugacuaaaacacuauauaac

SEQ ID NO: 10464 - RNA, 21 nt, Artificial Sequence
  Ebola virus siRNA sense strand
ugacuaaaacacuauauaacc

SEQ ID NO: 10465 - RNA, 21 nt, Artificial Sequence
  Ebola virus siRNA sense strand
gacuaaaacacuauauaaccu

SEQ ID NO: 10466 - RNA, 21 nt, Artificial Sequence
  Ebola virus siRNA sense strand
acuaaaacacuauauaaccuu

SEQ ID NO: 10467 - RNA, 21 nt, Artificial Sequence
  Ebola virus siRNA sense strand
cuaaaacacuauauaaccuuc

SEQ ID NO: 10468 - RNA, 21 nt, Artificial Sequence
  Ebola virus siRNA sense strand
uaaaacacuauauaaccuucu

SEQ ID NO: 10469 - RNA, 21 nt, Artificial Sequence
  Ebola virus siRNA sense strand
aaaacacuauauaaccuucua

SEQ ID NO: 10470 - RNA, 21 nt, Artificial Sequence
  Ebola virus siRNA sense strand
aaacacuauauaaccuucuac

SEQ ID NO: 10471 - RNA, 21 nt, Artificial Sequence
  Ebola virus siRNA sense strand
aacacuauauaaccuucuacu

SEQ ID NO: 10472 - RNA, 21 nt, Artificial Sequence
  Ebola virus siRNA sense strand
acacuauauaaccuucuacuu

SEQ ID NO: 10473 - RNA, 21 nt, Artificial Sequence
  Ebola virus siRNA sense strand
cacuauauaaccuucuacuug

SEQ ID NO: 10474 - RNA, 21 nt, Artificial Sequence
  Ebola virus siRNA sense strand
acuauauaaccuucuacuuga

SEQ ID NO: 10475 - RNA, 21 nt, Artificial Sequence
  Ebola virus siRNA sense strand
cuauauaaccuucuacuugau

SEQ ID NO: 10476 - RNA, 21 nt, Artificial Sequence
  Ebola virus siRNA sense strand
uauauaaccuucuacuugauc

SEQ ID NO: 10477 - RNA, 21 nt, Artificial Sequence
  Ebola virus siRNA sense strand
auauaaccuucuacuugauca

SEQ ID NO: 10478 - RNA, 21 nt, Artificial Sequence
  Ebola virus siRNA sense strand
uauaaccuucuacuugaucac

SEQ ID NO: 10479 - RNA, 21 nt, Artificial Sequence
  Ebola virus siRNA sense strand
auaaccuucuacuugaucaca

SEQ ID NO: 10480 - RNA, 21 nt, Artificial Sequence
  Ebola virus siRNA sense strand
uaaccuucuacuugaucacaa

SEQ ID NO: 10481 - RNA, 21 nt, Artificial Sequence
  Ebola virus siRNA sense strand
aaccuucuacuugaucacaau

SEQ ID NO: 10482 - RNA, 21 nt, Artificial Sequence
  Ebola virus siRNA sense strand
accuucuacuugaucacaaua

SEQ ID NO: 10483 - RNA, 21 nt, Artificial Sequence
  Ebola virus siRNA sense strand
ccuucuacuugaucacaauac

SEQ ID NO: 10484 - RNA, 21 nt, Artificial Sequence
  Ebola virus siRNA sense strand
cuucuacuugaucacaauacu

SEQ ID NO: 10485 - RNA, 21 nt, Artificial Sequence
  Ebola virus siRNA sense strand
uucuacuugaucacaauacuc

SEQ ID NO: 10486 - RNA, 21 nt, Artificial Sequence
  Ebola virus siRNA sense strand
ucuacuugaucacaauacucc

SEQ ID NO: 10487 - RNA, 21 nt, Artificial Sequence
  Ebola virus siRNA sense strand
cuacuugaucacaauacuccg

SEQ ID NO: 10488 - RNA, 21 nt, Artificial Sequence
  Ebola virus siRNA sense strand
uacuugaucacaauacuccgu

SEQ ID NO: 10489 - RNA, 21 nt, Artificial Sequence
  Ebola virus siRNA sense strand
acuugaucacaauacuccgua

SEQ ID NO: 10490 - RNA, 21 nt, Artificial Sequence
  Ebola virus siRNA sense strand
cuugaucacaauacuccguau

SEQ ID NO: 10491 - RNA, 21 nt, Artificial Sequence
  Ebola virus siRNA sense strand
uugaucacaauacuccguaua

SEQ ID NO: 10492 - RNA, 21 nt, Artificial Sequence
  Ebola virus siRNA sense strand
ugaucacaauacuccguauac

SEQ ID NO: 10493 - RNA, 21 nt, Artificial Sequence
  Ebola virus siRNA sense strand
gaucacaauacuccguauacc

SEQ ID NO: 10494 - RNA, 21 nt, Artificial Sequence
  Ebola virus siRNA sense strand
aucacaauacuccguauaccu

SEQ ID NO: 10495 - RNA, 21 nt, Artificial Sequence
  Ebola virus siRNA sense strand
ucacaauacuccguauaccua

SEQ ID NO: 10496 - RNA, 21 nt, Artificial Sequence
  Ebola virus siRNA sense strand
cacaauacuccguauaccuau

SEQ ID NO: 10497 - RNA, 21 nt, Artificial Sequence
  Ebola virus siRNA sense strand
acaauacuccguauaccuauc

SEQ ID NO: 10498 - RNA, 21 nt, Artificial Sequence
  Ebola virus siRNA sense strand
caauacuccguauaccuauca

SEQ ID NO: 10499 - RNA, 21 nt, Artificial Sequence
  Ebola virus siRNA sense strand
aauacuccguauaccuaucau

SEQ ID NO: 10500 - RNA, 21 nt, Artificial Sequence
  Ebola virus siRNA sense strand
auacuccguauaccuaucauc

SEQ ID NO: 10501 - RNA, 21 nt, Artificial Sequence
  Ebola virus siRNA sense strand
uacuccguauaccuaucauca

SEQ ID NO: 10502 - RNA, 21 nt, Artificial Sequence
  Ebola virus siRNA sense strand
acuccguauaccuaucaucau

SEQ ID NO: 10503 - RNA, 21 nt, Artificial Sequence
  Ebola virus siRNA sense strand
cuccguauaccuaucaucaua

SEQ ID NO: 10504 - RNA, 21 nt, Artificial Sequence
  Ebola virus siRNA sense strand
uccguauaccuaucaucauau

SEQ ID NO: 10505 - RNA, 21 nt, Artificial Sequence
  Ebola virus siRNA sense strand
ccguauaccuaucaucauaua

SEQ ID NO: 10506 - RNA, 21 nt, Artificial Sequence
  Ebola virus siRNA sense strand
cguauaccuaucaucauauau

SEQ ID NO: 10507 - RNA, 21 nt, Artificial Sequence
  Ebola virus siRNA sense strand
guauaccuaucaucauauauu

SEQ ID NO: 10508 - RNA, 21 nt, Artificial Sequence
  Ebola virus siRNA sense strand
uauaccuaucaucauauauuu

SEQ ID NO: 10509 - RNA, 21 nt, Artificial Sequence
  Ebola virus siRNA sense strand
auaccuaucaucauauauuua

SEQ ID NO: 10510 - RNA, 21 nt, Artificial Sequence
  Ebola virus siRNA sense strand
uaccuaucaucauauauuuaa

SEQ ID NO: 10511 - RNA, 21 nt, Artificial Sequence
  Ebola virus siRNA sense strand
accuaucaucauauauuuaau

SEQ ID NO: 10512 - RNA, 21 nt, Artificial Sequence
  Ebola virus siRNA sense strand
ccuaucaucauauauuuaauc

SEQ ID NO: 10513 - RNA, 21 nt, Artificial Sequence
  Ebola virus siRNA sense strand
cuaucaucauauauuuaauca

SEQ ID NO: 10514 - RNA, 21 nt, Artificial Sequence
  Ebola virus siRNA sense strand
uaucaucauauauuuaaucaa

SEQ ID NO: 10515 - RNA, 21 nt, Artificial Sequence
  Ebola virus siRNA sense strand
aucaucauauauuuaaucaag

SEQ ID NO: 10516 - RNA, 21 nt, Artificial Sequence
  Ebola virus siRNA sense strand
ucaucauauauuuaaucaaga

SEQ ID NO: 10517 - RNA, 21 nt, Artificial Sequence
  Ebola virus siRNA sense strand
caucauauauuuaaucaagac

SEQ ID NO: 10518 - RNA, 21 nt, Artificial Sequence
  Ebola virus siRNA sense strand
aucauauauuuaaucaagacg

SEQ ID NO: 10519 - RNA, 21 nt, Artificial Sequence
  Ebola virus siRNA sense strand
ucauauauuuaaucaagacga

SEQ ID NO: 10520 - RNA, 21 nt, Artificial Sequence
  Ebola virus siRNA sense strand
cauauauuuaaucaagacgau

SEQ ID NO: 10521 - RNA, 21 nt, Artificial Sequence
  Ebola virus siRNA sense strand
auauauuuaaucaagacgaua

SEQ ID NO: 10522 - RNA, 21 nt, Artificial Sequence
  Ebola virus siRNA sense strand
uauauuuaaucaagacgauau

SEQ ID NO: 10523 - RNA, 21 nt, Artificial Sequence
  Ebola virus siRNA sense strand
auauuuaaucaagacgauauc

SEQ ID NO: 10524 - RNA, 21 nt, Artificial Sequence
  Ebola virus siRNA sense strand
uauuuaaucaagacgauaucc

SEQ ID NO: 10525 - RNA, 21 nt, Artificial Sequence
  Ebola virus siRNA sense strand
auuuaaucaagacgauauccu

SEQ ID NO: 10526 - RNA, 21 nt, Artificial Sequence
  Ebola virus siRNA sense strand
uuuaaucaagacgauauccuu

SEQ ID NO: 10527 - RNA, 21 nt, Artificial Sequence
  Ebola virus siRNA sense strand
uuaaucaagacgauauccuuu

SEQ ID NO: 10528 - RNA, 21 nt, Artificial Sequence
  Ebola virus siRNA sense strand
uaaucaagacgauauccuuua

SEQ ID NO: 10529 - RNA, 21 nt, Artificial Sequence
  Ebola virus siRNA sense strand
aaucaagacgauauccuuuaa

SEQ ID NO: 10530 - RNA, 21 nt, Artificial Sequence
  Ebola virus siRNA sense strand
aucaagacgauauccuuuaaa

SEQ ID NO: 10531 - RNA, 21 nt, Artificial Sequence
  Ebola virus siRNA sense strand
ucaagacgauauccuuuaaaa

SEQ ID NO: 10532 - RNA, 21 nt, Artificial Sequence
  Ebola virus siRNA sense strand
caagacgauauccuuuaaaac

SEQ ID NO: 10533 - RNA, 21 nt, Artificial Sequence
  Ebola virus siRNA sense strand
aagacgauauccuuuaaaacu

SEQ ID NO: 10534 - RNA, 21 nt, Artificial Sequence
  Ebola virus siRNA sense strand
agacgauauccuuuaaaacuu

SEQ ID NO: 10535 - RNA, 21 nt, Artificial Sequence
  Ebola virus siRNA sense strand
gacgauauccuuuaaaacuua

SEQ ID NO: 10536 - RNA, 21 nt, Artificial Sequence
  Ebola virus siRNA sense strand
acgauauccuuuaaaacuuau

SEQ ID NO: 10537 - RNA, 21 nt, Artificial Sequence
  Ebola virus siRNA sense strand
cgauauccuuuaaaacuuauu

SEQ ID NO: 10538 - RNA, 21 nt, Artificial Sequence
  Ebola virus siRNA sense strand
gauauccuuuaaaacuuauuc

SEQ ID NO: 10539 - RNA, 21 nt, Artificial Sequence
  Ebola virus siRNA sense strand
auauccuuuaaaacuuauuca

SEQ ID NO: 10540 - RNA, 21 nt, Artificial Sequence
  Ebola virus siRNA sense strand
uauccuuuaaaacuuauucag

SEQ ID NO: 10541 - RNA, 21 nt, Artificial Sequence
  Ebola virus siRNA sense strand
auccuuuaaaacuuauucagu

SEQ ID NO: 10542 - RNA, 21 nt, Artificial Sequence
  Ebola virus siRNA sense strand
uccuuuaaaacuuauucagua

SEQ ID NO: 10543 - RNA, 21 nt, Artificial Sequence
  Ebola virus siRNA sense strand
ccuuuaaaacuuauucaguac

SEQ ID NO: 10544 - RNA, 21 nt, Artificial Sequence
  Ebola virus siRNA sense strand
cuuuaaaacuuauucaguacu

SEQ ID NO: 10545 - RNA, 21 nt, Artificial Sequence
  Ebola virus siRNA sense strand
uuuaaaacuuauucaguacua

SEQ ID NO: 10546 - RNA, 21 nt, Artificial Sequence
  Ebola virus siRNA sense strand
uuaaaacuuauucaguacuau

SEQ ID NO: 10547 - RNA, 21 nt, Artificial Sequence
  Ebola virus siRNA sense strand
uaaaacuuauucaguacuaua

SEQ ID NO: 10548 - RNA, 21 nt, Artificial Sequence
  Ebola virus siRNA sense strand
aaaacuuauucaguacuauaa

SEQ ID NO: 10549 - RNA, 21 nt, Artificial Sequence
  Ebola virus siRNA sense strand
aaacuuauucaguacuauaau

SEQ ID NO: 10550 - RNA, 21 nt, Artificial Sequence
  Ebola virus siRNA sense strand
aacuuauucaguacuauaauc

SEQ ID NO: 10551 - RNA, 21 nt, Artificial Sequence
  Ebola virus siRNA sense strand
acuuauucaguacuauaauca

SEQ ID NO: 10552 - RNA, 21 nt, Artificial Sequence
  Ebola virus siRNA sense strand
cuuauucaguacuauaaucac

SEQ ID NO: 10553 - RNA, 21 nt, Artificial Sequence
  Ebola virus siRNA sense strand
uuauucaguacuauaaucacu

SEQ ID NO: 10554 - RNA, 21 nt, Artificial Sequence
  Ebola virus siRNA sense strand
uauucaguacuauaaucacuc

SEQ ID NO: 10555 - RNA, 21 nt, Artificial Sequence
  Ebola virus siRNA sense strand
auucaguacuauaaucacucu

SEQ ID NO: 10556 - RNA, 21 nt, Artificial Sequence
  Ebola virus siRNA sense strand
uucaguacuauaaucacucuc

SEQ ID NO: 10557 - RNA, 21 nt, Artificial Sequence
  Ebola virus siRNA sense strand
ucaguacuauaaucacucucg

SEQ ID NO: 10558 - RNA, 21 nt, Artificial Sequence
  Ebola virus siRNA sense strand
caguacuauaaucacucucgu

SEQ ID NO: 10559 - RNA, 21 nt, Artificial Sequence
  Ebola virus siRNA sense strand
aguacuauaaucacucucguu

SEQ ID NO: 10560 - RNA, 21 nt, Artificial Sequence
  Ebola virus siRNA sense strand
guacuauaaucacucucguuu

SEQ ID NO: 10561 - RNA, 21 nt, Artificial Sequence
  Ebola virus siRNA sense strand
uacuauaaucacucucguuuc

SEQ ID NO: 10562 - RNA, 21 nt, Artificial Sequence
  Ebola virus siRNA sense strand
acuauaaucacucucguuuca

SEQ ID NO: 10563 - RNA, 21 nt, Artificial Sequence
  Ebola virus siRNA sense strand
cuauaaucacucucguuucaa

SEQ ID NO: 10564 - RNA, 21 nt, Artificial Sequence
  Ebola virus siRNA sense strand
uauaaucacucucguuucaaa

SEQ ID NO: 10565 - RNA, 21 nt, Artificial Sequence
  Ebola virus siRNA sense strand
auaaucacucucguuucaaau

SEQ ID NO: 10566 - RNA, 21 nt, Artificial Sequence
  Ebola virus siRNA sense strand
uaaucacucucguuucaaauu

SEQ ID NO: 10567 - RNA, 21 nt, Artificial Sequence
  Ebola virus siRNA sense strand
aaucacucucguuucaaauua

SEQ ID NO: 10568 - RNA, 21 nt, Artificial Sequence
  Ebola virus siRNA sense strand
aucacucucguuucaaauuaa

SEQ ID NO: 10569 - RNA, 21 nt, Artificial Sequence
  Ebola virus siRNA sense strand
ucacucucguuucaaauuaau

SEQ ID NO: 10570 - RNA, 21 nt, Artificial Sequence
  Ebola virus siRNA sense strand
cacucucguuucaaauuaaua

SEQ ID NO: 10571 - RNA, 21 nt, Artificial Sequence
  Ebola virus siRNA sense strand
acucucguuucaaauuaauaa

SEQ ID NO: 10572 - RNA, 21 nt, Artificial Sequence
  Ebola virus siRNA sense strand
cucucguuucaaauuaauaag

SEQ ID NO: 10573 - RNA, 21 nt, Artificial Sequence
  Ebola virus siRNA sense strand
ucucguuucaaauuaauaaga

SEQ ID NO: 10574 - RNA, 21 nt, Artificial Sequence
  Ebola virus siRNA sense strand
cucguuucaaauuaauaagau

SEQ ID NO: 10575 - RNA, 21 nt, Artificial Sequence
  Ebola virus siRNA sense strand
ucguuucaaauuaauaagaug

SEQ ID NO: 10576 - RNA, 21 nt, Artificial Sequence
  Ebola virus siRNA sense strand
cguuucaaauuaauaagaugu

SEQ ID NO: 10577 - RNA, 21 nt, Artificial Sequence
  Ebola virus siRNA sense strand
guuucaaauuaauaagaugug

SEQ ID NO: 10578 - RNA, 21 nt, Artificial Sequence
  Ebola virus siRNA sense strand
uuucaaauuaauaagaugugc

SEQ ID NO: 10579 - RNA, 21 nt, Artificial Sequence
  Ebola virus siRNA sense strand
uucaaauuaauaagaugugca

SEQ ID NO: 10580 - RNA, 21 nt, Artificial Sequence
  Ebola virus siRNA sense strand
ucaaauuaauaagaugugcau

SEQ ID NO: 10581 - RNA, 21 nt, Artificial Sequence
  Ebola virus siRNA sense strand
caaauuaauaagaugugcaug

SEQ ID NO: 10582 - RNA, 21 nt, Artificial Sequence
  Ebola virus siRNA sense strand
aaauuaauaagaugugcauga

SEQ ID NO: 10583 - RNA, 21 nt, Artificial Sequence
  Ebola virus siRNA sense strand
aauuaauaagaugugcaugau

SEQ ID NO: 10584 - RNA, 21 nt, Artificial Sequence
  Ebola virus siRNA sense strand
auuaauaagaugugcaugauu

SEQ ID NO: 10585 - RNA, 21 nt, Artificial Sequence
  Ebola virus siRNA sense strand
uuaauaagaugugcaugauug

SEQ ID NO: 10586 - RNA, 21 nt, Artificial Sequence
  Ebola virus siRNA sense strand
uaauaagaugugcaugauugc

SEQ ID NO: 10587 - RNA, 21 nt, Artificial Sequence
  Ebola virus siRNA sense strand
aauaagaugugcaugauugcc

SEQ ID NO: 10588 - RNA, 21 nt, Artificial Sequence
  Ebola virus siRNA sense strand
auaagaugugcaugauugccc

SEQ ID NO: 10589 - RNA, 21 nt, Artificial Sequence
  Ebola virus siRNA sense strand
uaagaugugcaugauugcccu

SEQ ID NO: 10590 - RNA, 21 nt, Artificial Sequence
  Ebola virus siRNA sense strand
aagaugugcaugauugcccua

SEQ ID NO: 10591 - RNA, 21 nt, Artificial Sequence
  Ebola virus siRNA sense strand
agaugugcaugauugcccuaa

SEQ ID NO: 10592 - RNA, 21 nt, Artificial Sequence
  Ebola virus siRNA sense strand
gaugugcaugauugcccuaau

SEQ ID NO: 10593 - RNA, 21 nt, Artificial Sequence
  Ebola virus siRNA sense strand
augugcaugauugcccuaaua

SEQ ID NO: 10594 - RNA, 21 nt, Artificial Sequence
  Ebola virus siRNA sense strand
ugugcaugauugcccuaauau

SEQ ID NO: 10595 - RNA, 21 nt, Artificial Sequence
  Ebola virus siRNA sense strand
gugcaugauugcccuaauaua

SEQ ID NO: 10596 - RNA, 21 nt, Artificial Sequence
  Ebola virus siRNA sense strand
ugcaugauugcccuaauauau

SEQ ID NO: 10597 - RNA, 21 nt, Artificial Sequence
  Ebola virus siRNA sense strand
gcaugauugcccuaauauaug

SEQ ID NO: 10598 - RNA, 21 nt, Artificial Sequence
  Ebola virus siRNA sense strand
caugauugcccuaauauauga

SEQ ID NO: 10599 - RNA, 21 nt, Artificial Sequence
  Ebola virus siRNA sense strand
augauugcccuaauauaugaa

SEQ ID NO: 10600 - RNA, 21 nt, Artificial Sequence
  Ebola virus siRNA sense strand
ugauugcccuaauauaugaag

SEQ ID NO: 10601 - RNA, 21 nt, Artificial Sequence
  Ebola virus siRNA sense strand
gauugcccuaauauaugaaga

SEQ ID NO: 10602 - RNA, 21 nt, Artificial Sequence
  Ebola virus siRNA sense strand
auugcccuaauauaugaagag

SEQ ID NO: 10603 - RNA, 21 nt, Artificial Sequence
  Ebola virus siRNA sense strand
uugcccuaauauaugaagagg

SEQ ID NO: 10604 - RNA, 21 nt, Artificial Sequence
  Ebola virus siRNA sense strand
ugcccuaauauaugaagaggu

SEQ ID NO: 10605 - RNA, 21 nt, Artificial Sequence
  Ebola virus siRNA sense strand
gcccuaauauaugaagaggua

SEQ ID NO: 10606 - RNA, 21 nt, Artificial Sequence
  Ebola virus siRNA sense strand
cccuaauauaugaagagguau

SEQ ID NO: 10607 - RNA, 21 nt, Artificial Sequence
  Ebola virus siRNA sense strand
ccuaauauaugaagagguaug

SEQ ID NO: 10608 - RNA, 21 nt, Artificial Sequence
  Ebola virus siRNA sense strand
cuaauauaugaagagguauga

SEQ ID NO: 10609 - RNA, 21 nt, Artificial Sequence
  Ebola virus siRNA sense strand
uaauauaugaagagguaugau

SEQ ID NO: 10610 - RNA, 21 nt, Artificial Sequence
  Ebola virus siRNA sense strand
aauauaugaagagguaugaua

SEQ ID NO: 10611 - RNA, 21 nt, Artificial Sequence
  Ebola virus siRNA sense strand
auauaugaagagguaugauac

SEQ ID NO: 10612 - RNA, 21 nt, Artificial Sequence
  Ebola virus siRNA sense strand
uauaugaagagguaugauaca

SEQ ID NO: 10613 - RNA, 21 nt, Artificial Sequence
  Ebola virus siRNA sense strand
auaugaagagguaugauacaa

SEQ ID NO: 10614 - RNA, 21 nt, Artificial Sequence
  Ebola virus siRNA sense strand
uaugaagagguaugauacaac

SEQ ID NO: 10615 - RNA, 21 nt, Artificial Sequence
  Ebola virus siRNA sense strand
augaagagguaugauacaacc

SEQ ID NO: 10616 - RNA, 21 nt, Artificial Sequence
  Ebola virus siRNA sense strand
ugaagagguaugauacaaccc

SEQ ID NO: 10617 - RNA, 21 nt, Artificial Sequence
  Ebola virus siRNA sense strand
gaagagguaugauacaacccu

SEQ ID NO: 10618 - RNA, 21 nt, Artificial Sequence
  Ebola virus siRNA sense strand
aagagguaugauacaacccua

SEQ ID NO: 10619 - RNA, 21 nt, Artificial Sequence
  Ebola virus siRNA sense strand
agagguaugauacaacccuaa

SEQ ID NO: 10620 - RNA, 21 nt, Artificial Sequence
  Ebola virus siRNA sense strand
gagguaugauacaacccuaac

SEQ ID NO: 10621 - RNA, 21 nt, Artificial Sequence
  Ebola virus siRNA sense strand
agguaugauacaacccuaaca

SEQ ID NO: 10622 - RNA, 21 nt, Artificial Sequence
  Ebola virus siRNA sense strand
gguaugauacaacccuaacag

SEQ ID NO: 10623 - RNA, 21 nt, Artificial Sequence
  Ebola virus siRNA sense strand
guaugauacaacccuaacagu

SEQ ID NO: 10624 - RNA, 21 nt, Artificial Sequence
  Ebola virus siRNA sense strand
uaugauacaacccuaacagug

SEQ ID NO: 10625 - RNA, 21 nt, Artificial Sequence
  Ebola virus siRNA sense strand
augauacaacccuaacaguga

SEQ ID NO: 10626 - RNA, 21 nt, Artificial Sequence
  Ebola virus siRNA sense strand
ugauacaacccuaacagugau

SEQ ID NO: 10627 - RNA, 21 nt, Artificial Sequence
  Ebola virus siRNA sense strand
gauacaacccuaacagugauc

SEQ ID NO: 10628 - RNA, 21 nt, Artificial Sequence
  Ebola virus siRNA sense strand
auacaacccuaacagugauca

SEQ ID NO: 10629 - RNA, 21 nt, Artificial Sequence
  Ebola virus siRNA sense strand
uacaacccuaacagugaucaa

SEQ ID NO: 10630 - RNA, 21 nt, Artificial Sequence
  Ebola virus siRNA sense strand
acaacccuaacagugaucaaa

SEQ ID NO: 10631 - RNA, 21 nt, Artificial Sequence
  Ebola virus siRNA sense strand
caacccuaacagugaucaaag

SEQ ID NO: 10632 - RNA, 21 nt, Artificial Sequence
  Ebola virus siRNA sense strand
aacccuaacagugaucaaaga

SEQ ID NO: 10633 - RNA, 21 nt, Artificial Sequence
  Ebola virus siRNA sense strand
acccuaacagugaucaaagaa

SEQ ID NO: 10634 - RNA, 21 nt, Artificial Sequence
  Ebola virus siRNA sense strand
cccuaacagugaucaaagaaa

SEQ ID NO: 10635 - RNA, 21 nt, Artificial Sequence
  Ebola virus siRNA sense strand
ccuaacagugaucaaagaaaa

SEQ ID NO: 10636 - RNA, 21 nt, Artificial Sequence
  Ebola virus siRNA sense strand
cuaacagugaucaaagaaaau

SEQ ID NO: 10637 - RNA, 21 nt, Artificial Sequence
  Ebola virus siRNA sense strand
uaacagugaucaaagaaaauc

SEQ ID NO: 10638 - RNA, 21 nt, Artificial Sequence
  Ebola virus siRNA sense strand
aacagugaucaaagaaaauca

SEQ ID NO: 10639 - RNA, 21 nt, Artificial Sequence
  Ebola virus siRNA sense strand
acagugaucaaagaaaaucau

SEQ ID NO: 10640 - RNA, 21 nt, Artificial Sequence
  Ebola virus siRNA sense strand
cagugaucaaagaaaaucaua

SEQ ID NO: 10641 - RNA, 21 nt, Artificial Sequence
  Ebola virus siRNA sense strand
agugaucaaagaaaaucauaa

SEQ ID NO: 10642 - RNA, 21 nt, Artificial Sequence
  Ebola virus siRNA sense strand
gugaucaaagaaaaucauaau

SEQ ID NO: 10643 - RNA, 21 nt, Artificial Sequence
  Ebola virus siRNA sense strand
ugaucaaagaaaaucauaauc

SEQ ID NO: 10644 - RNA, 21 nt, Artificial Sequence
  Ebola virus siRNA sense strand
gaucaaagaaaaucauaaucu

SEQ ID NO: 10645 - RNA, 21 nt, Artificial Sequence
  Ebola virus siRNA sense strand
aucaaagaaaaucauaaucuc

SEQ ID NO: 10646 - RNA, 21 nt, Artificial Sequence
  Ebola virus siRNA sense strand
ucaaagaaaaucauaaucucg

SEQ ID NO: 10647 - RNA, 21 nt, Artificial Sequence
  Ebola virus siRNA sense strand
caaagaaaaucauaaucucgu

SEQ ID NO: 10648 - RNA, 21 nt, Artificial Sequence
  Ebola virus siRNA sense strand
aaagaaaaucauaaucucgua

SEQ ID NO: 10649 - RNA, 21 nt, Artificial Sequence
  Ebola virus siRNA sense strand
aagaaaaucauaaucucguau

SEQ ID NO: 10650 - RNA, 21 nt, Artificial Sequence
  Ebola virus siRNA sense strand
agaaaaucauaaucucguauc

SEQ ID NO: 10651 - RNA, 21 nt, Artificial Sequence
  Ebola virus siRNA sense strand
gaaaaucauaaucucguaucg

SEQ ID NO: 10652 - RNA, 21 nt, Artificial Sequence
  Ebola virus siRNA sense strand
aaaaucauaaucucguaucgc

SEQ ID NO: 10653 - RNA, 21 nt, Artificial Sequence
  Ebola virus siRNA sense strand
aaaucauaaucucguaucgcu

SEQ ID NO: 10654 - RNA, 21 nt, Artificial Sequence
  Ebola virus siRNA sense strand
aaucauaaucucguaucgcuc

SEQ ID NO: 10655 - RNA, 21 nt, Artificial Sequence
  Ebola virus siRNA sense strand
aucauaaucucguaucgcucg

SEQ ID NO: 10656 - RNA, 21 nt, Artificial Sequence
  Ebola virus siRNA sense strand
ucauaaucucguaucgcucgu

SEQ ID NO: 10657 - RNA, 21 nt, Artificial Sequence
  Ebola virus siRNA sense strand
cauaaucucguaucgcucgua

SEQ ID NO: 10658 - RNA, 21 nt, Artificial Sequence
  Ebola virus siRNA sense strand
auaaucucguaucgcucguaa

SEQ ID NO: 10659 - RNA, 21 nt, Artificial Sequence
  Ebola virus siRNA sense strand
uaaucucguaucgcucguaau

SEQ ID NO: 10660 - RNA, 21 nt, Artificial Sequence
  Ebola virus siRNA sense strand
aaucucguaucgcucguaaua

SEQ ID NO: 10661 - RNA, 21 nt, Artificial Sequence
  Ebola virus siRNA sense strand
aucucguaucgcucguaauau

SEQ ID NO: 10662 - RNA, 21 nt, Artificial Sequence
  Ebola virus siRNA sense strand
ucucguaucgcucguaauaua

SEQ ID NO: 10663 - RNA, 21 nt, Artificial Sequence
  Ebola virus siRNA sense strand
cucguaucgcucguaauauaa

SEQ ID NO: 10664 - RNA, 21 nt, Artificial Sequence
  Ebola virus siRNA sense strand
ucguaucgcucguaauauaac

SEQ ID NO: 10665 - RNA, 21 nt, Artificial Sequence
  Ebola virus siRNA sense strand
cguaucgcucguaauauaacc

SEQ ID NO: 10666 - RNA, 21 nt, Artificial Sequence
  Ebola virus siRNA sense strand
guaucgcucguaauauaaccu

SEQ ID NO: 10667 - RNA, 21 nt, Artificial Sequence
  Ebola virus siRNA sense strand
uaucgcucguaauauaaccug

SEQ ID NO: 10668 - RNA, 21 nt, Artificial Sequence
  Ebola virus siRNA sense strand
aucgcucguaauauaaccugc

SEQ ID NO: 10669 - RNA, 21 nt, Artificial Sequence
  Ebola virus siRNA sense strand
ucgcucguaauauaaccugcc

SEQ ID NO: 10670 - RNA, 21 nt, Artificial Sequence
  Ebola virus siRNA sense strand
cgcucguaauauaaccugcca

SEQ ID NO: 10671 - RNA, 21 nt, Artificial Sequence
  Ebola virus siRNA sense strand
gcucguaauauaaccugccaa

SEQ ID NO: 10672 - RNA, 21 nt, Artificial Sequence
  Ebola virus siRNA sense strand
cucguaauauaaccugccaag

SEQ ID NO: 10673 - RNA, 21 nt, Artificial Sequence
  Ebola virus siRNA sense strand
ucguaauauaaccugccaagc

SEQ ID NO: 10674 - RNA, 21 nt, Artificial Sequence
  Ebola virus siRNA sense strand
cguaauauaaccugccaagca

SEQ ID NO: 10675 - RNA, 21 nt, Artificial Sequence
  Ebola virus siRNA sense strand
guaauauaaccugccaagcau

SEQ ID NO: 10676 - RNA, 21 nt, Artificial Sequence
  Ebola virus siRNA sense strand
uaauauaaccugccaagcaua

SEQ ID NO: 10677 - RNA, 21 nt, Artificial Sequence
  Ebola virus siRNA sense strand
aauauaaccugccaagcauac

SEQ ID NO: 10678 - RNA, 21 nt, Artificial Sequence
  Ebola virus siRNA sense strand
auauaaccugccaagcauacc

SEQ ID NO: 10679 - RNA, 21 nt, Artificial Sequence
  Ebola virus siRNA sense strand
uauaaccugccaagcauaccu

SEQ ID NO: 10680 - RNA, 21 nt, Artificial Sequence
  Ebola virus siRNA sense strand
auaaccugccaagcauaccuc

SEQ ID NO: 10681 - RNA, 21 nt, Artificial Sequence
  Ebola virus siRNA sense strand
uaaccugccaagcauaccucu

SEQ ID NO: 10682 - RNA, 21 nt, Artificial Sequence
  Ebola virus siRNA sense strand
aaccugccaagcauaccucuu

SEQ ID NO: 10683 - RNA, 21 nt, Artificial Sequence
  Ebola virus siRNA sense strand
accugccaagcauaccucuug

SEQ ID NO: 10684 - RNA, 21 nt, Artificial Sequence
  Ebola virus siRNA sense strand
ccugccaagcauaccucuugc

SEQ ID NO: 10685 - RNA, 21 nt, Artificial Sequence
  Ebola virus siRNA sense strand
cugccaagcauaccucuugca

SEQ ID NO: 10686 - RNA, 21 nt, Artificial Sequence
  Ebola virus siRNA sense strand
ugccaagcauaccucuugcac

SEQ ID NO: 10687 - RNA, 21 nt, Artificial Sequence
  Ebola virus siRNA sense strand
gccaagcauaccucuugcaca

SEQ ID NO: 10688 - RNA, 21 nt, Artificial Sequence
  Ebola virus siRNA sense strand
ccaagcauaccucuugcacaa

SEQ ID NO: 10689 - RNA, 21 nt, Artificial Sequence
  Ebola virus siRNA sense strand
caagcauaccucuugcacaaa

SEQ ID NO: 10690 - RNA, 21 nt, Artificial Sequence
  Ebola virus siRNA sense strand
aagcauaccucuugcacaaag

SEQ ID NO: 10691 - RNA, 21 nt, Artificial Sequence
  Ebola virus siRNA sense strand
agcauaccucuugcacaaagu

SEQ ID NO: 10692 - RNA, 21 nt, Artificial Sequence
  Ebola virus siRNA sense strand
gcauaccucuugcacaaagug

SEQ ID NO: 10693 - RNA, 21 nt, Artificial Sequence
  Ebola virus siRNA sense strand
cauaccucuugcacaaaguga

SEQ ID NO: 10694 - RNA, 21 nt, Artificial Sequence
  Ebola virus siRNA sense strand
auaccucuugcacaaagugau

SEQ ID NO: 10695 - RNA, 21 nt, Artificial Sequence
  Ebola virus siRNA sense strand
uaccucuugcacaaagugauu

SEQ ID NO: 10696 - RNA, 21 nt, Artificial Sequence
  Ebola virus siRNA sense strand
accucuugcacaaagugauuc

SEQ ID NO: 10697 - RNA, 21 nt, Artificial Sequence
  Ebola virus siRNA sense strand
ccucuugcacaaagugauucu

SEQ ID NO: 10698 - RNA, 21 nt, Artificial Sequence
  Ebola virus siRNA sense strand
cucuugcacaaagugauucuu

SEQ ID NO: 10699 - RNA, 21 nt, Artificial Sequence
  Ebola virus siRNA sense strand
ucuugcacaaagugauucuug

SEQ ID NO: 10700 - RNA, 21 nt, Artificial Sequence
  Ebola virus siRNA sense strand
cuugcacaaagugauucuugu

SEQ ID NO: 10701 - RNA, 21 nt, Artificial Sequence
  Ebola virus siRNA sense strand
uugcacaaagugauucuugua

SEQ ID NO: 10702 - RNA, 21 nt, Artificial Sequence
  Ebola virus siRNA sense strand
ugcacaaagugauucuuguac

SEQ ID NO: 10703 - RNA, 21 nt, Artificial Sequence
  Ebola virus siRNA sense strand
gcacaaagugauucuuguaca

SEQ ID NO: 10704 - RNA, 21 nt, Artificial Sequence
  Ebola virus siRNA sense strand
cacaaagugauucuuguacac

SEQ ID NO: 10705 - RNA, 21 nt, Artificial Sequence
  Ebola virus siRNA sense strand
acaaagugauucuuguacaca

SEQ ID NO: 10706 - RNA, 21 nt, Artificial Sequence
  Ebola virus siRNA sense strand
caaagugauucuuguacacaa

SEQ ID NO: 10707 - RNA, 21 nt, Artificial Sequence
  Ebola virus siRNA sense strand
aaagugauucuuguacacaaa

SEQ ID NO: 10708 - RNA, 21 nt, Artificial Sequence
  Ebola virus siRNA sense strand
aagugauucuuguacacaaau

SEQ ID NO: 10709 - RNA, 21 nt, Artificial Sequence
  Ebola virus siRNA sense strand
agugauucuuguacacaaaua

SEQ ID NO: 10710 - RNA, 21 nt, Artificial Sequence
  Ebola virus siRNA sense strand
gugauucuuguacacaaauaa

SEQ ID NO: 10711 - RNA, 21 nt, Artificial Sequence
  Ebola virus siRNA sense strand
ugauucuuguacacaaauaau

SEQ ID NO: 10712 - RNA, 21 nt, Artificial Sequence
  Ebola virus siRNA sense strand
gauucuuguacacaaauaaug

SEQ ID NO: 10713 - RNA, 21 nt, Artificial Sequence
  Ebola virus siRNA sense strand
auucuuguacacaaauaaugu

SEQ ID NO: 10714 - RNA, 21 nt, Artificial Sequence
  Ebola virus siRNA sense strand
uucuuguacacaaauaauguu

SEQ ID NO: 10715 - RNA, 21 nt, Artificial Sequence
  Ebola virus siRNA sense strand
ucuuguacacaaauaauguuu

SEQ ID NO: 10716 - RNA, 21 nt, Artificial Sequence
  Ebola virus siRNA sense strand
cuuguacacaaauaauguuuu

SEQ ID NO: 10717 - RNA, 21 nt, Artificial Sequence
  Ebola virus siRNA sense strand
uuguacacaaauaauguuuua

SEQ ID NO: 10718 - RNA, 21 nt, Artificial Sequence
  Ebola virus siRNA sense strand
uguacacaaauaauguuuuac

SEQ ID NO: 10719 - RNA, 21 nt, Artificial Sequence
  Ebola virus siRNA sense strand
guacacaaauaauguuuuacu

SEQ ID NO: 10720 - RNA, 21 nt, Artificial Sequence
  Ebola virus siRNA sense strand
uacacaaauaauguuuuacuc

SEQ ID NO: 10721 - RNA, 21 nt, Artificial Sequence
  Ebola virus siRNA sense strand
acacaaauaauguuuuacucu

SEQ ID NO: 10722 - RNA, 21 nt, Artificial Sequence
  Ebola virus siRNA sense strand
cacaaauaauguuuuacucua

SEQ ID NO: 10723 - RNA, 21 nt, Artificial Sequence
  Ebola virus siRNA sense strand
acaaauaauguuuuacucuac

SEQ ID NO: 10724 - RNA, 21 nt, Artificial Sequence
  Ebola virus siRNA sense strand
caaauaauguuuuacucuaca

SEQ ID NO: 10725 - RNA, 21 nt, Artificial Sequence
  Ebola virus siRNA sense strand
aaauaauguuuuacucuacag

SEQ ID NO: 10726 - RNA, 21 nt, Artificial Sequence
  Ebola virus siRNA sense strand
aauaauguuuuacucuacagg

SEQ ID NO: 10727 - RNA, 21 nt, Artificial Sequence
  Ebola virus siRNA sense strand
auaauguuuuacucuacagga

SEQ ID NO: 10728 - RNA, 21 nt, Artificial Sequence
  Ebola virus siRNA sense strand
uaauguuuuacucuacaggag

SEQ ID NO: 10729 - RNA, 21 nt, Artificial Sequence
  Ebola virus siRNA sense strand
aauguuuuacucuacaggagg

SEQ ID NO: 10730 - RNA, 21 nt, Artificial Sequence
  Ebola virus siRNA sense strand
auguuuuacucuacaggaggu

SEQ ID NO: 10731 - RNA, 21 nt, Artificial Sequence
  Ebola virus siRNA sense strand
uguuuuacucuacaggaggua

SEQ ID NO: 10732 - RNA, 21 nt, Artificial Sequence
  Ebola virus siRNA sense strand
guuuuacucuacaggagguag

SEQ ID NO: 10733 - RNA, 21 nt, Artificial Sequence
  Ebola virus siRNA sense strand
uuuuacucuacaggagguagc

SEQ ID NO: 10734 - RNA, 21 nt, Artificial Sequence
  Ebola virus siRNA sense strand
uuuacucuacaggagguagca

SEQ ID NO: 10735 - RNA, 21 nt, Artificial Sequence
  Ebola virus siRNA sense strand
uuacucuacaggagguagcaa

SEQ ID NO: 10736 - RNA, 21 nt, Artificial Sequence
  Ebola virus siRNA sense strand
uacucuacaggagguagcaac

SEQ ID NO: 10737 - RNA, 21 nt, Artificial Sequence
  Ebola virus siRNA sense strand
acucuacaggagguagcaacg

SEQ ID NO: 10738 - RNA, 21 nt, Artificial Sequence
  Ebola virus siRNA sense strand
cucuacaggagguagcaacga

SEQ ID NO: 10739 - RNA, 21 nt, Artificial Sequence
  Ebola virus siRNA sense strand
ucuacaggagguagcaacgau

SEQ ID NO: 10740 - RNA, 21 nt, Artificial Sequence
  Ebola virus siRNA sense strand
cuacaggagguagcaacgauc

SEQ ID NO: 10741 - RNA, 21 nt, Artificial Sequence
  Ebola virus siRNA sense strand
uacaggagguagcaacgaucc

SEQ ID NO: 10742 - RNA, 21 nt, Artificial Sequence
  Ebola virus siRNA sense strand
acaggagguagcaacgaucca

SEQ ID NO: 10743 - RNA, 21 nt, Artificial Sequence
  Ebola virus siRNA sense strand
caggagguagcaacgauccau

SEQ ID NO: 10744 - RNA, 21 nt, Artificial Sequence
  Ebola virus siRNA sense strand
aggagguagcaacgauccauc

SEQ ID NO: 10745 - RNA, 21 nt, Artificial Sequence
  Ebola virus siRNA sense strand
ggagguagcaacgauccaucc

SEQ ID NO: 10746 - RNA, 21 nt, Artificial Sequence
  Ebola virus siRNA sense strand
gagguagcaacgauccauccc

SEQ ID NO: 10747 - RNA, 21 nt, Artificial Sequence
  Ebola virus siRNA sense strand
agguagcaacgauccauccca

SEQ ID NO: 10748 - RNA, 21 nt, Artificial Sequence
  Ebola virus siRNA sense strand
gguagcaacgauccaucccau

SEQ ID NO: 10749 - RNA, 21 nt, Artificial Sequence
  Ebola virus siRNA sense strand
guagcaacgauccaucccauc

SEQ ID NO: 10750 - RNA, 21 nt, Artificial Sequence
  Ebola virus siRNA sense strand
uagcaacgauccaucccauca

SEQ ID NO: 10751 - RNA, 21 nt, Artificial Sequence
  Ebola virus siRNA sense strand
agcaacgauccaucccaucaa

SEQ ID NO: 10752 - RNA, 21 nt, Artificial Sequence
  Ebola virus siRNA sense strand
gcaacgauccaucccaucaaa

SEQ ID NO: 10753 - RNA, 21 nt, Artificial Sequence
  Ebola virus siRNA sense strand
caacgauccaucccaucaaaa

SEQ ID NO: 10754 - RNA, 21 nt, Artificial Sequence
  Ebola virus siRNA sense strand
aacgauccaucccaucaaaaa

SEQ ID NO: 10755 - RNA, 21 nt, Artificial Sequence
  Ebola virus siRNA sense strand
acgauccaucccaucaaaaaa

SEQ ID NO: 10756 - RNA, 21 nt, Artificial Sequence
  Ebola virus siRNA sense strand
cgauccaucccaucaaaaaau

SEQ ID NO: 10757 - RNA, 21 nt, Artificial Sequence
  Ebola virus siRNA sense strand
gauccaucccaucaaaaaaua

SEQ ID NO: 10758 - RNA, 21 nt, Artificial Sequence
  Ebola virus siRNA sense strand
auccaucccaucaaaaaauaa

SEQ ID NO: 10759 - RNA, 21 nt, Artificial Sequence
  Ebola virus siRNA sense strand
uccaucccaucaaaaaauaag

SEQ ID NO: 10760 - RNA, 21 nt, Artificial Sequence
  Ebola virus siRNA sense strand
ccaucccaucaaaaaauaagu

SEQ ID NO: 10761 - RNA, 21 nt, Artificial Sequence
  Ebola virus siRNA sense strand
caucccaucaaaaaauaagua

SEQ ID NO: 10762 - RNA, 21 nt, Artificial Sequence
  Ebola virus siRNA sense strand
aucccaucaaaaaauaaguau

SEQ ID NO: 10763 - RNA, 21 nt, Artificial Sequence
  Ebola virus siRNA sense strand
ucccaucaaaaaauaaguauu

SEQ ID NO: 10764 - RNA, 21 nt, Artificial Sequence
  Ebola virus siRNA sense strand
cccaucaaaaaauaaguauuu

SEQ ID NO: 10765 - RNA, 21 nt, Artificial Sequence
  Ebola virus siRNA sense strand
ccaucaaaaaauaaguauuuc

SEQ ID NO: 10766 - RNA, 21 nt, Artificial Sequence
  Ebola virus siRNA sense strand
caucaaaaaauaaguauuuca

SEQ ID NO: 10767 - RNA, 21 nt, Artificial Sequence
  Ebola virus siRNA sense strand
aucaaaaaauaaguauuucau

SEQ ID NO: 10768 - RNA, 21 nt, Artificial Sequence
  Ebola virus siRNA sense strand
ucaaaaaauaaguauuucaug

SEQ ID NO: 10769 - RNA, 21 nt, Artificial Sequence
  Ebola virus siRNA sense strand
caaaaaauaaguauuucauga

SEQ ID NO: 10770 - RNA, 21 nt, Artificial Sequence
  Ebola virus siRNA sense strand
aaaaaauaaguauuucaugac

SEQ ID NO: 10771 - RNA, 21 nt, Artificial Sequence
  Ebola virus siRNA sense strand
aaaaauaaguauuucaugacu

SEQ ID NO: 10772 - RNA, 21 nt, Artificial Sequence
  Ebola virus siRNA sense strand
aaaauaaguauuucaugacuu

SEQ ID NO: 10773 - RNA, 21 nt, Artificial Sequence
  Ebola virus siRNA sense strand
aaauaaguauuucaugacuua

SEQ ID NO: 10774 - RNA, 21 nt, Artificial Sequence
  Ebola virus siRNA sense strand
aauaaguauuucaugacuuac

SEQ ID NO: 10775 - RNA, 21 nt, Artificial Sequence
  Ebola virus siRNA sense strand
auaaguauuucaugacuuacu

SEQ ID NO: 10776 - RNA, 21 nt, Artificial Sequence
  Ebola virus siRNA sense strand
uaaguauuucaugacuuacua

SEQ ID NO: 10777 - RNA, 21 nt, Artificial Sequence
  Ebola virus siRNA sense strand
aaguauuucaugacuuacuaa

SEQ ID NO: 10778 - RNA, 21 nt, Artificial Sequence
  Ebola virus siRNA sense strand
aguauuucaugacuuacuaau

SEQ ID NO: 10779 - RNA, 21 nt, Artificial Sequence
  Ebola virus siRNA sense strand
guauuucaugacuuacuaaug

SEQ ID NO: 10780 - RNA, 21 nt, Artificial Sequence
  Ebola virus siRNA sense strand
uauuucaugacuuacuaauga

SEQ ID NO: 10781 - RNA, 21 nt, Artificial Sequence
  Ebola virus siRNA sense strand
auuucaugacuuacuaaugau

SEQ ID NO: 10782 - RNA, 21 nt, Artificial Sequence
  Ebola virus siRNA sense strand
uuucaugacuuacuaaugauc

SEQ ID NO: 10783 - RNA, 21 nt, Artificial Sequence
  Ebola virus siRNA sense strand
uucaugacuuacuaaugaucu

SEQ ID NO: 10784 - RNA, 21 nt, Artificial Sequence
  Ebola virus siRNA sense strand
ucaugacuuacuaaugaucuc

SEQ ID NO: 10785 - RNA, 21 nt, Artificial Sequence
  Ebola virus siRNA sense strand
caugacuuacuaaugaucucu

SEQ ID NO: 10786 - RNA, 21 nt, Artificial Sequence
  Ebola virus siRNA sense strand
augacuuacuaaugaucucuu

SEQ ID NO: 10787 - RNA, 21 nt, Artificial Sequence
  Ebola virus siRNA sense strand
ugacuuacuaaugaucucuua

SEQ ID NO: 10788 - RNA, 21 nt, Artificial Sequence
  Ebola virus siRNA sense strand
gacuuacuaaugaucucuuaa

SEQ ID NO: 10789 - RNA, 21 nt, Artificial Sequence
  Ebola virus siRNA sense strand
acuuacuaaugaucucuuaaa

SEQ ID NO: 10790 - RNA, 21 nt, Artificial Sequence
  Ebola virus siRNA sense strand
cuuacuaaugaucucuuaaaa

SEQ ID NO: 10791 - RNA, 21 nt, Artificial Sequence
  Ebola virus siRNA sense strand
uuacuaaugaucucuuaaaau

SEQ ID NO: 10792 - RNA, 21 nt, Artificial Sequence
  Ebola virus siRNA sense strand
uacuaaugaucucuuaaaaua

SEQ ID NO: 10793 - RNA, 21 nt, Artificial Sequence
  Ebola virus siRNA sense strand
acuaaugaucucuuaaaauau

SEQ ID NO: 10794 - RNA, 21 nt, Artificial Sequence
  Ebola virus siRNA sense strand
cuaaugaucucuuaaaauauu

SEQ ID NO: 10795 - RNA, 21 nt, Artificial Sequence
  Ebola virus siRNA sense strand
uaaugaucucuuaaaauauua

SEQ ID NO: 10796 - RNA, 21 nt, Artificial Sequence
  Ebola virus siRNA sense strand
aaugaucucuuaaaauauuaa

SEQ ID NO: 10797 - RNA, 21 nt, Artificial Sequence
  Ebola virus siRNA sense strand
augaucucuuaaaauauuaag

SEQ ID NO: 10798 - RNA, 21 nt, Artificial Sequence
  Ebola virus siRNA sense strand
ugaucucuuaaaauauuaaga

SEQ ID NO: 10799 - RNA, 21 nt, Artificial Sequence
  Ebola virus siRNA sense strand
gaucucuuaaaauauuaagaa

SEQ ID NO: 10800 - RNA, 21 nt, Artificial Sequence
  Ebola virus siRNA sense strand
aucucuuaaaauauuaagaaa

SEQ ID NO: 10801 - RNA, 21 nt, Artificial Sequence
  Ebola virus siRNA sense strand
ucucuuaaaauauuaagaaaa

SEQ ID NO: 10802 - RNA, 21 nt, Artificial Sequence
  Ebola virus siRNA sense strand
cucuuaaaauauuaagaaaaa

SEQ ID NO: 10803 - RNA, 21 nt, Artificial Sequence
  Ebola virus siRNA sense strand
ucuuaaaauauuaagaaaaac

SEQ ID NO: 10804 - RNA, 21 nt, Artificial Sequence
  Ebola virus siRNA sense strand
cuuaaaauauuaagaaaaacu

SEQ ID NO: 10805 - RNA, 21 nt, Artificial Sequence
  Ebola virus siRNA sense strand
uuaaaauauuaagaaaaacug

SEQ ID NO: 10806 - RNA, 21 nt, Artificial Sequence
  Ebola virus siRNA sense strand
uaaaauauuaagaaaaacuga

SEQ ID NO: 10807 - RNA, 21 nt, Artificial Sequence
  Ebola virus siRNA sense strand
aaaauauuaagaaaaacugac

SEQ ID NO: 10808 - RNA, 21 nt, Artificial Sequence
  Ebola virus siRNA sense strand
aaauauuaagaaaaacugacg

SEQ ID NO: 10809 - RNA, 21 nt, Artificial Sequence
  Ebola virus siRNA sense strand
aauauuaagaaaaacugacgg

SEQ ID NO: 10810 - RNA, 21 nt, Artificial Sequence
  Ebola virus siRNA sense strand
auauuaagaaaaacugacgga

SEQ ID NO: 10811 - RNA, 21 nt, Artificial Sequence
  Ebola virus siRNA sense strand
uauuaagaaaaacugacggaa

SEQ ID NO: 10812 - RNA, 21 nt, Artificial Sequence
  Ebola virus siRNA sense strand
auuaagaaaaacugacggaac

SEQ ID NO: 10813 - RNA, 21 nt, Artificial Sequence
  Ebola virus siRNA sense strand
uuaagaaaaacugacggaaca

SEQ ID NO: 10814 - RNA, 21 nt, Artificial Sequence
  Ebola virus siRNA sense strand
uaagaaaaacugacggaacau

SEQ ID NO: 10815 - RNA, 21 nt, Artificial Sequence
  Ebola virus siRNA sense strand
aagaaaaacugacggaacaua

SEQ ID NO: 10816 - RNA, 21 nt, Artificial Sequence
  Ebola virus siRNA sense strand
agaaaaacugacggaacauaa

SEQ ID NO: 10817 - RNA, 21 nt, Artificial Sequence
  Ebola virus siRNA sense strand
gaaaaacugacggaacauaaa

SEQ ID NO: 10818 - RNA, 21 nt, Artificial Sequence
  Ebola virus siRNA sense strand
aaaaacugacggaacauaaau

SEQ ID NO: 10819 - RNA, 21 nt, Artificial Sequence
  Ebola virus siRNA sense strand
aaaacugacggaacauaaauu

SEQ ID NO: 10820 - RNA, 21 nt, Artificial Sequence
  Ebola virus siRNA sense strand
aaacugacggaacauaaauuc

SEQ ID NO: 10821 - RNA, 21 nt, Artificial Sequence
  Ebola virus siRNA sense strand
aacugacggaacauaaauucu

SEQ ID NO: 10822 - RNA, 21 nt, Artificial Sequence
  Ebola virus siRNA sense strand
acugacggaacauaaauucuu

SEQ ID NO: 10823 - RNA, 21 nt, Artificial Sequence
  Ebola virus siRNA sense strand
cugacggaacauaaauucuuu

SEQ ID NO: 10824 - RNA, 21 nt, Artificial Sequence
  Ebola virus siRNA sense strand
ugacggaacauaaauucuuua

SEQ ID NO: 10825 - RNA, 21 nt, Artificial Sequence
  Ebola virus siRNA sense strand
gacggaacauaaauucuuuau

SEQ ID NO: 10826 - RNA, 21 nt, Artificial Sequence
  Ebola virus siRNA sense strand
acggaacauaaauucuuuaug

SEQ ID NO: 10827 - RNA, 21 nt, Artificial Sequence
  Ebola virus siRNA sense strand
cggaacauaaauucuuuaugc

SEQ ID NO: 10828 - RNA, 21 nt, Artificial Sequence
  Ebola virus siRNA sense strand
ggaacauaaauucuuuaugcu

SEQ ID NO: 10829 - RNA, 21 nt, Artificial Sequence
  Ebola virus siRNA sense strand
gaacauaaauucuuuaugcuu

SEQ ID NO: 10830 - RNA, 21 nt, Artificial Sequence
  Ebola virus siRNA sense strand
aacauaaauucuuuaugcuuc

SEQ ID NO: 10831 - RNA, 21 nt, Artificial Sequence
  Ebola virus siRNA sense strand
acauaaauucuuuaugcuuca

SEQ ID NO: 10832 - RNA, 21 nt, Artificial Sequence
  Ebola virus siRNA sense strand
cauaaauucuuuaugcuucaa

SEQ ID NO: 10833 - RNA, 21 nt, Artificial Sequence
  Ebola virus siRNA sense strand
auaaauucuuuaugcuucaag

SEQ ID NO: 10834 - RNA, 21 nt, Artificial Sequence
  Ebola virus siRNA sense strand
uaaauucuuuaugcuucaagc

SEQ ID NO: 10835 - RNA, 21 nt, Artificial Sequence
  Ebola virus siRNA sense strand
aaauucuuuaugcuucaagcu

SEQ ID NO: 10836 - RNA, 21 nt, Artificial Sequence
  Ebola virus siRNA sense strand
aauucuuuaugcuucaagcug

SEQ ID NO: 10837 - RNA, 21 nt, Artificial Sequence
  Ebola virus siRNA sense strand
auucuuuaugcuucaagcugu

SEQ ID NO: 10838 - RNA, 21 nt, Artificial Sequence
  Ebola virus siRNA sense strand
uucuuuaugcuucaagcugug

SEQ ID NO: 10839 - RNA, 21 nt, Artificial Sequence
  Ebola virus siRNA sense strand
ucuuuaugcuucaagcugugg

SEQ ID NO: 10840 - RNA, 21 nt, Artificial Sequence
  Ebola virus siRNA sense strand
cuuuaugcuucaagcugugga

SEQ ID NO: 10841 - RNA, 21 nt, Artificial Sequence
  Ebola virus siRNA sense strand
uuuaugcuucaagcuguggag

SEQ ID NO: 10842 - RNA, 21 nt, Artificial Sequence
  Ebola virus siRNA sense strand
uuaugcuucaagcuguggagg

SEQ ID NO: 10843 - RNA, 21 nt, Artificial Sequence
  Ebola virus siRNA sense strand
uaugcuucaagcuguggagga

SEQ ID NO: 10844 - RNA, 21 nt, Artificial Sequence
  Ebola virus siRNA sense strand
augcuucaagcuguggaggag

SEQ ID NO: 10845 - RNA, 21 nt, Artificial Sequence
  Ebola virus siRNA sense strand
ugcuucaagcuguggaggagg

SEQ ID NO: 10846 - RNA, 21 nt, Artificial Sequence
  Ebola virus siRNA sense strand
gcuucaagcuguggaggaggu

SEQ ID NO: 10847 - RNA, 21 nt, Artificial Sequence
  Ebola virus siRNA sense strand
cuucaagcuguggaggaggug

SEQ ID NO: 10848 - RNA, 21 nt, Artificial Sequence
  Ebola virus siRNA sense strand
uucaagcuguggaggaggugu

SEQ ID NO: 10849 - RNA, 21 nt, Artificial Sequence
  Ebola virus siRNA sense strand
ucaagcuguggaggagguguu

SEQ ID NO: 10850 - RNA, 21 nt, Artificial Sequence
  Ebola virus siRNA sense strand
caagcuguggaggagguguuu

SEQ ID NO: 10851 - RNA, 21 nt, Artificial Sequence
  Ebola virus siRNA sense strand
aagcuguggaggagguguuug

SEQ ID NO: 10852 - RNA, 21 nt, Artificial Sequence
  Ebola virus siRNA sense strand
agcuguggaggagguguuugg

SEQ ID NO: 10853 - RNA, 21 nt, Artificial Sequence
  Ebola virus siRNA sense strand
gcuguggaggagguguuuggu

SEQ ID NO: 10854 - RNA, 21 nt, Artificial Sequence
  Ebola virus siRNA sense strand
cuguggaggagguguuuggua

SEQ ID NO: 10855 - RNA, 21 nt, Artificial Sequence
  Ebola virus siRNA sense strand
uguggaggagguguuugguau

SEQ ID NO: 10856 - RNA, 21 nt, Artificial Sequence
  Ebola virus siRNA sense strand
guggaggagguguuugguauu

SEQ ID NO: 10857 - RNA, 21 nt, Artificial Sequence
  Ebola virus siRNA sense strand
uggaggagguguuugguauug

SEQ ID NO: 10858 - RNA, 21 nt, Artificial Sequence
  Ebola virus siRNA sense strand
ggaggagguguuugguauugg

SEQ ID NO: 10859 - RNA, 21 nt, Artificial Sequence
  Ebola virus siRNA sense strand
gaggagguguuugguauuggc

SEQ ID NO: 10860 - RNA, 21 nt, Artificial Sequence
  Ebola virus siRNA sense strand
aggagguguuugguauuggcu

SEQ ID NO: 10861 - RNA, 21 nt, Artificial Sequence
  Ebola virus siRNA sense strand
ggagguguuugguauuggcua

SEQ ID NO: 10862 - RNA, 21 nt, Artificial Sequence
  Ebola virus siRNA sense strand
gagguguuugguauuggcuau

SEQ ID NO: 10863 - RNA, 21 nt, Artificial Sequence
  Ebola virus siRNA sense strand
agguguuugguauuggcuauu

SEQ ID NO: 10864 - RNA, 21 nt, Artificial Sequence
  Ebola virus siRNA sense strand
gguguuugguauuggcuauug

SEQ ID NO: 10865 - RNA, 21 nt, Artificial Sequence
  Ebola virus siRNA sense strand
guguuugguauuggcuauugu

SEQ ID NO: 10866 - RNA, 21 nt, Artificial Sequence
  Ebola virus siRNA sense strand
uguuugguauuggcuauuguu

SEQ ID NO: 10867 - RNA, 21 nt, Artificial Sequence
  Ebola virus siRNA sense strand
guuugguauuggcuauuguua

SEQ ID NO: 10868 - RNA, 21 nt, Artificial Sequence
  Ebola virus siRNA sense strand
uuugguauuggcuauuguuau

SEQ ID NO: 10869 - RNA, 21 nt, Artificial Sequence
  Ebola virus siRNA sense strand
uugguauuggcuauuguuaua

SEQ ID NO: 10870 - RNA, 21 nt, Artificial Sequence
  Ebola virus siRNA sense strand
ugguauuggcuauuguuauau

SEQ ID NO: 10871 - RNA, 21 nt, Artificial Sequence
  Ebola virus siRNA sense strand
gguauuggcuauuguuauauu

SEQ ID NO: 10872 - RNA, 21 nt, Artificial Sequence
  Ebola virus siRNA sense strand
guauuggcuauuguuauauua

SEQ ID NO: 10873 - RNA, 21 nt, Artificial Sequence
  Ebola virus siRNA sense strand
uauuggcuauuguuauauuac

SEQ ID NO: 10874 - RNA, 21 nt, Artificial Sequence
  Ebola virus siRNA sense strand
auuggcuauuguuauauuaca

SEQ ID NO: 10875 - RNA, 21 nt, Artificial Sequence
  Ebola virus siRNA sense strand
uuggcuauuguuauauuacaa

SEQ ID NO: 10876 - RNA, 21 nt, Artificial Sequence
  Ebola virus siRNA sense strand
uggcuauuguuauauuacaau

SEQ ID NO: 10877 - RNA, 21 nt, Artificial Sequence
  Ebola virus siRNA sense strand
ggcuauuguuauauuacaauc

SEQ ID NO: 10878 - RNA, 21 nt, Artificial Sequence
  Ebola virus siRNA sense strand
gcuauuguuauauuacaauca

SEQ ID NO: 10879 - RNA, 21 nt, Artificial Sequence
  Ebola virus siRNA sense strand
cuauuguuauauuacaaucaa

SEQ ID NO: 10880 - RNA, 21 nt, Artificial Sequence
  Ebola virus siRNA sense strand
uauuguuauauuacaaucaau

SEQ ID NO: 10881 - RNA, 21 nt, Artificial Sequence
  Ebola virus siRNA sense strand
auuguuauauuacaaucaaua

SEQ ID NO: 10882 - RNA, 21 nt, Artificial Sequence
  Ebola virus siRNA sense strand
uuguuauauuacaaucaauaa

SEQ ID NO: 10883 - RNA, 21 nt, Artificial Sequence
  Ebola virus siRNA sense strand
uguuauauuacaaucaauaac

SEQ ID NO: 10884 - RNA, 21 nt, Artificial Sequence
  Ebola virus siRNA sense strand
guuauauuacaaucaauaaca

SEQ ID NO: 10885 - RNA, 21 nt, Artificial Sequence
  Ebola virus siRNA sense strand
uuauauuacaaucaauaacaa

SEQ ID NO: 10886 - RNA, 21 nt, Artificial Sequence
  Ebola virus siRNA sense strand
uauauuacaaucaauaacaag

SEQ ID NO: 10887 - RNA, 21 nt, Artificial Sequence
  Ebola virus siRNA sense strand
auauuacaaucaauaacaagc

SEQ ID NO: 10888 - RNA, 21 nt, Artificial Sequence
  Ebola virus siRNA sense strand
uauuacaaucaauaacaagcu

SEQ ID NO: 10889 - RNA, 21 nt, Artificial Sequence
  Ebola virus siRNA sense strand
auuacaaucaauaacaagcuu

SEQ ID NO: 10890 - RNA, 21 nt, Artificial Sequence
  Ebola virus siRNA sense strand
uuacaaucaauaacaagcuug

SEQ ID NO: 10891 - RNA, 21 nt, Artificial Sequence
  Ebola virus siRNA sense strand
uacaaucaauaacaagcuugu

SEQ ID NO: 10892 - RNA, 21 nt, Artificial Sequence
  Ebola virus siRNA sense strand
acaaucaauaacaagcuugua

SEQ ID NO: 10893 - RNA, 21 nt, Artificial Sequence
  Ebola virus siRNA sense strand
caaucaauaacaagcuuguaa

SEQ ID NO: 10894 - RNA, 21 nt, Artificial Sequence
  Ebola virus siRNA sense strand
aaucaauaacaagcuuguaaa

SEQ ID NO: 10895 - RNA, 21 nt, Artificial Sequence
  Ebola virus siRNA sense strand
aucaauaacaagcuuguaaaa

SEQ ID NO: 10896 - RNA, 21 nt, Artificial Sequence
  Ebola virus siRNA sense strand
ucaauaacaagcuuguaaaaa

SEQ ID NO: 10897 - RNA, 21 nt, Artificial Sequence
  Ebola virus siRNA sense strand
caauaacaagcuuguaaaaau

SEQ ID NO: 10898 - RNA, 21 nt, Artificial Sequence
  Ebola virus siRNA sense strand
aauaacaagcuuguaaaaaua

SEQ ID NO: 10899 - RNA, 21 nt, Artificial Sequence
  Ebola virus siRNA sense strand
auaacaagcuuguaaaaauau

SEQ ID NO: 10900 - RNA, 21 nt, Artificial Sequence
  Ebola virus siRNA sense strand
uaacaagcuuguaaaaauauu

SEQ ID NO: 10901 - RNA, 21 nt, Artificial Sequence
  Ebola virus siRNA sense strand
aacaagcuuguaaaaauauug

SEQ ID NO: 10902 - RNA, 21 nt, Artificial Sequence
  Ebola virus siRNA sense strand
acaagcuuguaaaaauauugu

SEQ ID NO: 10903 - RNA, 21 nt, Artificial Sequence
  Ebola virus siRNA sense strand
caagcuuguaaaaauauuguu

SEQ ID NO: 10904 - RNA, 21 nt, Artificial Sequence
  Ebola virus siRNA sense strand
aagcuuguaaaaauauuguuc

SEQ ID NO: 10905 - RNA, 21 nt, Artificial Sequence
  Ebola virus siRNA sense strand
agcuuguaaaaauauuguucu

SEQ ID NO: 10906 - RNA, 21 nt, Artificial Sequence
  Ebola virus siRNA sense strand
gcuuguaaaaauauuguucuu

SEQ ID NO: 10907 - RNA, 21 nt, Artificial Sequence
  Ebola virus siRNA sense strand
cuuguaaaaauauuguucuug

SEQ ID NO: 10908 - RNA, 21 nt, Artificial Sequence
  Ebola virus siRNA sense strand
uuguaaaaauauuguucuugu

SEQ ID NO: 10909 - RNA, 21 nt, Artificial Sequence
  Ebola virus siRNA sense strand
uguaaaaauauuguucuuguu

SEQ ID NO: 10910 - RNA, 21 nt, Artificial Sequence
  Ebola virus siRNA sense strand
guaaaaauauuguucuuguuu

SEQ ID NO: 10911 - RNA, 21 nt, Artificial Sequence
  Ebola virus siRNA sense strand
uaaaaauauuguucuuguuuc

SEQ ID NO: 10912 - RNA, 21 nt, Artificial Sequence
  Ebola virus siRNA sense strand
aaaaauauuguucuuguuuca

SEQ ID NO: 10913 - RNA, 21 nt, Artificial Sequence
  Ebola virus siRNA sense strand
aaaauauuguucuuguuucaa

SEQ ID NO: 10914 - RNA, 21 nt, Artificial Sequence
  Ebola virus siRNA sense strand
aaauauuguucuuguuucaag

SEQ ID NO: 10915 - RNA, 21 nt, Artificial Sequence
  Ebola virus siRNA sense strand
aauauuguucuuguuucaaga

SEQ ID NO: 10916 - RNA, 21 nt, Artificial Sequence
  Ebola virus siRNA sense strand
auauuguucuuguuucaagag

SEQ ID NO: 10917 - RNA, 21 nt, Artificial Sequence
  Ebola virus siRNA sense strand
uauuguucuuguuucaagagg

SEQ ID NO: 10918 - RNA, 21 nt, Artificial Sequence
  Ebola virus siRNA sense strand
auuguucuuguuucaagaggu

SEQ ID NO: 10919 - RNA, 21 nt, Artificial Sequence
  Ebola virus siRNA sense strand
uuguucuuguuucaagaggua

SEQ ID NO: 10920 - RNA, 21 nt, Artificial Sequence
  Ebola virus siRNA sense strand
uguucuuguuucaagagguag

SEQ ID NO: 10921 - RNA, 21 nt, Artificial Sequence
  Ebola virus siRNA sense strand
guucuuguuucaagagguaga

SEQ ID NO: 10922 - RNA, 21 nt, Artificial Sequence
  Ebola virus siRNA sense strand
uucuuguuucaagagguagau

SEQ ID NO: 10923 - RNA, 21 nt, Artificial Sequence
  Ebola virus siRNA sense strand
ucuuguuucaagagguagauu

SEQ ID NO: 10924 - RNA, 21 nt, Artificial Sequence
  Ebola virus siRNA sense strand
cuuguuucaagagguagauug

SEQ ID NO: 10925 - RNA, 21 nt, Artificial Sequence
  Ebola virus siRNA sense strand
uuguuucaagagguagauugu

SEQ ID NO: 10926 - RNA, 21 nt, Artificial Sequence
  Ebola virus siRNA sense strand
uguuucaagagguagauugug

SEQ ID NO: 10927 - RNA, 21 nt, Artificial Sequence
  Ebola virus siRNA sense strand
guuucaagagguagauuguga

SEQ ID NO: 10928 - RNA, 21 nt, Artificial Sequence
  Ebola virus siRNA sense strand
uuucaagagguagauugugac

SEQ ID NO: 10929 - RNA, 21 nt, Artificial Sequence
  Ebola virus siRNA sense strand
uucaagagguagauugugacc

SEQ ID NO: 10930 - RNA, 21 nt, Artificial Sequence
  Ebola virus siRNA sense strand
ucaagagguagauugugaccg

SEQ ID NO: 10931 - RNA, 21 nt, Artificial Sequence
  Ebola virus siRNA sense strand
caagagguagauugugaccgg

SEQ ID NO: 10932 - RNA, 21 nt, Artificial Sequence
  Ebola virus siRNA sense strand
aagagguagauugugaccgga

SEQ ID NO: 10933 - RNA, 21 nt, Artificial Sequence
  Ebola virus siRNA sense strand
agagguagauugugaccggaa

SEQ ID NO: 10934 - RNA, 21 nt, Artificial Sequence
  Ebola virus siRNA sense strand
gagguagauugugaccggaaa

SEQ ID NO: 10935 - RNA, 21 nt, Artificial Sequence
  Ebola virus siRNA sense strand
agguagauugugaccggaaau

SEQ ID NO: 10936 - RNA, 21 nt, Artificial Sequence
  Ebola virus siRNA sense strand
gguagauugugaccggaaaug

SEQ ID NO: 10937 - RNA, 21 nt, Artificial Sequence
  Ebola virus siRNA sense strand
guagauugugaccggaaaugc

SEQ ID NO: 10938 - RNA, 21 nt, Artificial Sequence
  Ebola virus siRNA sense strand
uagauugugaccggaaaugcu

SEQ ID NO: 10939 - RNA, 21 nt, Artificial Sequence
  Ebola virus siRNA sense strand
agauugugaccggaaaugcua

SEQ ID NO: 10940 - RNA, 21 nt, Artificial Sequence
  Ebola virus siRNA sense strand
gauugugaccggaaaugcuaa

SEQ ID NO: 10941 - RNA, 21 nt, Artificial Sequence
  Ebola virus siRNA sense strand
auugugaccggaaaugcuaaa

SEQ ID NO: 10942 - RNA, 21 nt, Artificial Sequence
  Ebola virus siRNA sense strand
uugugaccggaaaugcuaaac

SEQ ID NO: 10943 - RNA, 21 nt, Artificial Sequence
  Ebola virus siRNA sense strand
ugugaccggaaaugcuaaacu

SEQ ID NO: 10944 - RNA, 21 nt, Artificial Sequence
  Ebola virus siRNA sense strand
gugaccggaaaugcuaaacua

SEQ ID NO: 10945 - RNA, 21 nt, Artificial Sequence
  Ebola virus siRNA sense strand
ugaccggaaaugcuaaacuaa

SEQ ID NO: 10946 - RNA, 21 nt, Artificial Sequence
  Ebola virus siRNA sense strand
gaccggaaaugcuaaacuaau

SEQ ID NO: 10947 - RNA, 21 nt, Artificial Sequence
  Ebola virus siRNA sense strand
accggaaaugcuaaacuaaug

SEQ ID NO: 10948 - RNA, 21 nt, Artificial Sequence
  Ebola virus siRNA sense strand
ccggaaaugcuaaacuaauga

SEQ ID NO: 10949 - RNA, 21 nt, Artificial Sequence
  Ebola virus siRNA sense strand
cggaaaugcuaaacuaaugau

SEQ ID NO: 10950 - RNA, 21 nt, Artificial Sequence
  Ebola virus siRNA sense strand
ggaaaugcuaaacuaaugaug

SEQ ID NO: 10951 - RNA, 21 nt, Artificial Sequence
  Ebola virus siRNA sense strand
gaaaugcuaaacuaaugauga

SEQ ID NO: 10952 - RNA, 21 nt, Artificial Sequence
  Ebola virus siRNA sense strand
aaaugcuaaacuaaugaugaa

SEQ ID NO: 10953 - RNA, 21 nt, Artificial Sequence
  Ebola virus siRNA sense strand
aaugcuaaacuaaugaugaag

SEQ ID NO: 10954 - RNA, 21 nt, Artificial Sequence
  Ebola virus siRNA sense strand
augcuaaacuaaugaugaaga

SEQ ID NO: 10955 - RNA, 21 nt, Artificial Sequence
  Ebola virus siRNA sense strand
ugcuaaacuaaugaugaagau

SEQ ID NO: 10956 - RNA, 21 nt, Artificial Sequence
  Ebola virus siRNA sense strand
gcuaaacuaaugaugaagauu

SEQ ID NO: 10957 - RNA, 21 nt, Artificial Sequence
  Ebola virus siRNA sense strand
cuaaacuaaugaugaagauua

SEQ ID NO: 10958 - RNA, 21 nt, Artificial Sequence
  Ebola virus siRNA sense strand
uaaacuaaugaugaagauuaa

SEQ ID NO: 10959 - RNA, 21 nt, Artificial Sequence
  Ebola virus siRNA sense strand
aaacuaaugaugaagauuaau

SEQ ID NO: 10960 - RNA, 21 nt, Artificial Sequence
  Ebola virus siRNA sense strand
aacuaaugaugaagauuaaug

SEQ ID NO: 10961 - RNA, 21 nt, Artificial Sequence
  Ebola virus siRNA sense strand
acuaaugaugaagauuaaugc

SEQ ID NO: 10962 - RNA, 21 nt, Artificial Sequence
  Ebola virus siRNA sense strand
cuaaugaugaagauuaaugcg

SEQ ID NO: 10963 - RNA, 21 nt, Artificial Sequence
  Ebola virus siRNA sense strand
uaaugaugaagauuaaugcgg

SEQ ID NO: 10964 - RNA, 21 nt, Artificial Sequence
  Ebola virus siRNA sense strand
aaugaugaagauuaaugcgga

SEQ ID NO: 10965 - RNA, 21 nt, Artificial Sequence
  Ebola virus siRNA sense strand
augaugaagauuaaugcggag

SEQ ID NO: 10966 - RNA, 21 nt, Artificial Sequence
  Ebola virus siRNA sense strand
ugaugaagauuaaugcggagg

SEQ ID NO: 10967 - RNA, 21 nt, Artificial Sequence
  Ebola virus siRNA sense strand
gaugaagauuaaugcggaggu

SEQ ID NO: 10968 - RNA, 21 nt, Artificial Sequence
  Ebola virus siRNA sense strand
augaagauuaaugcggagguc

SEQ ID NO: 10969 - RNA, 21 nt, Artificial Sequence
  Ebola virus siRNA sense strand
ugaagauuaaugcggaggucu

SEQ ID NO: 10970 - RNA, 21 nt, Artificial Sequence
  Ebola virus siRNA sense strand
gaagauuaaugcggaggucug

SEQ ID NO: 10971 - RNA, 21 nt, Artificial Sequence
  Ebola virus siRNA sense strand
aagauuaaugcggaggucuga

SEQ ID NO: 10972 - RNA, 21 nt, Artificial Sequence
  Ebola virus siRNA sense strand
agauuaaugcggaggucugau

SEQ ID NO: 10973 - RNA, 21 nt, Artificial Sequence
  Ebola virus siRNA sense strand
gauuaaugcggaggucugaua

SEQ ID NO: 10974 - RNA, 21 nt, Artificial Sequence
  Ebola virus siRNA sense strand
auuaaugcggaggucugauaa

SEQ ID NO: 10975 - RNA, 21 nt, Artificial Sequence
  Ebola virus siRNA sense strand
uuaaugcggaggucugauaag

SEQ ID NO: 10976 - RNA, 21 nt, Artificial Sequence
  Ebola virus siRNA sense strand
uaaugcggaggucugauaaga

SEQ ID NO: 10977 - RNA, 21 nt, Artificial Sequence
  Ebola virus siRNA sense strand
aaugcggaggucugauaagaa

SEQ ID NO: 10978 - RNA, 21 nt, Artificial Sequence
  Ebola virus siRNA sense strand
augcggaggucugauaagaau

SEQ ID NO: 10979 - RNA, 21 nt, Artificial Sequence
  Ebola virus siRNA sense strand
ugcggaggucugauaagaaua

SEQ ID NO: 10980 - RNA, 21 nt, Artificial Sequence
  Ebola virus siRNA sense strand
gcggaggucugauaagaauaa

SEQ ID NO: 10981 - RNA, 21 nt, Artificial Sequence
  Ebola virus siRNA sense strand
cggaggucugauaagaauaaa

SEQ ID NO: 10982 - RNA, 21 nt, Artificial Sequence
  Ebola virus siRNA sense strand
ggaggucugauaagaauaaac

SEQ ID NO: 10983 - RNA, 21 nt, Artificial Sequence
  Ebola virus siRNA sense strand
gaggucugauaagaauaaacc

SEQ ID NO: 10984 - RNA, 21 nt, Artificial Sequence
  Ebola virus siRNA sense strand
aggucugauaagaauaaaccu

SEQ ID NO: 10985 - RNA, 21 nt, Artificial Sequence
  Ebola virus siRNA sense strand
ggucugauaagaauaaaccuu

SEQ ID NO: 10986 - RNA, 21 nt, Artificial Sequence
  Ebola virus siRNA sense strand
gucugauaagaauaaaccuua

SEQ ID NO: 10987 - RNA, 21 nt, Artificial Sequence
  Ebola virus siRNA sense strand
ucugauaagaauaaaccuuau

SEQ ID NO: 10988 - RNA, 21 nt, Artificial Sequence
  Ebola virus siRNA sense strand
cugauaagaauaaaccuuauu

SEQ ID NO: 10989 - RNA, 21 nt, Artificial Sequence
  Ebola virus siRNA sense strand
ugauaagaauaaaccuuauua

SEQ ID NO: 10990 - RNA, 21 nt, Artificial Sequence
  Ebola virus siRNA sense strand
gauaagaauaaaccuuauuau

SEQ ID NO: 10991 - RNA, 21 nt, Artificial Sequence
  Ebola virus siRNA sense strand
auaagaauaaaccuuauuauu

SEQ ID NO: 10992 - RNA, 21 nt, Artificial Sequence
  Ebola virus siRNA sense strand
uaagaauaaaccuuauuauuc

SEQ ID NO: 10993 - RNA, 21 nt, Artificial Sequence
  Ebola virus siRNA sense strand
aagaauaaaccuuauuauuca

SEQ ID NO: 10994 - RNA, 21 nt, Artificial Sequence
  Ebola virus siRNA sense strand
agaauaaaccuuauuauucag

SEQ ID NO: 10995 - RNA, 21 nt, Artificial Sequence
  Ebola virus siRNA sense strand
gaauaaaccuuauuauucaga

SEQ ID NO: 10996 - RNA, 21 nt, Artificial Sequence
  Ebola virus siRNA sense strand
aauaaaccuuauuauucagau

SEQ ID NO: 10997 - RNA, 21 nt, Artificial Sequence
  Ebola virus siRNA sense strand
auaaaccuuauuauucagauu

SEQ ID NO: 10998 - RNA, 21 nt, Artificial Sequence
  Ebola virus siRNA sense strand
uaaaccuuauuauucagauua

SEQ ID NO: 10999 - RNA, 21 nt, Artificial Sequence
  Ebola virus siRNA sense strand
aaaccuuauuauucagauuag

SEQ ID NO: 11000 - RNA, 21 nt, Artificial Sequence
  Ebola virus siRNA sense strand
aaccuuauuauucagauuagg

SEQ ID NO: 11001 - RNA, 21 nt, Artificial Sequence
  Ebola virus siRNA sense strand
accuuauuauucagauuaggc

SEQ ID NO: 11002 - RNA, 21 nt, Artificial Sequence
  Ebola virus siRNA sense strand
ccuuauuauucagauuaggcc

SEQ ID NO: 11003 - RNA, 21 nt, Artificial Sequence
  Ebola virus siRNA sense strand
cuuauuauucagauuaggccc

SEQ ID NO: 11004 - RNA, 21 nt, Artificial Sequence
  Ebola virus siRNA sense strand
uuauuauucagauuaggcccc

SEQ ID NO: 11005 - RNA, 21 nt, Artificial Sequence
  Ebola virus siRNA sense strand
uauuauucagauuaggcccca

SEQ ID NO: 11006 - RNA, 21 nt, Artificial Sequence
  Ebola virus siRNA sense strand
auuauucagauuaggccccaa

SEQ ID NO: 11007 - RNA, 21 nt, Artificial Sequence
  Ebola virus siRNA sense strand
uuauucagauuaggccccaag

SEQ ID NO: 11008 - RNA, 21 nt, Artificial Sequence
  Ebola virus siRNA sense strand
uauucagauuaggccccaaga

SEQ ID NO: 11009 - RNA, 21 nt, Artificial Sequence
  Ebola virus siRNA sense strand
auucagauuaggccccaagag

SEQ ID NO: 11010 - RNA, 21 nt, Artificial Sequence
  Ebola virus siRNA sense strand
uucagauuaggccccaagagg

SEQ ID NO: 11011 - RNA, 21 nt, Artificial Sequence
  Ebola virus siRNA sense strand
ucagauuaggccccaagaggc

SEQ ID NO: 11012 - RNA, 21 nt, Artificial Sequence
  Ebola virus siRNA sense strand
cagauuaggccccaagaggca

SEQ ID NO: 11013 - RNA, 21 nt, Artificial Sequence
  Ebola virus siRNA sense strand
agauuaggccccaagaggcau

SEQ ID NO: 11014 - RNA, 21 nt, Artificial Sequence
  Ebola virus siRNA sense strand
gauuaggccccaagaggcauu

SEQ ID NO: 11015 - RNA, 21 nt, Artificial Sequence
  Ebola virus siRNA sense strand
auuaggccccaagaggcauuc

SEQ ID NO: 11016 - RNA, 21 nt, Artificial Sequence
  Ebola virus siRNA sense strand
uuaggccccaagaggcauucu

SEQ ID NO: 11017 - RNA, 21 nt, Artificial Sequence
  Ebola virus siRNA sense strand
uaggccccaagaggcauucuu

SEQ ID NO: 11018 - RNA, 21 nt, Artificial Sequence
  Ebola virus siRNA sense strand
aggccccaagaggcauucuuc

SEQ ID NO: 11019 - RNA, 21 nt, Artificial Sequence
  Ebola virus siRNA sense strand
ggccccaagaggcauucuuca

SEQ ID NO: 11020 - RNA, 21 nt, Artificial Sequence
  Ebola virus siRNA sense strand
gccccaagaggcauucuucau

SEQ ID NO: 11021 - RNA, 21 nt, Artificial Sequence
  Ebola virus siRNA sense strand
ccccaagaggcauucuucauc

SEQ ID NO: 11022 - RNA, 21 nt, Artificial Sequence
  Ebola virus siRNA sense strand
cccaagaggcauucuucaucu

SEQ ID NO: 11023 - RNA, 21 nt, Artificial Sequence
  Ebola virus siRNA sense strand
ccaagaggcauucuucaucuc

SEQ ID NO: 11024 - RNA, 21 nt, Artificial Sequence
  Ebola virus siRNA sense strand
caagaggcauucuucaucucc

SEQ ID NO: 11025 - RNA, 21 nt, Artificial Sequence
  Ebola virus siRNA sense strand
aagaggcauucuucaucuccu

SEQ ID NO: 11026 - RNA, 21 nt, Artificial Sequence
  Ebola virus siRNA sense strand
agaggcauucuucaucuccuu

SEQ ID NO: 11027 - RNA, 21 nt, Artificial Sequence
  Ebola virus siRNA sense strand
gaggcauucuucaucuccuuu

SEQ ID NO: 11028 - RNA, 21 nt, Artificial Sequence
  Ebola virus siRNA sense strand
aggcauucuucaucuccuuuu

SEQ ID NO: 11029 - RNA, 21 nt, Artificial Sequence
  Ebola virus siRNA sense strand
ggcauucuucaucuccuuuua

SEQ ID NO: 11030 - RNA, 21 nt, Artificial Sequence
  Ebola virus siRNA sense strand
gcauucuucaucuccuuuuag

SEQ ID NO: 11031 - RNA, 21 nt, Artificial Sequence
  Ebola virus siRNA sense strand
cauucuucaucuccuuuuagc

SEQ ID NO: 11032 - RNA, 21 nt, Artificial Sequence
  Ebola virus siRNA sense strand
auucuucaucuccuuuuagca

SEQ ID NO: 11033 - RNA, 21 nt, Artificial Sequence
  Ebola virus siRNA sense strand
uucuucaucuccuuuuagcaa

SEQ ID NO: 11034 - RNA, 21 nt, Artificial Sequence
  Ebola virus siRNA sense strand
ucuucaucuccuuuuagcaaa

SEQ ID NO: 11035 - RNA, 21 nt, Artificial Sequence
  Ebola virus siRNA sense strand
cuucaucuccuuuuagcaaag

SEQ ID NO: 11036 - RNA, 21 nt, Artificial Sequence
  Ebola virus siRNA sense strand
uucaucuccuuuuagcaaagu

SEQ ID NO: 11037 - RNA, 21 nt, Artificial Sequence
  Ebola virus siRNA sense strand
ucaucuccuuuuagcaaagua

SEQ ID NO: 11038 - RNA, 21 nt, Artificial Sequence
  Ebola virus siRNA sense strand
caucuccuuuuagcaaaguac

SEQ ID NO: 11039 - RNA, 21 nt, Artificial Sequence
  Ebola virus siRNA sense strand
aucuccuuuuagcaaaguacu

SEQ ID NO: 11040 - RNA, 21 nt, Artificial Sequence
  Ebola virus siRNA sense strand
ucuccuuuuagcaaaguacua

SEQ ID NO: 11041 - RNA, 21 nt, Artificial Sequence
  Ebola virus siRNA sense strand
cuccuuuuagcaaaguacuau

SEQ ID NO: 11042 - RNA, 21 nt, Artificial Sequence
  Ebola virus siRNA sense strand
uccuuuuagcaaaguacuauu

SEQ ID NO: 11043 - RNA, 21 nt, Artificial Sequence
  Ebola virus siRNA sense strand
ccuuuuagcaaaguacuauuu

SEQ ID NO: 11044 - RNA, 21 nt, Artificial Sequence
  Ebola virus siRNA sense strand
cuuuuagcaaaguacuauuuc

SEQ ID NO: 11045 - RNA, 21 nt, Artificial Sequence
  Ebola virus siRNA sense strand
uuuuagcaaaguacuauuuca

SEQ ID NO: 11046 - RNA, 21 nt, Artificial Sequence
  Ebola virus siRNA sense strand
uuuagcaaaguacuauuucag

SEQ ID NO: 11047 - RNA, 21 nt, Artificial Sequence
  Ebola virus siRNA sense strand
uuagcaaaguacuauuucagg

SEQ ID NO: 11048 - RNA, 21 nt, Artificial Sequence
  Ebola virus siRNA sense strand
uagcaaaguacuauuucaggg

SEQ ID NO: 11049 - RNA, 21 nt, Artificial Sequence
  Ebola virus siRNA sense strand
agcaaaguacuauuucagggu

SEQ ID NO: 11050 - RNA, 21 nt, Artificial Sequence
  Ebola virus siRNA sense strand
gcaaaguacuauuucagggua

SEQ ID NO: 11051 - RNA, 21 nt, Artificial Sequence
  Ebola virus siRNA sense strand
caaaguacuauuucaggguag

SEQ ID NO: 11052 - RNA, 21 nt, Artificial Sequence
  Ebola virus siRNA sense strand
aaaguacuauuucaggguagu

SEQ ID NO: 11053 - RNA, 21 nt, Artificial Sequence
  Ebola virus siRNA sense strand
aaguacuauuucaggguaguc

SEQ ID NO: 11054 - RNA, 21 nt, Artificial Sequence
  Ebola virus siRNA sense strand
aguacuauuucaggguagucc

SEQ ID NO: 11055 - RNA, 21 nt, Artificial Sequence
  Ebola virus siRNA sense strand
guacuauuucaggguagucca

SEQ ID NO: 11056 - RNA, 21 nt, Artificial Sequence
  Ebola virus siRNA sense strand
uacuauuucaggguaguccaa

SEQ ID NO: 11057 - RNA, 21 nt, Artificial Sequence
  Ebola virus siRNA sense strand
acuauuucaggguaguccaau

SEQ ID NO: 11058 - RNA, 21 nt, Artificial Sequence
  Ebola virus siRNA sense strand
cuauuucaggguaguccaauu

SEQ ID NO: 11059 - RNA, 21 nt, Artificial Sequence
  Ebola virus siRNA sense strand
uauuucaggguaguccaauua

SEQ ID NO: 11060 - RNA, 21 nt, Artificial Sequence
  Ebola virus siRNA sense strand
auuucaggguaguccaauuag

SEQ ID NO: 11061 - RNA, 21 nt, Artificial Sequence
  Ebola virus siRNA sense strand
uuucaggguaguccaauuagu

SEQ ID NO: 11062 - RNA, 21 nt, Artificial Sequence
  Ebola virus siRNA sense strand
uucaggguaguccaauuagug

SEQ ID NO: 11063 - RNA, 21 nt, Artificial Sequence
  Ebola virus siRNA sense strand
ucaggguaguccaauuagugg

SEQ ID NO: 11064 - RNA, 21 nt, Artificial Sequence
  Ebola virus siRNA sense strand
caggguaguccaauuaguggc

SEQ ID NO: 11065 - RNA, 21 nt, Artificial Sequence
  Ebola virus siRNA sense strand
aggguaguccaauuaguggca

SEQ ID NO: 11066 - RNA, 21 nt, Artificial Sequence
  Ebola virus siRNA sense strand
ggguaguccaauuaguggcac

SEQ ID NO: 11067 - RNA, 21 nt, Artificial Sequence
  Ebola virus siRNA sense strand
gguaguccaauuaguggcacg

SEQ ID NO: 11068 - RNA, 21 nt, Artificial Sequence
  Ebola virus siRNA sense strand
guaguccaauuaguggcacgu

SEQ ID NO: 11069 - RNA, 21 nt, Artificial Sequence
  Ebola virus siRNA sense strand
uaguccaauuaguggcacguc

SEQ ID NO: 11070 - RNA, 21 nt, Artificial Sequence
  Ebola virus siRNA sense strand
aguccaauuaguggcacgucu

SEQ ID NO: 11071 - RNA, 21 nt, Artificial Sequence
  Ebola virus siRNA sense strand
guccaauuaguggcacgucuu

SEQ ID NO: 11072 - RNA, 21 nt, Artificial Sequence
  Ebola virus siRNA sense strand
uccaauuaguggcacgucuuu

SEQ ID NO: 11073 - RNA, 21 nt, Artificial Sequence
  Ebola virus siRNA sense strand
ccaauuaguggcacgucuuuu

SEQ ID NO: 11074 - RNA, 21 nt, Artificial Sequence
  Ebola virus siRNA sense strand
caauuaguggcacgucuuuua

SEQ ID NO: 11075 - RNA, 21 nt, Artificial Sequence
  Ebola virus siRNA sense strand
aauuaguggcacgucuuuuag

SEQ ID NO: 11076 - RNA, 21 nt, Artificial Sequence
  Ebola virus siRNA sense strand
auuaguggcacgucuuuuagc

SEQ ID NO: 11077 - RNA, 21 nt, Artificial Sequence
  Ebola virus siRNA sense strand
uuaguggcacgucuuuuagcu

SEQ ID NO: 11078 - RNA, 21 nt, Artificial Sequence
  Ebola virus siRNA sense strand
uaguggcacgucuuuuagcug

SEQ ID NO: 11079 - RNA, 21 nt, Artificial Sequence
  Ebola virus siRNA sense strand
aguggcacgucuuuuagcugu

SEQ ID NO: 11080 - RNA, 21 nt, Artificial Sequence
  Ebola virus siRNA sense strand
guggcacgucuuuuagcugua

SEQ ID NO: 11081 - RNA, 21 nt, Artificial Sequence
  Ebola virus siRNA sense strand
uggcacgucuuuuagcuguau

SEQ ID NO: 11082 - RNA, 21 nt, Artificial Sequence
  Ebola virus siRNA sense strand
ggcacgucuuuuagcuguaua

SEQ ID NO: 11083 - RNA, 21 nt, Artificial Sequence
  Ebola virus siRNA sense strand
gcacgucuuuuagcuguauau

SEQ ID NO: 11084 - RNA, 21 nt, Artificial Sequence
  Ebola virus siRNA sense strand
cacgucuuuuagcuguauauc

SEQ ID NO: 11085 - RNA, 21 nt, Artificial Sequence
  Ebola virus siRNA sense strand
acgucuuuuagcuguauauca

SEQ ID NO: 11086 - RNA, 21 nt, Artificial Sequence
  Ebola virus siRNA sense strand
cgucuuuuagcuguauaucag

SEQ ID NO: 11087 - RNA, 21 nt, Artificial Sequence
  Ebola virus siRNA sense strand
gucuuuuagcuguauaucagu

SEQ ID NO: 11088 - RNA, 21 nt, Artificial Sequence
  Ebola virus siRNA sense strand
ucuuuuagcuguauaucaguc

SEQ ID NO: 11089 - RNA, 21 nt, Artificial Sequence
  Ebola virus siRNA sense strand
cuuuuagcuguauaucagucg

SEQ ID NO: 11090 - RNA, 21 nt, Artificial Sequence
  Ebola virus siRNA sense strand
uuuuagcuguauaucagucgc

SEQ ID NO: 11091 - RNA, 21 nt, Artificial Sequence
  Ebola virus siRNA sense strand
uuuagcuguauaucagucgcc

SEQ ID NO: 11092 - RNA, 21 nt, Artificial Sequence
  Ebola virus siRNA sense strand
uuagcuguauaucagucgccc

SEQ ID NO: 11093 - RNA, 21 nt, Artificial Sequence
  Ebola virus siRNA sense strand
uagcuguauaucagucgcccc

SEQ ID NO: 11094 - RNA, 21 nt, Artificial Sequence
  Ebola virus siRNA sense strand
agcuguauaucagucgccccu

SEQ ID NO: 11095 - RNA, 21 nt, Artificial Sequence
  Ebola virus siRNA sense strand
gcuguauaucagucgccccug

SEQ ID NO: 11096 - RNA, 21 nt, Artificial Sequence
  Ebola virus siRNA sense strand
cuguauaucagucgccccuga

SEQ ID NO: 11097 - RNA, 21 nt, Artificial Sequence
  Ebola virus siRNA sense strand
uguauaucagucgccccugag

SEQ ID NO: 11098 - RNA, 21 nt, Artificial Sequence
  Ebola virus siRNA sense strand
guauaucagucgccccugaga

SEQ ID NO: 11099 - RNA, 21 nt, Artificial Sequence
  Ebola virus siRNA sense strand
uauaucagucgccccugagau

SEQ ID NO: 11100 - RNA, 21 nt, Artificial Sequence
  Ebola virus siRNA sense strand
auaucagucgccccugagaua

SEQ ID NO: 11101 - RNA, 21 nt, Artificial Sequence
  Ebola virus siRNA sense strand
uaucagucgccccugagauac

SEQ ID NO: 11102 - RNA, 21 nt, Artificial Sequence
  Ebola virus siRNA sense strand
aucagucgccccugagauacg

SEQ ID NO: 11103 - RNA, 21 nt, Artificial Sequence
  Ebola virus siRNA sense strand
ucagucgccccugagauacgc

SEQ ID NO: 11104 - RNA, 21 nt, Artificial Sequence
  Ebola virus siRNA sense strand
cagucgccccugagauacgcc

SEQ ID NO: 11105 - RNA, 21 nt, Artificial Sequence
  Ebola virus siRNA sense strand
agucgccccugagauacgcca

SEQ ID NO: 11106 - RNA, 21 nt, Artificial Sequence
  Ebola virus siRNA sense strand
gucgccccugagauacgccac

SEQ ID NO: 11107 - RNA, 21 nt, Artificial Sequence
  Ebola virus siRNA sense strand
ucgccccugagauacgccaca

SEQ ID NO: 11108 - RNA, 21 nt, Artificial Sequence
  Ebola virus siRNA sense strand
cgccccugagauacgccacaa

SEQ ID NO: 11109 - RNA, 21 nt, Artificial Sequence
  Ebola virus siRNA sense strand
gccccugagauacgccacaaa

SEQ ID NO: 11110 - RNA, 21 nt, Artificial Sequence
  Ebola virus siRNA sense strand
ccccugagauacgccacaaaa

SEQ ID NO: 11111 - RNA, 21 nt, Artificial Sequence
  Ebola virus siRNA sense strand
cccugagauacgccacaaaag

SEQ ID NO: 11112 - RNA, 21 nt, Artificial Sequence
  Ebola virus siRNA sense strand
ccugagauacgccacaaaagu

SEQ ID NO: 11113 - RNA, 21 nt, Artificial Sequence
  Ebola virus siRNA sense strand
cugagauacgccacaaaagug

SEQ ID NO: 11114 - RNA, 21 nt, Artificial Sequence
  Ebola virus siRNA sense strand
ugagauacgccacaaaagugu

SEQ ID NO: 11115 - RNA, 21 nt, Artificial Sequence
  Ebola virus siRNA sense strand
gagauacgccacaaaaguguc

SEQ ID NO: 11116 - RNA, 21 nt, Artificial Sequence
  Ebola virus siRNA sense strand
agauacgccacaaaagugucu

SEQ ID NO: 11117 - RNA, 21 nt, Artificial Sequence
  Ebola virus siRNA sense strand
gauacgccacaaaagugucuc

SEQ ID NO: 11118 - RNA, 21 nt, Artificial Sequence
  Ebola virus siRNA sense strand
auacgccacaaaagugucucu

SEQ ID NO: 11119 - RNA, 21 nt, Artificial Sequence
  Ebola virus siRNA sense strand
uacgccacaaaagugucucua

SEQ ID NO: 11120 - RNA, 21 nt, Artificial Sequence
  Ebola virus siRNA sense strand
acgccacaaaagugucucuaa

SEQ ID NO: 11121 - RNA, 21 nt, Artificial Sequence
  Ebola virus siRNA sense strand
cgccacaaaagugucucuaag

SEQ ID NO: 11122 - RNA, 21 nt, Artificial Sequence
  Ebola virus siRNA sense strand
gccacaaaagugucucuaagc

SEQ ID NO: 11123 - RNA, 21 nt, Artificial Sequence
  Ebola virus siRNA sense strand
ccacaaaagugucucuaagcu

SEQ ID NO: 11124 - RNA, 21 nt, Artificial Sequence
  Ebola virus siRNA sense strand
cacaaaagugucucuaagcua

SEQ ID NO: 11125 - RNA, 21 nt, Artificial Sequence
  Ebola virus siRNA sense strand
acaaaagugucucuaagcuaa

SEQ ID NO: 11126 - RNA, 21 nt, Artificial Sequence
  Ebola virus siRNA sense strand
caaaagugucucuaagcuaaa

SEQ ID NO: 11127 - RNA, 21 nt, Artificial Sequence
  Ebola virus siRNA sense strand
aaaagugucucuaagcuaaau

SEQ ID NO: 11128 - RNA, 21 nt, Artificial Sequence
  Ebola virus siRNA sense strand
aaagugucucuaagcuaaauu

SEQ ID NO: 11129 - RNA, 21 nt, Artificial Sequence
  Ebola virus siRNA sense strand
aagugucucuaagcuaaauug

SEQ ID NO: 11130 - RNA, 21 nt, Artificial Sequence
  Ebola virus siRNA sense strand
agugucucuaagcuaaauugg

SEQ ID NO: 11131 - RNA, 21 nt, Artificial Sequence
  Ebola virus siRNA sense strand
gugucucuaagcuaaauuggu

SEQ ID NO: 11132 - RNA, 21 nt, Artificial Sequence
  Ebola virus siRNA sense strand
ugucucuaagcuaaauugguc

SEQ ID NO: 11133 - RNA, 21 nt, Artificial Sequence
  Ebola virus siRNA sense strand
gucucuaagcuaaauuggucu

SEQ ID NO: 11134 - RNA, 21 nt, Artificial Sequence
  Ebola virus siRNA sense strand
ucucuaagcuaaauuggucug

SEQ ID NO: 11135 - RNA, 21 nt, Artificial Sequence
  Ebola virus siRNA sense strand
cucuaagcuaaauuggucugu

SEQ ID NO: 11136 - RNA, 21 nt, Artificial Sequence
  Ebola virus siRNA sense strand
ucuaagcuaaauuggucugua

SEQ ID NO: 11137 - RNA, 21 nt, Artificial Sequence
  Ebola virus siRNA sense strand
cuaagcuaaauuggucuguac

SEQ ID NO: 11138 - RNA, 21 nt, Artificial Sequence
  Ebola virus siRNA sense strand
uaagcuaaauuggucuguaca

SEQ ID NO: 11139 - RNA, 21 nt, Artificial Sequence
  Ebola virus siRNA sense strand
aagcuaaauuggucuguacac

SEQ ID NO: 11140 - RNA, 21 nt, Artificial Sequence
  Ebola virus siRNA sense strand
agcuaaauuggucuguacaca

SEQ ID NO: 11141 - RNA, 21 nt, Artificial Sequence
  Ebola virus siRNA sense strand
gcuaaauuggucuguacacau

SEQ ID NO: 11142 - RNA, 21 nt, Artificial Sequence
  Ebola virus siRNA sense strand
cuaaauuggucuguacacauc

SEQ ID NO: 11143 - RNA, 21 nt, Artificial Sequence
  Ebola virus siRNA sense strand
uaaauuggucuguacacaucc

SEQ ID NO: 11144 - RNA, 21 nt, Artificial Sequence
  Ebola virus siRNA sense strand
aaauuggucuguacacauccc

SEQ ID NO: 11145 - RNA, 21 nt, Artificial Sequence
  Ebola virus siRNA sense strand
aauuggucuguacacauccca

SEQ ID NO: 11146 - RNA, 21 nt, Artificial Sequence
  Ebola virus siRNA sense strand
auuggucuguacacaucccau

SEQ ID NO: 11147 - RNA, 21 nt, Artificial Sequence
  Ebola virus siRNA sense strand
uuggucuguacacaucccaua

SEQ ID NO: 11148 - RNA, 21 nt, Artificial Sequence
  Ebola virus siRNA sense strand
uggucuguacacaucccauac

SEQ ID NO: 11149 - RNA, 21 nt, Artificial Sequence
  Ebola virus siRNA sense strand
ggucuguacacaucccauaca

SEQ ID NO: 11150 - RNA, 21 nt, Artificial Sequence
  Ebola virus siRNA sense strand
gucuguacacaucccauacau

SEQ ID NO: 11151 - RNA, 21 nt, Artificial Sequence
  Ebola virus siRNA sense strand
ucuguacacaucccauacauu

SEQ ID NO: 11152 - RNA, 21 nt, Artificial Sequence
  Ebola virus siRNA sense strand
cuguacacaucccauacauug

SEQ ID NO: 11153 - RNA, 21 nt, Artificial Sequence
  Ebola virus siRNA sense strand
uguacacaucccauacauugu

SEQ ID NO: 11154 - RNA, 21 nt, Artificial Sequence
  Ebola virus siRNA sense strand
guacacaucccauacauugua

SEQ ID NO: 11155 - RNA, 21 nt, Artificial Sequence
  Ebola virus siRNA sense strand
uacacaucccauacauuguau

SEQ ID NO: 11156 - RNA, 21 nt, Artificial Sequence
  Ebola virus siRNA sense strand
acacaucccauacauuguauu

SEQ ID NO: 11157 - RNA, 21 nt, Artificial Sequence
  Ebola virus siRNA sense strand
cacaucccauacauuguauua

SEQ ID NO: 11158 - RNA, 21 nt, Artificial Sequence
  Ebola virus siRNA sense strand
acaucccauacauuguauuag

SEQ ID NO: 11159 - RNA, 21 nt, Artificial Sequence
  Ebola virus siRNA sense strand
caucccauacauuguauuagg

SEQ ID NO: 11160 - RNA, 21 nt, Artificial Sequence
  Ebola virus siRNA sense strand
aucccauacauuguauuaggg

SEQ ID NO: 11161 - RNA, 21 nt, Artificial Sequence
  Ebola virus siRNA sense strand
ucccauacauuguauuagggg

SEQ ID NO: 11162 - RNA, 21 nt, Artificial Sequence
  Ebola virus siRNA sense strand
cccauacauuguauuaggggc

SEQ ID NO: 11163 - RNA, 21 nt, Artificial Sequence
  Ebola virus siRNA sense strand
ccauacauuguauuaggggca

SEQ ID NO: 11164 - RNA, 21 nt, Artificial Sequence
  Ebola virus siRNA sense strand
cauacauuguauuaggggcaa

SEQ ID NO: 11165 - RNA, 21 nt, Artificial Sequence
  Ebola virus siRNA sense strand
auacauuguauuaggggcaau

SEQ ID NO: 11166 - RNA, 21 nt, Artificial Sequence
  Ebola virus siRNA sense strand
uacauuguauuaggggcaaua

SEQ ID NO: 11167 - RNA, 21 nt, Artificial Sequence
  Ebola virus siRNA sense strand
acauuguauuaggggcaauaa

SEQ ID NO: 11168 - RNA, 21 nt, Artificial Sequence
  Ebola virus siRNA sense strand
cauuguauuaggggcaauaau

SEQ ID NO: 11169 - RNA, 21 nt, Artificial Sequence
  Ebola virus siRNA sense strand
auuguauuaggggcaauaaua

SEQ ID NO: 11170 - RNA, 21 nt, Artificial Sequence
  Ebola virus siRNA sense strand
uuguauuaggggcaauaauau

SEQ ID NO: 11171 - RNA, 21 nt, Artificial Sequence
  Ebola virus siRNA sense strand
uguauuaggggcaauaauauc

SEQ ID NO: 11172 - RNA, 21 nt, Artificial Sequence
  Ebola virus siRNA sense strand
guauuaggggcaauaauaucu

SEQ ID NO: 11173 - RNA, 21 nt, Artificial Sequence
  Ebola virus siRNA sense strand
uauuaggggcaauaauaucua

SEQ ID NO: 11174 - RNA, 21 nt, Artificial Sequence
  Ebola virus siRNA sense strand
auuaggggcaauaauaucuaa

SEQ ID NO: 11175 - RNA, 21 nt, Artificial Sequence
  Ebola virus siRNA sense strand
uuaggggcaauaauaucuaau

SEQ ID NO: 11176 - RNA, 21 nt, Artificial Sequence
  Ebola virus siRNA sense strand
uaggggcaauaauaucuaauu

SEQ ID NO: 11177 - RNA, 21 nt, Artificial Sequence
  Ebola virus siRNA sense strand
aggggcaauaauaucuaauug

SEQ ID NO: 11178 - RNA, 21 nt, Artificial Sequence
  Ebola virus siRNA sense strand
ggggcaauaauaucuaauuga

SEQ ID NO: 11179 - RNA, 21 nt, Artificial Sequence
  Ebola virus siRNA sense strand
gggcaauaauaucuaauugaa

SEQ ID NO: 11180 - RNA, 21 nt, Artificial Sequence
  Ebola virus siRNA sense strand
ggcaauaauaucuaauugaac

SEQ ID NO: 11181 - RNA, 21 nt, Artificial Sequence
  Ebola virus siRNA sense strand
gcaauaauaucuaauugaacu

SEQ ID NO: 11182 - RNA, 21 nt, Artificial Sequence
  Ebola virus siRNA sense strand
caauaauaucuaauugaacuu

SEQ ID NO: 11183 - RNA, 21 nt, Artificial Sequence
  Ebola virus siRNA sense strand
aauaauaucuaauugaacuua

SEQ ID NO: 11184 - RNA, 21 nt, Artificial Sequence
  Ebola virus siRNA sense strand
auaauaucuaauugaacuuag

SEQ ID NO: 11185 - RNA, 21 nt, Artificial Sequence
  Ebola virus siRNA sense strand
uaauaucuaauugaacuuagc

SEQ ID NO: 11186 - RNA, 21 nt, Artificial Sequence
  Ebola virus siRNA sense strand
aauaucuaauugaacuuagcc

SEQ ID NO: 11187 - RNA, 21 nt, Artificial Sequence
  Ebola virus siRNA sense strand
auaucuaauugaacuuagccg

SEQ ID NO: 11188 - RNA, 21 nt, Artificial Sequence
  Ebola virus siRNA sense strand
uaucuaauugaacuuagccgu

SEQ ID NO: 11189 - RNA, 21 nt, Artificial Sequence
  Ebola virus siRNA sense strand
aucuaauugaacuuagccguu

SEQ ID NO: 11190 - RNA, 21 nt, Artificial Sequence
  Ebola virus siRNA sense strand
ucuaauugaacuuagccguuu

SEQ ID NO: 11191 - RNA, 21 nt, Artificial Sequence
  Ebola virus siRNA sense strand
cuaauugaacuuagccguuua

SEQ ID NO: 11192 - RNA, 21 nt, Artificial Sequence
  Ebola virus siRNA sense strand
uaauugaacuuagccguuuaa

SEQ ID NO: 11193 - RNA, 21 nt, Artificial Sequence
  Ebola virus siRNA sense strand
aauugaacuuagccguuuaaa

SEQ ID NO: 11194 - RNA, 21 nt, Artificial Sequence
  Ebola virus siRNA sense strand
auugaacuuagccguuuaaaa

SEQ ID NO: 11195 - RNA, 21 nt, Artificial Sequence
  Ebola virus siRNA sense strand
uugaacuuagccguuuaaaau

SEQ ID NO: 11196 - RNA, 21 nt, Artificial Sequence
  Ebola virus siRNA sense strand
ugaacuuagccguuuaaaauu

SEQ ID NO: 11197 - RNA, 21 nt, Artificial Sequence
  Ebola virus siRNA sense strand
gaacuuagccguuuaaaauuu

SEQ ID NO: 11198 - RNA, 21 nt, Artificial Sequence
  Ebola virus siRNA sense strand
aacuuagccguuuaaaauuua

SEQ ID NO: 11199 - RNA, 21 nt, Artificial Sequence
  Ebola virus siRNA sense strand
acuuagccguuuaaaauuuag

SEQ ID NO: 11200 - RNA, 21 nt, Artificial Sequence
  Ebola virus siRNA sense strand
cuuagccguuuaaaauuuagu

SEQ ID NO: 11201 - RNA, 21 nt, Artificial Sequence
  Ebola virus siRNA sense strand
uuagccguuuaaaauuuagug

SEQ ID NO: 11202 - RNA, 21 nt, Artificial Sequence
  Ebola virus siRNA sense strand
uagccguuuaaaauuuagugc

SEQ ID NO: 11203 - RNA, 21 nt, Artificial Sequence
  Ebola virus siRNA sense strand
agccguuuaaaauuuagugca

SEQ ID NO: 11204 - RNA, 21 nt, Artificial Sequence
  Ebola virus siRNA sense strand
gccguuuaaaauuuagugcau

SEQ ID NO: 11205 - RNA, 21 nt, Artificial Sequence
  Ebola virus siRNA sense strand
ccguuuaaaauuuagugcaua

SEQ ID NO: 11206 - RNA, 21 nt, Artificial Sequence
  Ebola virus siRNA sense strand
cguuuaaaauuuagugcauaa

SEQ ID NO: 11207 - RNA, 21 nt, Artificial Sequence
  Ebola virus siRNA sense strand
guuuaaaauuuagugcauaaa

SEQ ID NO: 11208 - RNA, 21 nt, Artificial Sequence
  Ebola virus siRNA sense strand
uuuaaaauuuagugcauaaau

SEQ ID NO: 11209 - RNA, 21 nt, Artificial Sequence
  Ebola virus siRNA sense strand
uuaaaauuuagugcauaaauc

SEQ ID NO: 11210 - RNA, 21 nt, Artificial Sequence
  Ebola virus siRNA sense strand
uaaaauuuagugcauaaaucu

SEQ ID NO: 11211 - RNA, 21 nt, Artificial Sequence
  Ebola virus siRNA sense strand
aaaauuuagugcauaaaucug

SEQ ID NO: 11212 - RNA, 21 nt, Artificial Sequence
  Ebola virus siRNA sense strand
aaauuuagugcauaaaucugg

SEQ ID NO: 11213 - RNA, 21 nt, Artificial Sequence
  Ebola virus siRNA sense strand
aauuuagugcauaaaucuggg

SEQ ID NO: 11214 - RNA, 21 nt, Artificial Sequence
  Ebola virus siRNA sense strand
auuuagugcauaaaucugggc

SEQ ID NO: 11215 - RNA, 21 nt, Artificial Sequence
  Ebola virus siRNA sense strand
uuuagugcauaaaucugggcu

SEQ ID NO: 11216 - RNA, 21 nt, Artificial Sequence
  Ebola virus siRNA sense strand
uuagugcauaaaucugggcua

SEQ ID NO: 11217 - RNA, 21 nt, Artificial Sequence
  Ebola virus siRNA sense strand
uagugcauaaaucugggcuaa

SEQ ID NO: 11218 - RNA, 21 nt, Artificial Sequence
  Ebola virus siRNA sense strand
agugcauaaaucugggcuaac

SEQ ID NO: 11219 - RNA, 21 nt, Artificial Sequence
  Ebola virus siRNA sense strand
gugcauaaaucugggcuaaca

SEQ ID NO: 11220 - RNA, 21 nt, Artificial Sequence
  Ebola virus siRNA sense strand
ugcauaaaucugggcuaacac

SEQ ID NO: 11221 - RNA, 21 nt, Artificial Sequence
  Ebola virus siRNA sense strand
gcauaaaucugggcuaacacc

SEQ ID NO: 11222 - RNA, 21 nt, Artificial Sequence
  Ebola virus siRNA sense strand
cauaaaucugggcuaacacca

SEQ ID NO: 11223 - RNA, 21 nt, Artificial Sequence
  Ebola virus siRNA sense strand
auaaaucugggcuaacaccac

SEQ ID NO: 11224 - RNA, 21 nt, Artificial Sequence
  Ebola virus siRNA sense strand
uaaaucugggcuaacaccacc

SEQ ID NO: 11225 - RNA, 21 nt, Artificial Sequence
  Ebola virus siRNA sense strand
aaaucugggcuaacaccacca

SEQ ID NO: 11226 - RNA, 21 nt, Artificial Sequence
  Ebola virus siRNA sense strand
aaucugggcuaacaccaccag

SEQ ID NO: 11227 - RNA, 21 nt, Artificial Sequence
  Ebola virus siRNA sense strand
aucugggcuaacaccaccagg

SEQ ID NO: 11228 - RNA, 21 nt, Artificial Sequence
  Ebola virus siRNA sense strand
ucugggcuaacaccaccaggu

SEQ ID NO: 11229 - RNA, 21 nt, Artificial Sequence
  Ebola virus siRNA sense strand
cugggcuaacaccaccagguc

SEQ ID NO: 11230 - RNA, 21 nt, Artificial Sequence
  Ebola virus siRNA sense strand
ugggcuaacaccaccagguca

SEQ ID NO: 11231 - RNA, 21 nt, Artificial Sequence
  Ebola virus siRNA sense strand
gggcuaacaccaccaggucaa

SEQ ID NO: 11232 - RNA, 21 nt, Artificial Sequence
  Ebola virus siRNA sense strand
ggcuaacaccaccaggucaac

SEQ ID NO: 11233 - RNA, 21 nt, Artificial Sequence
  Ebola virus siRNA sense strand
gcuaacaccaccaggucaacu

SEQ ID NO: 11234 - RNA, 21 nt, Artificial Sequence
  Ebola virus siRNA sense strand
cuaacaccaccaggucaacuc

SEQ ID NO: 11235 - RNA, 21 nt, Artificial Sequence
  Ebola virus siRNA sense strand
uaacaccaccaggucaacucc

SEQ ID NO: 11236 - RNA, 21 nt, Artificial Sequence
  Ebola virus siRNA sense strand
aacaccaccaggucaacucca

SEQ ID NO: 11237 - RNA, 21 nt, Artificial Sequence
  Ebola virus siRNA sense strand
acaccaccaggucaacuccau

SEQ ID NO: 11238 - RNA, 21 nt, Artificial Sequence
  Ebola virus siRNA sense strand
caccaccaggucaacuccauu

SEQ ID NO: 11239 - RNA, 21 nt, Artificial Sequence
  Ebola virus siRNA sense strand
accaccaggucaacuccauug

SEQ ID NO: 11240 - RNA, 21 nt, Artificial Sequence
  Ebola virus siRNA sense strand
ccaccaggucaacuccauugg

SEQ ID NO: 11241 - RNA, 21 nt, Artificial Sequence
  Ebola virus siRNA sense strand
caccaggucaacuccauuggc

SEQ ID NO: 11242 - RNA, 21 nt, Artificial Sequence
  Ebola virus siRNA sense strand
accaggucaacuccauuggcu

SEQ ID NO: 11243 - RNA, 21 nt, Artificial Sequence
  Ebola virus siRNA sense strand
ccaggucaacuccauuggcug

SEQ ID NO: 11244 - RNA, 21 nt, Artificial Sequence
  Ebola virus siRNA sense strand
caggucaacuccauuggcuga

SEQ ID NO: 11245 - RNA, 21 nt, Artificial Sequence
  Ebola virus siRNA sense strand
aggucaacuccauuggcugaa

SEQ ID NO: 11246 - RNA, 21 nt, Artificial Sequence
  Ebola virus siRNA sense strand
ggucaacuccauuggcugaaa

SEQ ID NO: 11247 - RNA, 21 nt, Artificial Sequence
  Ebola virus siRNA sense strand
gucaacuccauuggcugaaaa

SEQ ID NO: 11248 - RNA, 21 nt, Artificial Sequence
  Ebola virus siRNA sense strand
ucaacuccauuggcugaaaag

SEQ ID NO: 11249 - RNA, 21 nt, Artificial Sequence
  Ebola virus siRNA sense strand
caacuccauuggcugaaaaga

SEQ ID NO: 11250 - RNA, 21 nt, Artificial Sequence
  Ebola virus siRNA sense strand
aacuccauuggcugaaaagaa

SEQ ID NO: 11251 - RNA, 21 nt, Artificial Sequence
  Ebola virus siRNA sense strand
acuccauuggcugaaaagaag

SEQ ID NO: 11252 - RNA, 21 nt, Artificial Sequence
  Ebola virus siRNA sense strand
cuccauuggcugaaaagaagc

SEQ ID NO: 11253 - RNA, 21 nt, Artificial Sequence
  Ebola virus siRNA sense strand
uccauuggcugaaaagaagcu

SEQ ID NO: 11254 - RNA, 21 nt, Artificial Sequence
  Ebola virus siRNA sense strand
ccauuggcugaaaagaagcuu

SEQ ID NO: 11255 - RNA, 21 nt, Artificial Sequence
  Ebola virus siRNA sense strand
cauuggcugaaaagaagcuua

SEQ ID NO: 11256 - RNA, 21 nt, Artificial Sequence
  Ebola virus siRNA sense strand
auuggcugaaaagaagcuuac

SEQ ID NO: 11257 - RNA, 21 nt, Artificial Sequence
  Ebola virus siRNA sense strand
uuggcugaaaagaagcuuacc

SEQ ID NO: 11258 - RNA, 21 nt, Artificial Sequence
  Ebola virus siRNA sense strand
uggcugaaaagaagcuuaccu

SEQ ID NO: 11259 - RNA, 21 nt, Artificial Sequence
  Ebola virus siRNA sense strand
ggcugaaaagaagcuuaccua

SEQ ID NO: 11260 - RNA, 21 nt, Artificial Sequence
  Ebola virus siRNA sense strand
gcugaaaagaagcuuaccuac

SEQ ID NO: 11261 - RNA, 21 nt, Artificial Sequence
  Ebola virus siRNA sense strand
cugaaaagaagcuuaccuaca

SEQ ID NO: 11262 - RNA, 21 nt, Artificial Sequence
  Ebola virus siRNA sense strand
ugaaaagaagcuuaccuacaa

SEQ ID NO: 11263 - RNA, 21 nt, Artificial Sequence
  Ebola virus siRNA sense strand
gaaaagaagcuuaccuacaac

SEQ ID NO: 11264 - RNA, 21 nt, Artificial Sequence
  Ebola virus siRNA sense strand
aaaagaagcuuaccuacaacg

SEQ ID NO: 11265 - RNA, 21 nt, Artificial Sequence
  Ebola virus siRNA sense strand
aaagaagcuuaccuacaacga

SEQ ID NO: 11266 - RNA, 21 nt, Artificial Sequence
  Ebola virus siRNA sense strand
aagaagcuuaccuacaacgaa

SEQ ID NO: 11267 - RNA, 21 nt, Artificial Sequence
  Ebola virus siRNA sense strand
agaagcuuaccuacaacgaac

SEQ ID NO: 11268 - RNA, 21 nt, Artificial Sequence
  Ebola virus siRNA sense strand
gaagcuuaccuacaacgaaca

SEQ ID NO: 11269 - RNA, 21 nt, Artificial Sequence
  Ebola virus siRNA sense strand
aagcuuaccuacaacgaacau

SEQ ID NO: 11270 - RNA, 21 nt, Artificial Sequence
  Ebola virus siRNA sense strand
agcuuaccuacaacgaacauc

SEQ ID NO: 11271 - RNA, 21 nt, Artificial Sequence
  Ebola virus siRNA sense strand
gcuuaccuacaacgaacauca

SEQ ID NO: 11272 - RNA, 21 nt, Artificial Sequence
  Ebola virus siRNA sense strand
cuuaccuacaacgaacaucac

SEQ ID NO: 11273 - RNA, 21 nt, Artificial Sequence
  Ebola virus siRNA sense strand
uuaccuacaacgaacaucacu

SEQ ID NO: 11274 - RNA, 21 nt, Artificial Sequence
  Ebola virus siRNA sense strand
uaccuacaacgaacaucacuu

SEQ ID NO: 11275 - RNA, 21 nt, Artificial Sequence
  Ebola virus siRNA sense strand
accuacaacgaacaucacuuu

SEQ ID NO: 11276 - RNA, 21 nt, Artificial Sequence
  Ebola virus siRNA sense strand
ccuacaacgaacaucacuuug

SEQ ID NO: 11277 - RNA, 21 nt, Artificial Sequence
  Ebola virus siRNA sense strand
cuacaacgaacaucacuuuga

SEQ ID NO: 11278 - RNA, 21 nt, Artificial Sequence
  Ebola virus siRNA sense strand
uacaacgaacaucacuuugag

SEQ ID NO: 11279 - RNA, 21 nt, Artificial Sequence
  Ebola virus siRNA sense strand
acaacgaacaucacuuugagc

SEQ ID NO: 11280 - RNA, 21 nt, Artificial Sequence
  Ebola virus siRNA sense strand
caacgaacaucacuuugagcg

SEQ ID NO: 11281 - RNA, 21 nt, Artificial Sequence
  Ebola virus siRNA sense strand
aacgaacaucacuuugagcgc

SEQ ID NO: 11282 - RNA, 21 nt, Artificial Sequence
  Ebola virus siRNA sense strand
acgaacaucacuuugagcgcc

SEQ ID NO: 11283 - RNA, 21 nt, Artificial Sequence
  Ebola virus siRNA sense strand
cgaacaucacuuugagcgccc

SEQ ID NO: 11284 - RNA, 21 nt, Artificial Sequence
  Ebola virus siRNA sense strand
gaacaucacuuugagcgcccu

SEQ ID NO: 11285 - RNA, 21 nt, Artificial Sequence
  Ebola virus siRNA sense strand
aacaucacuuugagcgcccuc

SEQ ID NO: 11286 - RNA, 21 nt, Artificial Sequence
  Ebola virus siRNA sense strand
acaucacuuugagcgcccuca

SEQ ID NO: 11287 - RNA, 21 nt, Artificial Sequence
  Ebola virus siRNA sense strand
caucacuuugagcgcccucac

SEQ ID NO: 11288 - RNA, 21 nt, Artificial Sequence
  Ebola virus siRNA sense strand
aucacuuugagcgcccucaca

SEQ ID NO: 11289 - RNA, 21 nt, Artificial Sequence
  Ebola virus siRNA sense strand
ucacuuugagcgcccucacaa

SEQ ID NO: 11290 - RNA, 21 nt, Artificial Sequence
  Ebola virus siRNA sense strand
cacuuugagcgcccucacaau

SEQ ID NO: 11291 - RNA, 21 nt, Artificial Sequence
  Ebola virus siRNA sense strand
acuuugagcgcccucacaauu

SEQ ID NO: 11292 - RNA, 21 nt, Artificial Sequence
  Ebola virus siRNA sense strand
cuuugagcgcccucacaauua

SEQ ID NO: 11293 - RNA, 21 nt, Artificial Sequence
  Ebola virus siRNA sense strand
uuugagcgcccucacaauuaa

SEQ ID NO: 11294 - RNA, 21 nt, Artificial Sequence
  Ebola virus siRNA sense strand
uugagcgcccucacaauuaaa

SEQ ID NO: 11295 - RNA, 21 nt, Artificial Sequence
  Ebola virus siRNA sense strand
ugagcgcccucacaauuaaaa

SEQ ID NO: 11296 - RNA, 21 nt, Artificial Sequence
  Ebola virus siRNA sense strand
gagcgcccucacaauuaaaaa

SEQ ID NO: 11297 - RNA, 21 nt, Artificial Sequence
  Ebola virus siRNA sense strand
agcgcccucacaauuaaaaaa

SEQ ID NO: 11298 - RNA, 21 nt, Artificial Sequence
  Ebola virus siRNA sense strand
gcgcccucacaauuaaaaaau

SEQ ID NO: 11299 - RNA, 21 nt, Artificial Sequence
  Ebola virus siRNA sense strand
cgcccucacaauuaaaaaaua

SEQ ID NO: 11300 - RNA, 21 nt, Artificial Sequence
  Ebola virus siRNA sense strand
gcccucacaauuaaaaaauag

SEQ ID NO: 11301 - RNA, 21 nt, Artificial Sequence
  Ebola virus siRNA sense strand
cccucacaauuaaaaaauagg

SEQ ID NO: 11302 - RNA, 21 nt, Artificial Sequence
  Ebola virus siRNA sense strand
ccucacaauuaaaaaauagga

SEQ ID NO: 11303 - RNA, 21 nt, Artificial Sequence
  Ebola virus siRNA sense strand
cucacaauuaaaaaauaggaa

SEQ ID NO: 11304 - RNA, 21 nt, Artificial Sequence
  Ebola virus siRNA sense strand
ucacaauuaaaaaauaggaac

SEQ ID NO: 11305 - RNA, 21 nt, Artificial Sequence
  Ebola virus siRNA sense strand
cacaauuaaaaaauaggaacg

SEQ ID NO: 11306 - RNA, 21 nt, Artificial Sequence
  Ebola virus siRNA sense strand
acaauuaaaaaauaggaacgu

SEQ ID NO: 11307 - RNA, 21 nt, Artificial Sequence
  Ebola virus siRNA sense strand
caauuaaaaaauaggaacguc

SEQ ID NO: 11308 - RNA, 21 nt, Artificial Sequence
  Ebola virus siRNA sense strand
aauuaaaaaauaggaacgucg

SEQ ID NO: 11309 - RNA, 21 nt, Artificial Sequence
  Ebola virus siRNA sense strand
auuaaaaaauaggaacgucgu

SEQ ID NO: 11310 - RNA, 21 nt, Artificial Sequence
  Ebola virus siRNA sense strand
uuaaaaaauaggaacgucguu

SEQ ID NO: 11311 - RNA, 21 nt, Artificial Sequence
  Ebola virus siRNA sense strand
uaaaaaauaggaacgucguuc

SEQ ID NO: 11312 - RNA, 21 nt, Artificial Sequence
  Ebola virus siRNA sense strand
aaaaaauaggaacgucguucc

SEQ ID NO: 11313 - RNA, 21 nt, Artificial Sequence
  Ebola virus siRNA sense strand
aaaaauaggaacgucguucca

SEQ ID NO: 11314 - RNA, 21 nt, Artificial Sequence
  Ebola virus siRNA sense strand
aaaauaggaacgucguuccaa

SEQ ID NO: 11315 - RNA, 21 nt, Artificial Sequence
  Ebola virus siRNA sense strand
aaauaggaacgucguuccaac

SEQ ID NO: 11316 - RNA, 21 nt, Artificial Sequence
  Ebola virus siRNA sense strand
aauaggaacgucguuccaaca

SEQ ID NO: 11317 - RNA, 21 nt, Artificial Sequence
  Ebola virus siRNA sense strand
auaggaacgucguuccaacaa

SEQ ID NO: 11318 - RNA, 21 nt, Artificial Sequence
  Ebola virus siRNA sense strand
uaggaacgucguuccaacaau

SEQ ID NO: 11319 - RNA, 21 nt, Artificial Sequence
  Ebola virus siRNA sense strand
aggaacgucguuccaacaauc

SEQ ID NO: 11320 - RNA, 21 nt, Artificial Sequence
  Ebola virus siRNA sense strand
ggaacgucguuccaacaaucg

SEQ ID NO: 11321 - RNA, 21 nt, Artificial Sequence
  Ebola virus siRNA sense strand
gaacgucguuccaacaaucga

SEQ ID NO: 11322 - RNA, 21 nt, Artificial Sequence
  Ebola virus siRNA sense strand
aacgucguuccaacaaucgag

SEQ ID NO: 11323 - RNA, 21 nt, Artificial Sequence
  Ebola virus siRNA sense strand
acgucguuccaacaaucgagc

SEQ ID NO: 11324 - RNA, 21 nt, Artificial Sequence
  Ebola virus siRNA sense strand
cgucguuccaacaaucgagcg

SEQ ID NO: 11325 - RNA, 21 nt, Artificial Sequence
  Ebola virus siRNA sense strand
gucguuccaacaaucgagcgc

SEQ ID NO: 11326 - RNA, 21 nt, Artificial Sequence
  Ebola virus siRNA sense strand
ucguuccaacaaucgagcgca

SEQ ID NO: 11327 - RNA, 21 nt, Artificial Sequence
  Ebola virus siRNA sense strand
cguuccaacaaucgagcgcaa

SEQ ID NO: 11328 - RNA, 21 nt, Artificial Sequence
  Ebola virus siRNA sense strand
guuccaacaaucgagcgcaag

SEQ ID NO: 11329 - RNA, 21 nt, Artificial Sequence
  Ebola virus siRNA sense strand
uuccaacaaucgagcgcaagg

SEQ ID NO: 11330 - RNA, 21 nt, Artificial Sequence
  Ebola virus siRNA sense strand
uccaacaaucgagcgcaaggu

SEQ ID NO: 11331 - RNA, 21 nt, Artificial Sequence
  Ebola virus siRNA sense strand
ccaacaaucgagcgcaagguu

SEQ ID NO: 11332 - RNA, 21 nt, Artificial Sequence
  Ebola virus siRNA sense strand
caacaaucgagcgcaagguuu

SEQ ID NO: 11333 - RNA, 21 nt, Artificial Sequence
  Ebola virus siRNA sense strand
aacaaucgagcgcaagguuuc

SEQ ID NO: 11334 - RNA, 21 nt, Artificial Sequence
  Ebola virus siRNA sense strand
acaaucgagcgcaagguuuca

SEQ ID NO: 11335 - RNA, 21 nt, Artificial Sequence
  Ebola virus siRNA sense strand
caaucgagcgcaagguuucaa

SEQ ID NO: 11336 - RNA, 21 nt, Artificial Sequence
  Ebola virus siRNA sense strand
aaucgagcgcaagguuucaag

SEQ ID NO: 11337 - RNA, 21 nt, Artificial Sequence
  Ebola virus siRNA sense strand
aucgagcgcaagguuucaagg

SEQ ID NO: 11338 - RNA, 21 nt, Artificial Sequence
  Ebola virus siRNA sense strand
ucgagcgcaagguuucaaggu

SEQ ID NO: 11339 - RNA, 21 nt, Artificial Sequence
  Ebola virus siRNA sense strand
cgagcgcaagguuucaagguu

SEQ ID NO: 11340 - RNA, 21 nt, Artificial Sequence
  Ebola virus siRNA sense strand
gagcgcaagguuucaagguug

SEQ ID NO: 11341 - RNA, 21 nt, Artificial Sequence
  Ebola virus siRNA sense strand
agcgcaagguuucaagguuga

SEQ ID NO: 11342 - RNA, 21 nt, Artificial Sequence
  Ebola virus siRNA sense strand
gcgcaagguuucaagguugaa

SEQ ID NO: 11343 - RNA, 21 nt, Artificial Sequence
  Ebola virus siRNA sense strand
cgcaagguuucaagguugaac

SEQ ID NO: 11344 - RNA, 21 nt, Artificial Sequence
  Ebola virus siRNA sense strand
gcaagguuucaagguugaacu

SEQ ID NO: 11345 - RNA, 21 nt, Artificial Sequence
  Ebola virus siRNA sense strand
caagguuucaagguugaacug

SEQ ID NO: 11346 - RNA, 21 nt, Artificial Sequence
  Ebola virus siRNA sense strand
aagguuucaagguugaacuga

SEQ ID NO: 11347 - RNA, 21 nt, Artificial Sequence
  Ebola virus siRNA sense strand
agguuucaagguugaacugag

SEQ ID NO: 11348 - RNA, 21 nt, Artificial Sequence
  Ebola virus siRNA sense strand
gguuucaagguugaacugaga

SEQ ID NO: 11349 - RNA, 21 nt, Artificial Sequence
  Ebola virus siRNA sense strand
guuucaagguugaacugagag

SEQ ID NO: 11350 - RNA, 21 nt, Artificial Sequence
  Ebola virus siRNA sense strand
uuucaagguugaacugagagu

SEQ ID NO: 11351 - RNA, 21 nt, Artificial Sequence
  Ebola virus siRNA sense strand
uucaagguugaacugagagug

SEQ ID NO: 11352 - RNA, 21 nt, Artificial Sequence
  Ebola virus siRNA sense strand
ucaagguugaacugagagugu

SEQ ID NO: 11353 - RNA, 21 nt, Artificial Sequence
  Ebola virus siRNA sense strand
caagguugaacugagaguguc

SEQ ID NO: 11354 - RNA, 21 nt, Artificial Sequence
  Ebola virus siRNA sense strand
aagguugaacugagagugucu

SEQ ID NO: 11355 - RNA, 21 nt, Artificial Sequence
  Ebola virus siRNA sense strand
agguugaacugagagugucua

SEQ ID NO: 11356 - RNA, 21 nt, Artificial Sequence
  Ebola virus siRNA sense strand
gguugaacugagagugucuag

SEQ ID NO: 11357 - RNA, 21 nt, Artificial Sequence
  Ebola virus siRNA sense strand
guugaacugagagugucuaga

SEQ ID NO: 11358 - RNA, 21 nt, Artificial Sequence
  Ebola virus siRNA sense strand
uugaacugagagugucuagac

SEQ ID NO: 11359 - RNA, 21 nt, Artificial Sequence
  Ebola virus siRNA sense strand
ugaacugagagugucuagaca

SEQ ID NO: 11360 - RNA, 21 nt, Artificial Sequence
  Ebola virus siRNA sense strand
gaacugagagugucuagacaa

SEQ ID NO: 11361 - RNA, 21 nt, Artificial Sequence
  Ebola virus siRNA sense strand
aacugagagugucuagacaac

SEQ ID NO: 11362 - RNA, 21 nt, Artificial Sequence
  Ebola virus siRNA sense strand
acugagagugucuagacaaca

SEQ ID NO: 11363 - RNA, 21 nt, Artificial Sequence
  Ebola virus siRNA sense strand
cugagagugucuagacaacaa

SEQ ID NO: 11364 - RNA, 21 nt, Artificial Sequence
  Ebola virus siRNA sense strand
ugagagugucuagacaacaaa

SEQ ID NO: 11365 - RNA, 21 nt, Artificial Sequence
  Ebola virus siRNA sense strand
gagagugucuagacaacaaaa

SEQ ID NO: 11366 - RNA, 21 nt, Artificial Sequence
  Ebola virus siRNA sense strand
agagugucuagacaacaaaau

SEQ ID NO: 11367 - RNA, 21 nt, Artificial Sequence
  Ebola virus siRNA sense strand
gagugucuagacaacaaaaua

SEQ ID NO: 11368 - RNA, 21 nt, Artificial Sequence
  Ebola virus siRNA sense strand
agugucuagacaacaaaauau

SEQ ID NO: 11369 - RNA, 21 nt, Artificial Sequence
  Ebola virus siRNA sense strand
gugucuagacaacaaaauauu

SEQ ID NO: 11370 - RNA, 21 nt, Artificial Sequence
  Ebola virus siRNA sense strand
ugucuagacaacaaaauauug

SEQ ID NO: 11371 - RNA, 21 nt, Artificial Sequence
  Ebola virus siRNA sense strand
gucuagacaacaaaauauuga

SEQ ID NO: 11372 - RNA, 21 nt, Artificial Sequence
  Ebola virus siRNA sense strand
ucuagacaacaaaauauugau

SEQ ID NO: 11373 - RNA, 21 nt, Artificial Sequence
  Ebola virus siRNA sense strand
cuagacaacaaaauauugaua

SEQ ID NO: 11374 - RNA, 21 nt, Artificial Sequence
  Ebola virus siRNA sense strand
uagacaacaaaauauugauac

SEQ ID NO: 11375 - RNA, 21 nt, Artificial Sequence
  Ebola virus siRNA sense strand
agacaacaaaauauugauacu

SEQ ID NO: 11376 - RNA, 21 nt, Artificial Sequence
  Ebola virus siRNA sense strand
gacaacaaaauauugauacuc

SEQ ID NO: 11377 - RNA, 21 nt, Artificial Sequence
  Ebola virus siRNA sense strand
acaacaaaauauugauacucc

SEQ ID NO: 11378 - RNA, 21 nt, Artificial Sequence
  Ebola virus siRNA sense strand
caacaaaauauugauacucca

SEQ ID NO: 11379 - RNA, 21 nt, Artificial Sequence
  Ebola virus siRNA sense strand
aacaaaauauugauacuccag

SEQ ID NO: 11380 - RNA, 21 nt, Artificial Sequence
  Ebola virus siRNA sense strand
acaaaauauugauacuccaga

SEQ ID NO: 11381 - RNA, 21 nt, Artificial Sequence
  Ebola virus siRNA sense strand
caaaauauugauacuccagac

SEQ ID NO: 11382 - RNA, 21 nt, Artificial Sequence
  Ebola virus siRNA sense strand
aaaauauugauacuccagaca

SEQ ID NO: 11383 - RNA, 21 nt, Artificial Sequence
  Ebola virus siRNA sense strand
aaauauugauacuccagacac

SEQ ID NO: 11384 - RNA, 21 nt, Artificial Sequence
  Ebola virus siRNA sense strand
aauauugauacuccagacacc

SEQ ID NO: 11385 - RNA, 21 nt, Artificial Sequence
  Ebola virus siRNA sense strand
auauugauacuccagacacca

SEQ ID NO: 11386 - RNA, 21 nt, Artificial Sequence
  Ebola virus siRNA sense strand
uauugauacuccagacaccaa

SEQ ID NO: 11387 - RNA, 21 nt, Artificial Sequence
  Ebola virus siRNA sense strand
auugauacuccagacaccaag

SEQ ID NO: 11388 - RNA, 21 nt, Artificial Sequence
  Ebola virus siRNA sense strand
uugauacuccagacaccaagc

SEQ ID NO: 11389 - RNA, 21 nt, Artificial Sequence
  Ebola virus siRNA sense strand
ugauacuccagacaccaagca

SEQ ID NO: 11390 - RNA, 21 nt, Artificial Sequence
  Ebola virus siRNA sense strand
gauacuccagacaccaagcaa

SEQ ID NO: 11391 - RNA, 21 nt, Artificial Sequence
  Ebola virus siRNA sense strand
auacuccagacaccaagcaag

SEQ ID NO: 11392 - RNA, 21 nt, Artificial Sequence
  Ebola virus siRNA sense strand
uacuccagacaccaagcaaga

SEQ ID NO: 11393 - RNA, 21 nt, Artificial Sequence
  Ebola virus siRNA sense strand
acuccagacaccaagcaagac

SEQ ID NO: 11394 - RNA, 21 nt, Artificial Sequence
  Ebola virus siRNA sense strand
cuccagacaccaagcaagacc

SEQ ID NO: 11395 - RNA, 21 nt, Artificial Sequence
  Ebola virus siRNA sense strand
uccagacaccaagcaagaccu

SEQ ID NO: 11396 - RNA, 21 nt, Artificial Sequence
  Ebola virus siRNA sense strand
ccagacaccaagcaagaccug

SEQ ID NO: 11397 - RNA, 21 nt, Artificial Sequence
  Ebola virus siRNA sense strand
cagacaccaagcaagaccuga

SEQ ID NO: 11398 - RNA, 21 nt, Artificial Sequence
  Ebola virus siRNA sense strand
agacaccaagcaagaccugag

SEQ ID NO: 11399 - RNA, 21 nt, Artificial Sequence
  Ebola virus siRNA sense strand
gacaccaagcaagaccugaga

SEQ ID NO: 11400 - RNA, 21 nt, Artificial Sequence
  Ebola virus siRNA sense strand
acaccaagcaagaccugagaa

SEQ ID NO: 11401 - RNA, 21 nt, Artificial Sequence
  Ebola virus siRNA sense strand
caccaagcaagaccugagaaa

SEQ ID NO: 11402 - RNA, 21 nt, Artificial Sequence
  Ebola virus siRNA sense strand
accaagcaagaccugagaaaa

SEQ ID NO: 11403 - RNA, 21 nt, Artificial Sequence
  Ebola virus siRNA sense strand
ccaagcaagaccugagaaaaa

SEQ ID NO: 11404 - RNA, 21 nt, Artificial Sequence
  Ebola virus siRNA sense strand
caagcaagaccugagaaaaaa

SEQ ID NO: 11405 - RNA, 21 nt, Artificial Sequence
  Ebola virus siRNA sense strand
aagcaagaccugagaaaaaac

SEQ ID NO: 11406 - RNA, 21 nt, Artificial Sequence
  Ebola virus siRNA sense strand
agcaagaccugagaaaaaacc

SEQ ID NO: 11407 - RNA, 21 nt, Artificial Sequence
  Ebola virus siRNA sense strand
gcaagaccugagaaaaaacca

SEQ ID NO: 11408 - RNA, 21 nt, Artificial Sequence
  Ebola virus siRNA sense strand
caagaccugagaaaaaaccau

SEQ ID NO: 11409 - RNA, 21 nt, Artificial Sequence
  Ebola virus siRNA sense strand
aagaccugagaaaaaaccaug

SEQ ID NO: 11410 - RNA, 21 nt, Artificial Sequence
  Ebola virus siRNA sense strand
agaccugagaaaaaaccaugg

SEQ ID NO: 11411 - RNA, 21 nt, Artificial Sequence
  Ebola virus siRNA sense strand
gaccugagaaaaaaccauggc

SEQ ID NO: 11412 - RNA, 21 nt, Artificial Sequence
  Ebola virus siRNA sense strand
accugagaaaaaaccauggcu

SEQ ID NO: 11413 - RNA, 21 nt, Artificial Sequence
  Ebola virus siRNA sense strand
ccugagaaaaaaccauggcua

SEQ ID NO: 11414 - RNA, 21 nt, Artificial Sequence
  Ebola virus siRNA sense strand
cugagaaaaaaccauggcuaa

SEQ ID NO: 11415 - RNA, 21 nt, Artificial Sequence
  Ebola virus siRNA sense strand
ugagaaaaaaccauggcuaaa

SEQ ID NO: 11416 - RNA, 21 nt, Artificial Sequence
  Ebola virus siRNA sense strand
gagaaaaaaccauggcuaaag

SEQ ID NO: 11417 - RNA, 21 nt, Artificial Sequence
  Ebola virus siRNA sense strand
agaaaaaaccauggcuaaagc

SEQ ID NO: 11418 - RNA, 21 nt, Artificial Sequence
  Ebola virus siRNA sense strand
gaaaaaaccauggcuaaagcu

SEQ ID NO: 11419 - RNA, 21 nt, Artificial Sequence
  Ebola virus siRNA sense strand
aaaaaaccauggcuaaagcua

SEQ ID NO: 11420 - RNA, 21 nt, Artificial Sequence
  Ebola virus siRNA sense strand
aaaaaccauggcuaaagcuac

SEQ ID NO: 11421 - RNA, 21 nt, Artificial Sequence
  Ebola virus siRNA sense strand
aaaaccauggcuaaagcuacg

SEQ ID NO: 11422 - RNA, 21 nt, Artificial Sequence
  Ebola virus siRNA sense strand
aaaccauggcuaaagcuacgg

SEQ ID NO: 11423 - RNA, 21 nt, Artificial Sequence
  Ebola virus siRNA sense strand
aaccauggcuaaagcuacggg

SEQ ID NO: 11424 - RNA, 21 nt, Artificial Sequence
  Ebola virus siRNA sense strand
accauggcuaaagcuacggga

SEQ ID NO: 11425 - RNA, 21 nt, Artificial Sequence
  Ebola virus siRNA sense strand
ccauggcuaaagcuacgggac

SEQ ID NO: 11426 - RNA, 21 nt, Artificial Sequence
  Ebola virus siRNA sense strand
cauggcuaaagcuacgggacg

SEQ ID NO: 11427 - RNA, 21 nt, Artificial Sequence
  Ebola virus siRNA sense strand
auggcuaaagcuacgggacga

SEQ ID NO: 11428 - RNA, 21 nt, Artificial Sequence
  Ebola virus siRNA sense strand
uggcuaaagcuacgggacgau

SEQ ID NO: 11429 - RNA, 21 nt, Artificial Sequence
  Ebola virus siRNA sense strand
ggcuaaagcuacgggacgaua

SEQ ID NO: 11430 - RNA, 21 nt, Artificial Sequence
  Ebola virus siRNA sense strand
gcuaaagcuacgggacgauac

SEQ ID NO: 11431 - RNA, 21 nt, Artificial Sequence
  Ebola virus siRNA sense strand
cuaaagcuacgggacgauaca

SEQ ID NO: 11432 - RNA, 21 nt, Artificial Sequence
  Ebola virus siRNA sense strand
uaaagcuacgggacgauacaa

SEQ ID NO: 11433 - RNA, 21 nt, Artificial Sequence
  Ebola virus siRNA sense strand
aaagcuacgggacgauacaau

SEQ ID NO: 11434 - RNA, 21 nt, Artificial Sequence
  Ebola virus siRNA sense strand
aagcuacgggacgauacaauc

SEQ ID NO: 11435 - RNA, 21 nt, Artificial Sequence
  Ebola virus siRNA sense strand
agcuacgggacgauacaaucu

SEQ ID NO: 11436 - RNA, 21 nt, Artificial Sequence
  Ebola virus siRNA sense strand
gcuacgggacgauacaaucua

SEQ ID NO: 11437 - RNA, 21 nt, Artificial Sequence
  Ebola virus siRNA sense strand
cuacgggacgauacaaucuaa

SEQ ID NO: 11438 - RNA, 21 nt, Artificial Sequence
  Ebola virus siRNA sense strand
uacgggacgauacaaucuaau

SEQ ID NO: 11439 - RNA, 21 nt, Artificial Sequence
  Ebola virus siRNA sense strand
acgggacgauacaaucuaaua

SEQ ID NO: 11440 - RNA, 21 nt, Artificial Sequence
  Ebola virus siRNA sense strand
cgggacgauacaaucuaauau

SEQ ID NO: 11441 - RNA, 21 nt, Artificial Sequence
  Ebola virus siRNA sense strand
gggacgauacaaucuaauauc

SEQ ID NO: 11442 - RNA, 21 nt, Artificial Sequence
  Ebola virus siRNA sense strand
ggacgauacaaucuaauaucg

SEQ ID NO: 11443 - RNA, 21 nt, Artificial Sequence
  Ebola virus siRNA sense strand
gacgauacaaucuaauaucgc

SEQ ID NO: 11444 - RNA, 21 nt, Artificial Sequence
  Ebola virus siRNA sense strand
acgauacaaucuaauaucgcc

SEQ ID NO: 11445 - RNA, 21 nt, Artificial Sequence
  Ebola virus siRNA sense strand
cgauacaaucuaauaucgccc

SEQ ID NO: 11446 - RNA, 21 nt, Artificial Sequence
  Ebola virus siRNA sense strand
gauacaaucuaauaucgccca

SEQ ID NO: 11447 - RNA, 21 nt, Artificial Sequence
  Ebola virus siRNA sense strand
auacaaucuaauaucgcccaa

SEQ ID NO: 11448 - RNA, 21 nt, Artificial Sequence
  Ebola virus siRNA sense strand
uacaaucuaauaucgcccaaa

SEQ ID NO: 11449 - RNA, 21 nt, Artificial Sequence
  Ebola virus siRNA sense strand
acaaucuaauaucgcccaaaa

SEQ ID NO: 11450 - RNA, 21 nt, Artificial Sequence
  Ebola virus siRNA sense strand
caaucuaauaucgcccaaaaa

SEQ ID NO: 11451 - RNA, 21 nt, Artificial Sequence
  Ebola virus siRNA sense strand
aaucuaauaucgcccaaaaag

SEQ ID NO: 11452 - RNA, 21 nt, Artificial Sequence
  Ebola virus siRNA sense strand
aucuaauaucgcccaaaaagg

SEQ ID NO: 11453 - RNA, 21 nt, Artificial Sequence
  Ebola virus siRNA sense strand
ucuaauaucgcccaaaaagga

SEQ ID NO: 11454 - RNA, 21 nt, Artificial Sequence
  Ebola virus siRNA sense strand
cuaauaucgcccaaaaaggac

SEQ ID NO: 11455 - RNA, 21 nt, Artificial Sequence
  Ebola virus siRNA sense strand
uaauaucgcccaaaaaggacc

SEQ ID NO: 11456 - RNA, 21 nt, Artificial Sequence
  Ebola virus siRNA sense strand
aauaucgcccaaaaaggaccu

SEQ ID NO: 11457 - RNA, 21 nt, Artificial Sequence
  Ebola virus siRNA sense strand
auaucgcccaaaaaggaccug

SEQ ID NO: 11458 - RNA, 21 nt, Artificial Sequence
  Ebola virus siRNA sense strand
uaucgcccaaaaaggaccugg

SEQ ID NO: 11459 - RNA, 21 nt, Artificial Sequence
  Ebola virus siRNA sense strand
aucgcccaaaaaggaccugga

SEQ ID NO: 11460 - RNA, 21 nt, Artificial Sequence
  Ebola virus siRNA sense strand
ucgcccaaaaaggaccuggag

SEQ ID NO: 11461 - RNA, 21 nt, Artificial Sequence
  Ebola virus siRNA sense strand
cgcccaaaaaggaccuggaga

SEQ ID NO: 11462 - RNA, 21 nt, Artificial Sequence
  Ebola virus siRNA sense strand
gcccaaaaaggaccuggagaa

SEQ ID NO: 11463 - RNA, 21 nt, Artificial Sequence
  Ebola virus siRNA sense strand
cccaaaaaggaccuggagaaa

SEQ ID NO: 11464 - RNA, 21 nt, Artificial Sequence
  Ebola virus siRNA sense strand
ccaaaaaggaccuggagaaag

SEQ ID NO: 11465 - RNA, 21 nt, Artificial Sequence
  Ebola virus siRNA sense strand
caaaaaggaccuggagaaagg

SEQ ID NO: 11466 - RNA, 21 nt, Artificial Sequence
  Ebola virus siRNA sense strand
aaaaaggaccuggagaaaggg

SEQ ID NO: 11467 - RNA, 21 nt, Artificial Sequence
  Ebola virus siRNA sense strand
aaaaggaccuggagaaagggg

SEQ ID NO: 11468 - RNA, 21 nt, Artificial Sequence
  Ebola virus siRNA sense strand
aaaggaccuggagaaaggggu

SEQ ID NO: 11469 - RNA, 21 nt, Artificial Sequence
  Ebola virus siRNA sense strand
aaggaccuggagaaagggguu

SEQ ID NO: 11470 - RNA, 21 nt, Artificial Sequence
  Ebola virus siRNA sense strand
aggaccuggagaaagggguug

SEQ ID NO: 11471 - RNA, 21 nt, Artificial Sequence
  Ebola virus siRNA sense strand
ggaccuggagaaagggguugu

SEQ ID NO: 11472 - RNA, 21 nt, Artificial Sequence
  Ebola virus siRNA sense strand
gaccuggagaaagggguuguc

SEQ ID NO: 11473 - RNA, 21 nt, Artificial Sequence
  Ebola virus siRNA sense strand
accuggagaaagggguugucu

SEQ ID NO: 11474 - RNA, 21 nt, Artificial Sequence
  Ebola virus siRNA sense strand
ccuggagaaagggguugucuu

SEQ ID NO: 11475 - RNA, 21 nt, Artificial Sequence
  Ebola virus siRNA sense strand
cuggagaaagggguugucuua

SEQ ID NO: 11476 - RNA, 21 nt, Artificial Sequence
  Ebola virus siRNA sense strand
uggagaaagggguugucuuaa

SEQ ID NO: 11477 - RNA, 21 nt, Artificial Sequence
  Ebola virus siRNA sense strand
ggagaaagggguugucuuaag

SEQ ID NO: 11478 - RNA, 21 nt, Artificial Sequence
  Ebola virus siRNA sense strand
gagaaagggguugucuuaagc

SEQ ID NO: 11479 - RNA, 21 nt, Artificial Sequence
  Ebola virus siRNA sense strand
agaaagggguugucuuaagcg

SEQ ID NO: 11480 - RNA, 21 nt, Artificial Sequence
  Ebola virus siRNA sense strand
gaaagggguugucuuaagcga

SEQ ID NO: 11481 - RNA, 21 nt, Artificial Sequence
  Ebola virus siRNA sense strand
aaagggguugucuuaagcgac

SEQ ID NO: 11482 - RNA, 21 nt, Artificial Sequence
  Ebola virus siRNA sense strand
aagggguugucuuaagcgacc

SEQ ID NO: 11483 - RNA, 21 nt, Artificial Sequence
  Ebola virus siRNA sense strand
agggguugucuuaagcgaccu

SEQ ID NO: 11484 - RNA, 21 nt, Artificial Sequence
  Ebola virus siRNA sense strand
gggguugucuuaagcgaccuc

SEQ ID NO: 11485 - RNA, 21 nt, Artificial Sequence
  Ebola virus siRNA sense strand
ggguugucuuaagcgaccucu

SEQ ID NO: 11486 - RNA, 21 nt, Artificial Sequence
  Ebola virus siRNA sense strand
gguugucuuaagcgaccucug

SEQ ID NO: 11487 - RNA, 21 nt, Artificial Sequence
  Ebola virus siRNA sense strand
guugucuuaagcgaccucugu

SEQ ID NO: 11488 - RNA, 21 nt, Artificial Sequence
  Ebola virus siRNA sense strand
uugucuuaagcgaccucugua

SEQ ID NO: 11489 - RNA, 21 nt, Artificial Sequence
  Ebola virus siRNA sense strand
ugucuuaagcgaccucuguaa

SEQ ID NO: 11490 - RNA, 21 nt, Artificial Sequence
  Ebola virus siRNA sense strand
gucuuaagcgaccucuguaac

SEQ ID NO: 11491 - RNA, 21 nt, Artificial Sequence
  Ebola virus siRNA sense strand
ucuuaagcgaccucuguaacu

SEQ ID NO: 11492 - RNA, 21 nt, Artificial Sequence
  Ebola virus siRNA sense strand
cuuaagcgaccucuguaacuu

SEQ ID NO: 11493 - RNA, 21 nt, Artificial Sequence
  Ebola virus siRNA sense strand
uuaagcgaccucuguaacuuc

SEQ ID NO: 11494 - RNA, 21 nt, Artificial Sequence
  Ebola virus siRNA sense strand
uaagcgaccucuguaacuucu

SEQ ID NO: 11495 - RNA, 21 nt, Artificial Sequence
  Ebola virus siRNA sense strand
aagcgaccucuguaacuucuu

SEQ ID NO: 11496 - RNA, 21 nt, Artificial Sequence
  Ebola virus siRNA sense strand
agcgaccucuguaacuucuua

SEQ ID NO: 11497 - RNA, 21 nt, Artificial Sequence
  Ebola virus siRNA sense strand
gcgaccucuguaacuucuuag

SEQ ID NO: 11498 - RNA, 21 nt, Artificial Sequence
  Ebola virus siRNA sense strand
cgaccucuguaacuucuuagu

SEQ ID NO: 11499 - RNA, 21 nt, Artificial Sequence
  Ebola virus siRNA sense strand
gaccucuguaacuucuuaguu

SEQ ID NO: 11500 - RNA, 21 nt, Artificial Sequence
  Ebola virus siRNA sense strand
accucuguaacuucuuaguua

SEQ ID NO: 11501 - RNA, 21 nt, Artificial Sequence
  Ebola virus siRNA sense strand
ccucuguaacuucuuaguuag

SEQ ID NO: 11502 - RNA, 21 nt, Artificial Sequence
  Ebola virus siRNA sense strand
cucuguaacuucuuaguuagc

SEQ ID NO: 11503 - RNA, 21 nt, Artificial Sequence
  Ebola virus siRNA sense strand
ucuguaacuucuuaguuagcc

SEQ ID NO: 11504 - RNA, 21 nt, Artificial Sequence
  Ebola virus siRNA sense strand
cuguaacuucuuaguuagcca

SEQ ID NO: 11505 - RNA, 21 nt, Artificial Sequence
  Ebola virus siRNA sense strand
uguaacuucuuaguuagccaa

SEQ ID NO: 11506 - RNA, 21 nt, Artificial Sequence
  Ebola virus siRNA sense strand
guaacuucuuaguuagccaaa

SEQ ID NO: 11507 - RNA, 21 nt, Artificial Sequence
  Ebola virus siRNA sense strand
uaacuucuuaguuagccaaac

SEQ ID NO: 11508 - RNA, 21 nt, Artificial Sequence
  Ebola virus siRNA sense strand
aacuucuuaguuagccaaacu

SEQ ID NO: 11509 - RNA, 21 nt, Artificial Sequence
  Ebola virus siRNA sense strand
acuucuuaguuagccaaacua

SEQ ID NO: 11510 - RNA, 21 nt, Artificial Sequence
  Ebola virus siRNA sense strand
cuucuuaguuagccaaacuau

SEQ ID NO: 11511 - RNA, 21 nt, Artificial Sequence
  Ebola virus siRNA sense strand
uucuuaguuagccaaacuauu

SEQ ID NO: 11512 - RNA, 21 nt, Artificial Sequence
  Ebola virus siRNA sense strand
ucuuaguuagccaaacuauuc

SEQ ID NO: 11513 - RNA, 21 nt, Artificial Sequence
  Ebola virus siRNA sense strand
cuuaguuagccaaacuauuca

SEQ ID NO: 11514 - RNA, 21 nt, Artificial Sequence
  Ebola virus siRNA sense strand
uuaguuagccaaacuauucag

SEQ ID NO: 11515 - RNA, 21 nt, Artificial Sequence
  Ebola virus siRNA sense strand
uaguuagccaaacuauucagg

SEQ ID NO: 11516 - RNA, 21 nt, Artificial Sequence
  Ebola virus siRNA sense strand
aguuagccaaacuauucaggg

SEQ ID NO: 11517 - RNA, 21 nt, Artificial Sequence
  Ebola virus siRNA sense strand
guuagccaaacuauucagggg

SEQ ID NO: 11518 - RNA, 21 nt, Artificial Sequence
  Ebola virus siRNA sense strand
uuagccaaacuauucaggggu

SEQ ID NO: 11519 - RNA, 21 nt, Artificial Sequence
  Ebola virus siRNA sense strand
uagccaaacuauucaggggug

SEQ ID NO: 11520 - RNA, 21 nt, Artificial Sequence
  Ebola virus siRNA sense strand
agccaaacuauucaggggugg

SEQ ID NO: 11521 - RNA, 21 nt, Artificial Sequence
  Ebola virus siRNA sense strand
gccaaacuauucaggggugga

SEQ ID NO: 11522 - RNA, 21 nt, Artificial Sequence
  Ebola virus siRNA sense strand
ccaaacuauucagggguggaa

SEQ ID NO: 11523 - RNA, 21 nt, Artificial Sequence
  Ebola virus siRNA sense strand
caaacuauucagggguggaag

SEQ ID NO: 11524 - RNA, 21 nt, Artificial Sequence
  Ebola virus siRNA sense strand
aaacuauucagggguggaagg

SEQ ID NO: 11525 - RNA, 21 nt, Artificial Sequence
  Ebola virus siRNA sense strand
aacuauucagggguggaaggu

SEQ ID NO: 11526 - RNA, 21 nt, Artificial Sequence
  Ebola virus siRNA sense strand
acuauucagggguggaagguu

SEQ ID NO: 11527 - RNA, 21 nt, Artificial Sequence
  Ebola virus siRNA sense strand
cuauucagggguggaagguuu

SEQ ID NO: 11528 - RNA, 21 nt, Artificial Sequence
  Ebola virus siRNA sense strand
uauucagggguggaagguuua

SEQ ID NO: 11529 - RNA, 21 nt, Artificial Sequence
  Ebola virus siRNA sense strand
auucagggguggaagguuuau

SEQ ID NO: 11530 - RNA, 21 nt, Artificial Sequence
  Ebola virus siRNA sense strand
uucagggguggaagguuuauu

SEQ ID NO: 11531 - RNA, 21 nt, Artificial Sequence
  Ebola virus siRNA sense strand
ucagggguggaagguuuauug

SEQ ID NO: 11532 - RNA, 21 nt, Artificial Sequence
  Ebola virus siRNA sense strand
cagggguggaagguuuauugg

SEQ ID NO: 11533 - RNA, 21 nt, Artificial Sequence
  Ebola virus siRNA sense strand
agggguggaagguuuauuggg

SEQ ID NO: 11534 - RNA, 21 nt, Artificial Sequence
  Ebola virus siRNA sense strand
gggguggaagguuuauugggc

SEQ ID NO: 11535 - RNA, 21 nt, Artificial Sequence
  Ebola virus siRNA sense strand
ggguggaagguuuauugggcu

SEQ ID NO: 11536 - RNA, 21 nt, Artificial Sequence
  Ebola virus siRNA sense strand
gguggaagguuuauugggcug

SEQ ID NO: 11537 - RNA, 21 nt, Artificial Sequence
  Ebola virus siRNA sense strand
guggaagguuuauugggcugg

SEQ ID NO: 11538 - RNA, 21 nt, Artificial Sequence
  Ebola virus siRNA sense strand
uggaagguuuauugggcuggu

SEQ ID NO: 11539 - RNA, 21 nt, Artificial Sequence
  Ebola virus siRNA sense strand
ggaagguuuauugggcuggua

SEQ ID NO: 11540 - RNA, 21 nt, Artificial Sequence
  Ebola virus siRNA sense strand
gaagguuuauugggcugguau

SEQ ID NO: 11541 - RNA, 21 nt, Artificial Sequence
  Ebola virus siRNA sense strand
aagguuuauugggcugguauu

SEQ ID NO: 11542 - RNA, 21 nt, Artificial Sequence
  Ebola virus siRNA sense strand
agguuuauugggcugguauug

SEQ ID NO: 11543 - RNA, 21 nt, Artificial Sequence
  Ebola virus siRNA sense strand
gguuuauugggcugguauuga

SEQ ID NO: 11544 - RNA, 21 nt, Artificial Sequence
  Ebola virus siRNA sense strand
guuuauugggcugguauugag

SEQ ID NO: 11545 - RNA, 21 nt, Artificial Sequence
  Ebola virus siRNA sense strand
uuuauugggcugguauugagu

SEQ ID NO: 11546 - RNA, 21 nt, Artificial Sequence
  Ebola virus siRNA sense strand
uuauugggcugguauugaguu

SEQ ID NO: 11547 - RNA, 21 nt, Artificial Sequence
  Ebola virus siRNA sense strand
uauugggcugguauugaguuu

SEQ ID NO: 11548 - RNA, 21 nt, Artificial Sequence
  Ebola virus siRNA sense strand
auugggcugguauugaguuug

SEQ ID NO: 11549 - RNA, 21 nt, Artificial Sequence
  Ebola virus siRNA sense strand
uugggcugguauugaguuuga

SEQ ID NO: 11550 - RNA, 21 nt, Artificial Sequence
  Ebola virus siRNA sense strand
ugggcugguauugaguuugau

SEQ ID NO: 11551 - RNA, 21 nt, Artificial Sequence
  Ebola virus siRNA sense strand
gggcugguauugaguuugaug

SEQ ID NO: 11552 - RNA, 21 nt, Artificial Sequence
  Ebola virus siRNA sense strand
ggcugguauugaguuugaugu

SEQ ID NO: 11553 - RNA, 21 nt, Artificial Sequence
  Ebola virus siRNA sense strand
gcugguauugaguuugaugug

SEQ ID NO: 11554 - RNA, 21 nt, Artificial Sequence
  Ebola virus siRNA sense strand
cugguauugaguuugauguga

SEQ ID NO: 11555 - RNA, 21 nt, Artificial Sequence
  Ebola virus siRNA sense strand
ugguauugaguuugaugugac

SEQ ID NO: 11556 - RNA, 21 nt, Artificial Sequence
  Ebola virus siRNA sense strand
gguauugaguuugaugugacu

SEQ ID NO: 11557 - RNA, 21 nt, Artificial Sequence
  Ebola virus siRNA sense strand
guauugaguuugaugugacuc

SEQ ID NO: 11558 - RNA, 21 nt, Artificial Sequence
  Ebola virus siRNA sense strand
uauugaguuugaugugacuca

SEQ ID NO: 11559 - RNA, 21 nt, Artificial Sequence
  Ebola virus siRNA sense strand
auugaguuugaugugacucac

SEQ ID NO: 11560 - RNA, 21 nt, Artificial Sequence
  Ebola virus siRNA sense strand
uugaguuugaugugacucaca

SEQ ID NO: 11561 - RNA, 21 nt, Artificial Sequence
  Ebola virus siRNA sense strand
ugaguuugaugugacucacaa

SEQ ID NO: 11562 - RNA, 21 nt, Artificial Sequence
  Ebola virus siRNA sense strand
gaguuugaugugacucacaaa

SEQ ID NO: 11563 - RNA, 21 nt, Artificial Sequence
  Ebola virus siRNA sense strand
aguuugaugugacucacaaag

SEQ ID NO: 11564 - RNA, 21 nt, Artificial Sequence
  Ebola virus siRNA sense strand
guuugaugugacucacaaagg

SEQ ID NO: 11565 - RNA, 21 nt, Artificial Sequence
  Ebola virus siRNA sense strand
uuugaugugacucacaaagga

SEQ ID NO: 11566 - RNA, 21 nt, Artificial Sequence
  Ebola virus siRNA sense strand
uugaugugacucacaaaggaa

SEQ ID NO: 11567 - RNA, 21 nt, Artificial Sequence
  Ebola virus siRNA sense strand
ugaugugacucacaaaggaau

SEQ ID NO: 11568 - RNA, 21 nt, Artificial Sequence
  Ebola virus siRNA sense strand
gaugugacucacaaaggaaug

SEQ ID NO: 11569 - RNA, 21 nt, Artificial Sequence
  Ebola virus siRNA sense strand
augugacucacaaaggaaugg

SEQ ID NO: 11570 - RNA, 21 nt, Artificial Sequence
  Ebola virus siRNA sense strand
ugugacucacaaaggaauggc

SEQ ID NO: 11571 - RNA, 21 nt, Artificial Sequence
  Ebola virus siRNA sense strand
gugacucacaaaggaauggcc

SEQ ID NO: 11572 - RNA, 21 nt, Artificial Sequence
  Ebola virus siRNA sense strand
ugacucacaaaggaauggccc

SEQ ID NO: 11573 - RNA, 21 nt, Artificial Sequence
  Ebola virus siRNA sense strand
gacucacaaaggaauggcccu

SEQ ID NO: 11574 - RNA, 21 nt, Artificial Sequence
  Ebola virus siRNA sense strand
acucacaaaggaauggcccua

SEQ ID NO: 11575 - RNA, 21 nt, Artificial Sequence
  Ebola virus siRNA sense strand
cucacaaaggaauggcccuau

SEQ ID NO: 11576 - RNA, 21 nt, Artificial Sequence
  Ebola virus siRNA sense strand
ucacaaaggaauggcccuauu

SEQ ID NO: 11577 - RNA, 21 nt, Artificial Sequence
  Ebola virus siRNA sense strand
cacaaaggaauggcccuauug

SEQ ID NO: 11578 - RNA, 21 nt, Artificial Sequence
  Ebola virus siRNA sense strand
acaaaggaauggcccuauugc

SEQ ID NO: 11579 - RNA, 21 nt, Artificial Sequence
  Ebola virus siRNA sense strand
caaaggaauggcccuauugca

SEQ ID NO: 11580 - RNA, 21 nt, Artificial Sequence
  Ebola virus siRNA sense strand
aaaggaauggcccuauugcau

SEQ ID NO: 11581 - RNA, 21 nt, Artificial Sequence
  Ebola virus siRNA sense strand
aaggaauggcccuauugcaua

SEQ ID NO: 11582 - RNA, 21 nt, Artificial Sequence
  Ebola virus siRNA sense strand
aggaauggcccuauugcauag

SEQ ID NO: 11583 - RNA, 21 nt, Artificial Sequence
  Ebola virus siRNA sense strand
ggaauggcccuauugcauaga

SEQ ID NO: 11584 - RNA, 21 nt, Artificial Sequence
  Ebola virus siRNA sense strand
gaauggcccuauugcauagac

SEQ ID NO: 11585 - RNA, 21 nt, Artificial Sequence
  Ebola virus siRNA sense strand
aauggcccuauugcauagacu

SEQ ID NO: 11586 - RNA, 21 nt, Artificial Sequence
  Ebola virus siRNA sense strand
auggcccuauugcauagacug

SEQ ID NO: 11587 - RNA, 21 nt, Artificial Sequence
  Ebola virus siRNA sense strand
uggcccuauugcauagacuga

SEQ ID NO: 11588 - RNA, 21 nt, Artificial Sequence
  Ebola virus siRNA sense strand
ggcccuauugcauagacugaa

SEQ ID NO: 11589 - RNA, 21 nt, Artificial Sequence
  Ebola virus siRNA sense strand
gcccuauugcauagacugaaa

SEQ ID NO: 11590 - RNA, 21 nt, Artificial Sequence
  Ebola virus siRNA sense strand
cccuauugcauagacugaaaa

SEQ ID NO: 11591 - RNA, 21 nt, Artificial Sequence
  Ebola virus siRNA sense strand
ccuauugcauagacugaaaac

SEQ ID NO: 11592 - RNA, 21 nt, Artificial Sequence
  Ebola virus siRNA sense strand
cuauugcauagacugaaaacu

SEQ ID NO: 11593 - RNA, 21 nt, Artificial Sequence
  Ebola virus siRNA sense strand
uauugcauagacugaaaacua

SEQ ID NO: 11594 - RNA, 21 nt, Artificial Sequence
  Ebola virus siRNA sense strand
auugcauagacugaaaacuaa

SEQ ID NO: 11595 - RNA, 21 nt, Artificial Sequence
  Ebola virus siRNA sense strand
uugcauagacugaaaacuaau

SEQ ID NO: 11596 - RNA, 21 nt, Artificial Sequence
  Ebola virus siRNA sense strand
ugcauagacugaaaacuaaug

SEQ ID NO: 11597 - RNA, 21 nt, Artificial Sequence
  Ebola virus siRNA sense strand
gcauagacugaaaacuaauga

SEQ ID NO: 11598 - RNA, 21 nt, Artificial Sequence
  Ebola virus siRNA sense strand
cauagacugaaaacuaaugac

SEQ ID NO: 11599 - RNA, 21 nt, Artificial Sequence
  Ebola virus siRNA sense strand
auagacugaaaacuaaugacu

SEQ ID NO: 11600 - RNA, 21 nt, Artificial Sequence
  Ebola virus siRNA sense strand
uagacugaaaacuaaugacuu

SEQ ID NO: 11601 - RNA, 21 nt, Artificial Sequence
  Ebola virus siRNA sense strand
agacugaaaacuaaugacuuu

SEQ ID NO: 11602 - RNA, 21 nt, Artificial Sequence
  Ebola virus siRNA sense strand
gacugaaaacuaaugacuuug

SEQ ID NO: 11603 - RNA, 21 nt, Artificial Sequence
  Ebola virus siRNA sense strand
acugaaaacuaaugacuuugc

SEQ ID NO: 11604 - RNA, 21 nt, Artificial Sequence
  Ebola virus siRNA sense strand
cugaaaacuaaugacuuugcc

SEQ ID NO: 11605 - RNA, 21 nt, Artificial Sequence
  Ebola virus siRNA sense strand
ugaaaacuaaugacuuugccc

SEQ ID NO: 11606 - RNA, 21 nt, Artificial Sequence
  Ebola virus siRNA sense strand
gaaaacuaaugacuuugcccc

SEQ ID NO: 11607 - RNA, 21 nt, Artificial Sequence
  Ebola virus siRNA sense strand
aaaacuaaugacuuugccccu

SEQ ID NO: 11608 - RNA, 21 nt, Artificial Sequence
  Ebola virus siRNA sense strand
aaacuaaugacuuugccccug

SEQ ID NO: 11609 - RNA, 21 nt, Artificial Sequence
  Ebola virus siRNA sense strand
aacuaaugacuuugccccugc

SEQ ID NO: 11610 - RNA, 21 nt, Artificial Sequence
  Ebola virus siRNA sense strand
acuaaugacuuugccccugca

SEQ ID NO: 11611 - RNA, 21 nt, Artificial Sequence
  Ebola virus siRNA sense strand
cuaaugacuuugccccugcau

SEQ ID NO: 11612 - RNA, 21 nt, Artificial Sequence
  Ebola virus siRNA sense strand
uaaugacuuugccccugcaug

SEQ ID NO: 11613 - RNA, 21 nt, Artificial Sequence
  Ebola virus siRNA sense strand
aaugacuuugccccugcaugg

SEQ ID NO: 11614 - RNA, 21 nt, Artificial Sequence
  Ebola virus siRNA sense strand
augacuuugccccugcauggu

SEQ ID NO: 11615 - RNA, 21 nt, Artificial Sequence
  Ebola virus siRNA sense strand
ugacuuugccccugcaugguc

SEQ ID NO: 11616 - RNA, 21 nt, Artificial Sequence
  Ebola virus siRNA sense strand
gacuuugccccugcaugguca

SEQ ID NO: 11617 - RNA, 21 nt, Artificial Sequence
  Ebola virus siRNA sense strand
acuuugccccugcauggucaa

SEQ ID NO: 11618 - RNA, 21 nt, Artificial Sequence
  Ebola virus siRNA sense strand
cuuugccccugcauggucaau

SEQ ID NO: 11619 - RNA, 21 nt, Artificial Sequence
  Ebola virus siRNA sense strand
uuugccccugcauggucaaug

SEQ ID NO: 11620 - RNA, 21 nt, Artificial Sequence
  Ebola virus siRNA sense strand
uugccccugcauggucaauga

SEQ ID NO: 11621 - RNA, 21 nt, Artificial Sequence
  Ebola virus siRNA sense strand
ugccccugcauggucaaugac

SEQ ID NO: 11622 - RNA, 21 nt, Artificial Sequence
  Ebola virus siRNA sense strand
gccccugcauggucaaugaca

SEQ ID NO: 11623 - RNA, 21 nt, Artificial Sequence
  Ebola virus siRNA sense strand
ccccugcauggucaaugacaa

SEQ ID NO: 11624 - RNA, 21 nt, Artificial Sequence
  Ebola virus siRNA sense strand
cccugcauggucaaugacaag

SEQ ID NO: 11625 - RNA, 21 nt, Artificial Sequence
  Ebola virus siRNA sense strand
ccugcauggucaaugacaagg

SEQ ID NO: 11626 - RNA, 21 nt, Artificial Sequence
  Ebola virus siRNA sense strand
cugcauggucaaugacaagga

SEQ ID NO: 11627 - RNA, 21 nt, Artificial Sequence
  Ebola virus siRNA sense strand
ugcauggucaaugacaaggaa

SEQ ID NO: 11628 - RNA, 21 nt, Artificial Sequence
  Ebola virus siRNA sense strand
gcauggucaaugacaaggaau

SEQ ID NO: 11629 - RNA, 21 nt, Artificial Sequence
  Ebola virus siRNA sense strand
cauggucaaugacaaggaauc

SEQ ID NO: 11630 - RNA, 21 nt, Artificial Sequence
  Ebola virus siRNA sense strand
auggucaaugacaaggaaucu

SEQ ID NO: 11631 - RNA, 21 nt, Artificial Sequence
  Ebola virus siRNA sense strand
uggucaaugacaaggaaucuc

SEQ ID NO: 11632 - RNA, 21 nt, Artificial Sequence
  Ebola virus siRNA sense strand
ggucaaugacaaggaaucucu

SEQ ID NO: 11633 - RNA, 21 nt, Artificial Sequence
  Ebola virus siRNA sense strand
gucaaugacaaggaaucucuu

SEQ ID NO: 11634 - RNA, 21 nt, Artificial Sequence
  Ebola virus siRNA sense strand
ucaaugacaaggaaucucuuu

SEQ ID NO: 11635 - RNA, 21 nt, Artificial Sequence
  Ebola virus siRNA sense strand
caaugacaaggaaucucuuuc

SEQ ID NO: 11636 - RNA, 21 nt, Artificial Sequence
  Ebola virus siRNA sense strand
aaugacaaggaaucucuuucc

SEQ ID NO: 11637 - RNA, 21 nt, Artificial Sequence
  Ebola virus siRNA sense strand
augacaaggaaucucuuuccu

SEQ ID NO: 11638 - RNA, 21 nt, Artificial Sequence
  Ebola virus siRNA sense strand
ugacaaggaaucucuuuccuc

SEQ ID NO: 11639 - RNA, 21 nt, Artificial Sequence
  Ebola virus siRNA sense strand
gacaaggaaucucuuuccuca

SEQ ID NO: 11640 - RNA, 21 nt, Artificial Sequence
  Ebola virus siRNA sense strand
acaaggaaucucuuuccucau

SEQ ID NO: 11641 - RNA, 21 nt, Artificial Sequence
  Ebola virus siRNA sense strand
caaggaaucucuuuccucauu

SEQ ID NO: 11642 - RNA, 21 nt, Artificial Sequence
  Ebola virus siRNA sense strand
aaggaaucucuuuccucauuu

SEQ ID NO: 11643 - RNA, 21 nt, Artificial Sequence
  Ebola virus siRNA sense strand
aggaaucucuuuccucauuua

SEQ ID NO: 11644 - RNA, 21 nt, Artificial Sequence
  Ebola virus siRNA sense strand
ggaaucucuuuccucauuuau

SEQ ID NO: 11645 - RNA, 21 nt, Artificial Sequence
  Ebola virus siRNA sense strand
gaaucucuuuccucauuuauu

SEQ ID NO: 11646 - RNA, 21 nt, Artificial Sequence
  Ebola virus siRNA sense strand
aaucucuuuccucauuuauuu

SEQ ID NO: 11647 - RNA, 21 nt, Artificial Sequence
  Ebola virus siRNA sense strand
aucucuuuccucauuuauuuc

SEQ ID NO: 11648 - RNA, 21 nt, Artificial Sequence
  Ebola virus siRNA sense strand
ucucuuuccucauuuauuuca

SEQ ID NO: 11649 - RNA, 21 nt, Artificial Sequence
  Ebola virus siRNA sense strand
cucuuuccucauuuauuucaa

SEQ ID NO: 11650 - RNA, 21 nt, Artificial Sequence
  Ebola virus siRNA sense strand
ucuuuccucauuuauuucaaa

SEQ ID NO: 11651 - RNA, 21 nt, Artificial Sequence
  Ebola virus siRNA sense strand
cuuuccucauuuauuucaaaa

SEQ ID NO: 11652 - RNA, 21 nt, Artificial Sequence
  Ebola virus siRNA sense strand
uuuccucauuuauuucaaaau

SEQ ID NO: 11653 - RNA, 21 nt, Artificial Sequence
  Ebola virus siRNA sense strand
uuccucauuuauuucaaaauc

SEQ ID NO: 11654 - RNA, 21 nt, Artificial Sequence
  Ebola virus siRNA sense strand
uccucauuuauuucaaaaucc

SEQ ID NO: 11655 - RNA, 21 nt, Artificial Sequence
  Ebola virus siRNA sense strand
ccucauuuauuucaaaauccg

SEQ ID NO: 11656 - RNA, 21 nt, Artificial Sequence
  Ebola virus siRNA sense strand
cucauuuauuucaaaauccga

SEQ ID NO: 11657 - RNA, 21 nt, Artificial Sequence
  Ebola virus siRNA sense strand
ucauuuauuucaaaauccgaa

SEQ ID NO: 11658 - RNA, 21 nt, Artificial Sequence
  Ebola virus siRNA sense strand
cauuuauuucaaaauccgaau

SEQ ID NO: 11659 - RNA, 21 nt, Artificial Sequence
  Ebola virus siRNA sense strand
auuuauuucaaaauccgaauu

SEQ ID NO: 11660 - RNA, 21 nt, Artificial Sequence
  Ebola virus siRNA sense strand
uuuauuucaaaauccgaauuc

SEQ ID NO: 11661 - RNA, 21 nt, Artificial Sequence
  Ebola virus siRNA sense strand
uuauuucaaaauccgaauucc

SEQ ID NO: 11662 - RNA, 21 nt, Artificial Sequence
  Ebola virus siRNA sense strand
uauuucaaaauccgaauucca

SEQ ID NO: 11663 - RNA, 21 nt, Artificial Sequence
  Ebola virus siRNA sense strand
auuucaaaauccgaauuccac

SEQ ID NO: 11664 - RNA, 21 nt, Artificial Sequence
  Ebola virus siRNA sense strand
uuucaaaauccgaauuccaca

SEQ ID NO: 11665 - RNA, 21 nt, Artificial Sequence
  Ebola virus siRNA sense strand
uucaaaauccgaauuccacaa

SEQ ID NO: 11666 - RNA, 21 nt, Artificial Sequence
  Ebola virus siRNA sense strand
ucaaaauccgaauuccacaau

SEQ ID NO: 11667 - RNA, 21 nt, Artificial Sequence
  Ebola virus siRNA sense strand
caaaauccgaauuccacaauu

SEQ ID NO: 11668 - RNA, 21 nt, Artificial Sequence
  Ebola virus siRNA sense strand
aaaauccgaauuccacaauug

SEQ ID NO: 11669 - RNA, 21 nt, Artificial Sequence
  Ebola virus siRNA sense strand
aaauccgaauuccacaauuga

SEQ ID NO: 11670 - RNA, 21 nt, Artificial Sequence
  Ebola virus siRNA sense strand
aauccgaauuccacaauugaa

SEQ ID NO: 11671 - RNA, 21 nt, Artificial Sequence
  Ebola virus siRNA sense strand
auccgaauuccacaauugaau

SEQ ID NO: 11672 - RNA, 21 nt, Artificial Sequence
  Ebola virus siRNA sense strand
uccgaauuccacaauugaauc

SEQ ID NO: 11673 - RNA, 21 nt, Artificial Sequence
  Ebola virus siRNA sense strand
ccgaauuccacaauugaauca

SEQ ID NO: 11674 - RNA, 21 nt, Artificial Sequence
  Ebola virus siRNA sense strand
cgaauuccacaauugaaucac

SEQ ID NO: 11675 - RNA, 21 nt, Artificial Sequence
  Ebola virus siRNA sense strand
gaauuccacaauugaaucacc

SEQ ID NO: 11676 - RNA, 21 nt, Artificial Sequence
  Ebola virus siRNA sense strand
aauuccacaauugaaucaccg

SEQ ID NO: 11677 - RNA, 21 nt, Artificial Sequence
  Ebola virus siRNA sense strand
auuccacaauugaaucaccgc

SEQ ID NO: 11678 - RNA, 21 nt, Artificial Sequence
  Ebola virus siRNA sense strand
uuccacaauugaaucaccgcu

SEQ ID NO: 11679 - RNA, 21 nt, Artificial Sequence
  Ebola virus siRNA sense strand
uccacaauugaaucaccgcug

SEQ ID NO: 11680 - RNA, 21 nt, Artificial Sequence
  Ebola virus siRNA sense strand
ccacaauugaaucaccgcugu

SEQ ID NO: 11681 - RNA, 21 nt, Artificial Sequence
  Ebola virus siRNA sense strand
cacaauugaaucaccgcugug

SEQ ID NO: 11682 - RNA, 21 nt, Artificial Sequence
  Ebola virus siRNA sense strand
acaauugaaucaccgcugugg

SEQ ID NO: 11683 - RNA, 21 nt, Artificial Sequence
  Ebola virus siRNA sense strand
caauugaaucaccgcuguggg

SEQ ID NO: 11684 - RNA, 21 nt, Artificial Sequence
  Ebola virus siRNA sense strand
aauugaaucaccgcugugggc

SEQ ID NO: 11685 - RNA, 21 nt, Artificial Sequence
  Ebola virus siRNA sense strand
auugaaucaccgcugugggca

SEQ ID NO: 11686 - RNA, 21 nt, Artificial Sequence
  Ebola virus siRNA sense strand
uugaaucaccgcugugggcau

SEQ ID NO: 11687 - RNA, 21 nt, Artificial Sequence
  Ebola virus siRNA sense strand
ugaaucaccgcugugggcauu

SEQ ID NO: 11688 - RNA, 21 nt, Artificial Sequence
  Ebola virus siRNA sense strand
gaaucaccgcugugggcauug

SEQ ID NO: 11689 - RNA, 21 nt, Artificial Sequence
  Ebola virus siRNA sense strand
aaucaccgcugugggcauuga

SEQ ID NO: 11690 - RNA, 21 nt, Artificial Sequence
  Ebola virus siRNA sense strand
aucaccgcugugggcauugag

SEQ ID NO: 11691 - RNA, 21 nt, Artificial Sequence
  Ebola virus siRNA sense strand
ucaccgcugugggcauugaga

SEQ ID NO: 11692 - RNA, 21 nt, Artificial Sequence
  Ebola virus siRNA sense strand
caccgcugugggcauugagag

SEQ ID NO: 11693 - RNA, 21 nt, Artificial Sequence
  Ebola virus siRNA sense strand
accgcugugggcauugagagu

SEQ ID NO: 11694 - RNA, 21 nt, Artificial Sequence
  Ebola virus siRNA sense strand
ccgcugugggcauugagaguc

SEQ ID NO: 11695 - RNA, 21 nt, Artificial Sequence
  Ebola virus siRNA sense strand
cgcugugggcauugagaguca

SEQ ID NO: 11696 - RNA, 21 nt, Artificial Sequence
  Ebola virus siRNA sense strand
gcugugggcauugagagucau

SEQ ID NO: 11697 - RNA, 21 nt, Artificial Sequence
  Ebola virus siRNA sense strand
cugugggcauugagagucauc

SEQ ID NO: 11698 - RNA, 21 nt, Artificial Sequence
  Ebola virus siRNA sense strand
ugugggcauugagagucaucc

SEQ ID NO: 11699 - RNA, 21 nt, Artificial Sequence
  Ebola virus siRNA sense strand
gugggcauugagagucauccu

SEQ ID NO: 11700 - RNA, 21 nt, Artificial Sequence
  Ebola virus siRNA sense strand
ugggcauugagagucauccuu

SEQ ID NO: 11701 - RNA, 21 nt, Artificial Sequence
  Ebola virus siRNA sense strand
gggcauugagagucauccuug

SEQ ID NO: 11702 - RNA, 21 nt, Artificial Sequence
  Ebola virus siRNA sense strand
ggcauugagagucauccuugc

SEQ ID NO: 11703 - RNA, 21 nt, Artificial Sequence
  Ebola virus siRNA sense strand
gcauugagagucauccuugca

SEQ ID NO: 11704 - RNA, 21 nt, Artificial Sequence
  Ebola virus siRNA sense strand
cauugagagucauccuugcag

SEQ ID NO: 11705 - RNA, 21 nt, Artificial Sequence
  Ebola virus siRNA sense strand
auugagagucauccuugcagc

SEQ ID NO: 11706 - RNA, 21 nt, Artificial Sequence
  Ebola virus siRNA sense strand
uugagagucauccuugcagca

SEQ ID NO: 11707 - RNA, 21 nt, Artificial Sequence
  Ebola virus siRNA sense strand
ugagagucauccuugcagcag

SEQ ID NO: 11708 - RNA, 21 nt, Artificial Sequence
  Ebola virus siRNA sense strand
gagagucauccuugcagcagg

SEQ ID NO: 11709 - RNA, 21 nt, Artificial Sequence
  Ebola virus siRNA sense strand
agagucauccuugcagcaggg

SEQ ID NO: 11710 - RNA, 21 nt, Artificial Sequence
  Ebola virus siRNA sense strand
gagucauccuugcagcaggga

SEQ ID NO: 11711 - RNA, 21 nt, Artificial Sequence
  Ebola virus siRNA sense strand
agucauccuugcagcagggau

SEQ ID NO: 11712 - RNA, 21 nt, Artificial Sequence
  Ebola virus siRNA sense strand
gucauccuugcagcagggaua

SEQ ID NO: 11713 - RNA, 21 nt, Artificial Sequence
  Ebola virus siRNA sense strand
ucauccuugcagcagggauac

SEQ ID NO: 11714 - RNA, 21 nt, Artificial Sequence
  Ebola virus siRNA sense strand
cauccuugcagcagggauaca

SEQ ID NO: 11715 - RNA, 21 nt, Artificial Sequence
  Ebola virus siRNA sense strand
auccuugcagcagggauacag

SEQ ID NO: 11716 - RNA, 21 nt, Artificial Sequence
  Ebola virus siRNA sense strand
uccuugcagcagggauacagg

SEQ ID NO: 11717 - RNA, 21 nt, Artificial Sequence
  Ebola virus siRNA sense strand
ccuugcagcagggauacagga

SEQ ID NO: 11718 - RNA, 21 nt, Artificial Sequence
  Ebola virus siRNA sense strand
cuugcagcagggauacaggac

SEQ ID NO: 11719 - RNA, 21 nt, Artificial Sequence
  Ebola virus siRNA sense strand
uugcagcagggauacaggacc

SEQ ID NO: 11720 - RNA, 21 nt, Artificial Sequence
  Ebola virus siRNA sense strand
ugcagcagggauacaggacca

SEQ ID NO: 11721 - RNA, 21 nt, Artificial Sequence
  Ebola virus siRNA sense strand
gcagcagggauacaggaccag

SEQ ID NO: 11722 - RNA, 21 nt, Artificial Sequence
  Ebola virus siRNA sense strand
cagcagggauacaggaccagc

SEQ ID NO: 11723 - RNA, 21 nt, Artificial Sequence
  Ebola virus siRNA sense strand
agcagggauacaggaccagcu

SEQ ID NO: 11724 - RNA, 21 nt, Artificial Sequence
  Ebola virus siRNA sense strand
gcagggauacaggaccagcug

SEQ ID NO: 11725 - RNA, 21 nt, Artificial Sequence
  Ebola virus siRNA sense strand
cagggauacaggaccagcuga

SEQ ID NO: 11726 - RNA, 21 nt, Artificial Sequence
  Ebola virus siRNA sense strand
agggauacaggaccagcugau

SEQ ID NO: 11727 - RNA, 21 nt, Artificial Sequence
  Ebola virus siRNA sense strand
gggauacaggaccagcugauu

SEQ ID NO: 11728 - RNA, 21 nt, Artificial Sequence
  Ebola virus siRNA sense strand
ggauacaggaccagcugauug

SEQ ID NO: 11729 - RNA, 21 nt, Artificial Sequence
  Ebola virus siRNA sense strand
gauacaggaccagcugauuga

SEQ ID NO: 11730 - RNA, 21 nt, Artificial Sequence
  Ebola virus siRNA sense strand
auacaggaccagcugauugac

SEQ ID NO: 11731 - RNA, 21 nt, Artificial Sequence
  Ebola virus siRNA sense strand
uacaggaccagcugauugacc

SEQ ID NO: 11732 - RNA, 21 nt, Artificial Sequence
  Ebola virus siRNA sense strand
acaggaccagcugauugacca

SEQ ID NO: 11733 - RNA, 21 nt, Artificial Sequence
  Ebola virus siRNA sense strand
caggaccagcugauugaccag

SEQ ID NO: 11734 - RNA, 21 nt, Artificial Sequence
  Ebola virus siRNA sense strand
aggaccagcugauugaccagu

SEQ ID NO: 11735 - RNA, 21 nt, Artificial Sequence
  Ebola virus siRNA sense strand
ggaccagcugauugaccaguc

SEQ ID NO: 11736 - RNA, 21 nt, Artificial Sequence
  Ebola virus siRNA sense strand
gaccagcugauugaccagucu

SEQ ID NO: 11737 - RNA, 21 nt, Artificial Sequence
  Ebola virus siRNA sense strand
accagcugauugaccagucuu

SEQ ID NO: 11738 - RNA, 21 nt, Artificial Sequence
  Ebola virus siRNA sense strand
ccagcugauugaccagucuuu

SEQ ID NO: 11739 - RNA, 21 nt, Artificial Sequence
  Ebola virus siRNA sense strand
cagcugauugaccagucuuug

SEQ ID NO: 11740 - RNA, 21 nt, Artificial Sequence
  Ebola virus siRNA sense strand
agcugauugaccagucuuuga

SEQ ID NO: 11741 - RNA, 21 nt, Artificial Sequence
  Ebola virus siRNA sense strand
gcugauugaccagucuuugau

SEQ ID NO: 11742 - RNA, 21 nt, Artificial Sequence
  Ebola virus siRNA sense strand
cugauugaccagucuuugauu

SEQ ID NO: 11743 - RNA, 21 nt, Artificial Sequence
  Ebola virus siRNA sense strand
ugauugaccagucuuugauug

SEQ ID NO: 11744 - RNA, 21 nt, Artificial Sequence
  Ebola virus siRNA sense strand
gauugaccagucuuugauuga

SEQ ID NO: 11745 - RNA, 21 nt, Artificial Sequence
  Ebola virus siRNA sense strand
auugaccagucuuugauugaa

SEQ ID NO: 11746 - RNA, 21 nt, Artificial Sequence
  Ebola virus siRNA sense strand
uugaccagucuuugauugaac

SEQ ID NO: 11747 - RNA, 21 nt, Artificial Sequence
  Ebola virus siRNA sense strand
ugaccagucuuugauugaacc

SEQ ID NO: 11748 - RNA, 21 nt, Artificial Sequence
  Ebola virus siRNA sense strand
gaccagucuuugauugaaccc

SEQ ID NO: 11749 - RNA, 21 nt, Artificial Sequence
  Ebola virus siRNA sense strand
accagucuuugauugaacccu

SEQ ID NO: 11750 - RNA, 21 nt, Artificial Sequence
  Ebola virus siRNA sense strand
ccagucuuugauugaacccuu

SEQ ID NO: 11751 - RNA, 21 nt, Artificial Sequence
  Ebola virus siRNA sense strand
cagucuuugauugaacccuua

SEQ ID NO: 11752 - RNA, 21 nt, Artificial Sequence
  Ebola virus siRNA sense strand
agucuuugauugaacccuuag

SEQ ID NO: 11753 - RNA, 21 nt, Artificial Sequence
  Ebola virus siRNA sense strand
gucuuugauugaacccuuagc

SEQ ID NO: 11754 - RNA, 21 nt, Artificial Sequence
  Ebola virus siRNA sense strand
ucuuugauugaacccuuagca

SEQ ID NO: 11755 - RNA, 21 nt, Artificial Sequence
  Ebola virus siRNA sense strand
cuuugauugaacccuuagcag

SEQ ID NO: 11756 - RNA, 21 nt, Artificial Sequence
  Ebola virus siRNA sense strand
uuugauugaacccuuagcagg

SEQ ID NO: 11757 - RNA, 21 nt, Artificial Sequence
  Ebola virus siRNA sense strand
uugauugaacccuuagcagga

SEQ ID NO: 11758 - RNA, 21 nt, Artificial Sequence
  Ebola virus siRNA sense strand
ugauugaacccuuagcaggag

SEQ ID NO: 11759 - RNA, 21 nt, Artificial Sequence
  Ebola virus siRNA sense strand
gauugaacccuuagcaggagc

SEQ ID NO: 11760 - RNA, 21 nt, Artificial Sequence
  Ebola virus siRNA sense strand
auugaacccuuagcaggagcc

SEQ ID NO: 11761 - RNA, 21 nt, Artificial Sequence
  Ebola virus siRNA sense strand
uugaacccuuagcaggagccc

SEQ ID NO: 11762 - RNA, 21 nt, Artificial Sequence
  Ebola virus siRNA sense strand
ugaacccuuagcaggagcccu

SEQ ID NO: 11763 - RNA, 21 nt, Artificial Sequence
  Ebola virus siRNA sense strand
gaacccuuagcaggagcccuu

SEQ ID NO: 11764 - RNA, 21 nt, Artificial Sequence
  Ebola virus siRNA sense strand
aacccuuagcaggagcccuug

SEQ ID NO: 11765 - RNA, 21 nt, Artificial Sequence
  Ebola virus siRNA sense strand
acccuuagcaggagcccuugg

SEQ ID NO: 11766 - RNA, 21 nt, Artificial Sequence
  Ebola virus siRNA sense strand
cccuuagcaggagcccuuggu

SEQ ID NO: 11767 - RNA, 21 nt, Artificial Sequence
  Ebola virus siRNA sense strand
ccuuagcaggagcccuugguc

SEQ ID NO: 11768 - RNA, 21 nt, Artificial Sequence
  Ebola virus siRNA sense strand
cuuagcaggagcccuuggucu

SEQ ID NO: 11769 - RNA, 21 nt, Artificial Sequence
  Ebola virus siRNA sense strand
uuagcaggagcccuuggucug

SEQ ID NO: 11770 - RNA, 21 nt, Artificial Sequence
  Ebola virus siRNA sense strand
uagcaggagcccuuggucuga

SEQ ID NO: 11771 - RNA, 21 nt, Artificial Sequence
  Ebola virus siRNA sense strand
agcaggagcccuuggucugau

SEQ ID NO: 11772 - RNA, 21 nt, Artificial Sequence
  Ebola virus siRNA sense strand
gcaggagcccuuggucugauc

SEQ ID NO: 11773 - RNA, 21 nt, Artificial Sequence
  Ebola virus siRNA sense strand
caggagcccuuggucugaucu

SEQ ID NO: 11774 - RNA, 21 nt, Artificial Sequence
  Ebola virus siRNA sense strand
aggagcccuuggucugaucuc

SEQ ID NO: 11775 - RNA, 21 nt, Artificial Sequence
  Ebola virus siRNA sense strand
ggagcccuuggucugaucucu

SEQ ID NO: 11776 - RNA, 21 nt, Artificial Sequence
  Ebola virus siRNA sense strand
gagcccuuggucugaucucug

SEQ ID NO: 11777 - RNA, 21 nt, Artificial Sequence
  Ebola virus siRNA sense strand
agcccuuggucugaucucuga

SEQ ID NO: 11778 - RNA, 21 nt, Artificial Sequence
  Ebola virus siRNA sense strand
gcccuuggucugaucucugau

SEQ ID NO: 11779 - RNA, 21 nt, Artificial Sequence
  Ebola virus siRNA sense strand
cccuuggucugaucucugauu

SEQ ID NO: 11780 - RNA, 21 nt, Artificial Sequence
  Ebola virus siRNA sense strand
ccuuggucugaucucugauug

SEQ ID NO: 11781 - RNA, 21 nt, Artificial Sequence
  Ebola virus siRNA sense strand
cuuggucugaucucugauugg

SEQ ID NO: 11782 - RNA, 21 nt, Artificial Sequence
  Ebola virus siRNA sense strand
uuggucugaucucugauuggc

SEQ ID NO: 11783 - RNA, 21 nt, Artificial Sequence
  Ebola virus siRNA sense strand
uggucugaucucugauuggcu

SEQ ID NO: 11784 - RNA, 21 nt, Artificial Sequence
  Ebola virus siRNA sense strand
ggucugaucucugauuggcug

SEQ ID NO: 11785 - RNA, 21 nt, Artificial Sequence
  Ebola virus siRNA sense strand
gucugaucucugauuggcugc

SEQ ID NO: 11786 - RNA, 21 nt, Artificial Sequence
  Ebola virus siRNA sense strand
ucugaucucugauuggcugcu

SEQ ID NO: 11787 - RNA, 21 nt, Artificial Sequence
  Ebola virus siRNA sense strand
cugaucucugauuggcugcua

SEQ ID NO: 11788 - RNA, 21 nt, Artificial Sequence
  Ebola virus siRNA sense strand
ugaucucugauuggcugcuaa

SEQ ID NO: 11789 - RNA, 21 nt, Artificial Sequence
  Ebola virus siRNA sense strand
gaucucugauuggcugcuaac

SEQ ID NO: 11790 - RNA, 21 nt, Artificial Sequence
  Ebola virus siRNA sense strand
aucucugauuggcugcuaaca

SEQ ID NO: 11791 - RNA, 21 nt, Artificial Sequence
  Ebola virus siRNA sense strand
ucucugauuggcugcuaacaa

SEQ ID NO: 11792 - RNA, 21 nt, Artificial Sequence
  Ebola virus siRNA sense strand
cucugauuggcugcuaacaac

SEQ ID NO: 11793 - RNA, 21 nt, Artificial Sequence
  Ebola virus siRNA sense strand
ucugauuggcugcuaacaacc

SEQ ID NO: 11794 - RNA, 21 nt, Artificial Sequence
  Ebola virus siRNA sense strand
cugauuggcugcuaacaacca

SEQ ID NO: 11795 - RNA, 21 nt, Artificial Sequence
  Ebola virus siRNA sense strand
ugauuggcugcuaacaaccaa

SEQ ID NO: 11796 - RNA, 21 nt, Artificial Sequence
  Ebola virus siRNA sense strand
gauuggcugcuaacaaccaac

SEQ ID NO: 11797 - RNA, 21 nt, Artificial Sequence
  Ebola virus siRNA sense strand
auuggcugcuaacaaccaaca

SEQ ID NO: 11798 - RNA, 21 nt, Artificial Sequence
  Ebola virus siRNA sense strand
uuggcugcuaacaaccaacac

SEQ ID NO: 11799 - RNA, 21 nt, Artificial Sequence
  Ebola virus siRNA sense strand
uggcugcuaacaaccaacacu

SEQ ID NO: 11800 - RNA, 21 nt, Artificial Sequence
  Ebola virus siRNA sense strand
ggcugcuaacaaccaacacua

SEQ ID NO: 11801 - RNA, 21 nt, Artificial Sequence
  Ebola virus siRNA sense strand
gcugcuaacaaccaacacuaa

SEQ ID NO: 11802 - RNA, 21 nt, Artificial Sequence
  Ebola virus siRNA sense strand
cugcuaacaaccaacacuaac

SEQ ID NO: 11803 - RNA, 21 nt, Artificial Sequence
  Ebola virus siRNA sense strand
ugcuaacaaccaacacuaacc

SEQ ID NO: 11804 - RNA, 21 nt, Artificial Sequence
  Ebola virus siRNA sense strand
gcuaacaaccaacacuaacca

SEQ ID NO: 11805 - RNA, 21 nt, Artificial Sequence
  Ebola virus siRNA sense strand
cuaacaaccaacacuaaccau

SEQ ID NO: 11806 - RNA, 21 nt, Artificial Sequence
  Ebola virus siRNA sense strand
uaacaaccaacacuaaccauu

SEQ ID NO: 11807 - RNA, 21 nt, Artificial Sequence
  Ebola virus siRNA sense strand
aacaaccaacacuaaccauuu

SEQ ID NO: 11808 - RNA, 21 nt, Artificial Sequence
  Ebola virus siRNA sense strand
acaaccaacacuaaccauuuc

SEQ ID NO: 11809 - RNA, 21 nt, Artificial Sequence
  Ebola virus siRNA sense strand
caaccaacacuaaccauuuca

SEQ ID NO: 11810 - RNA, 21 nt, Artificial Sequence
  Ebola virus siRNA sense strand
aaccaacacuaaccauuucaa

SEQ ID NO: 11811 - RNA, 21 nt, Artificial Sequence
  Ebola virus siRNA sense strand
accaacacuaaccauuucaac

SEQ ID NO: 11812 - RNA, 21 nt, Artificial Sequence
  Ebola virus siRNA sense strand
ccaacacuaaccauuucaaca

SEQ ID NO: 11813 - RNA, 21 nt, Artificial Sequence
  Ebola virus siRNA sense strand
caacacuaaccauuucaacau

SEQ ID NO: 11814 - RNA, 21 nt, Artificial Sequence
  Ebola virus siRNA sense strand
aacacuaaccauuucaacaug

SEQ ID NO: 11815 - RNA, 21 nt, Artificial Sequence
  Ebola virus siRNA sense strand
acacuaaccauuucaacaugc

SEQ ID NO: 11816 - RNA, 21 nt, Artificial Sequence
  Ebola virus siRNA sense strand
cacuaaccauuucaacaugcg

SEQ ID NO: 11817 - RNA, 21 nt, Artificial Sequence
  Ebola virus siRNA sense strand
acuaaccauuucaacaugcga

SEQ ID NO: 11818 - RNA, 21 nt, Artificial Sequence
  Ebola virus siRNA sense strand
cuaaccauuucaacaugcgaa

SEQ ID NO: 11819 - RNA, 21 nt, Artificial Sequence
  Ebola virus siRNA sense strand
uaaccauuucaacaugcgaac

SEQ ID NO: 11820 - RNA, 21 nt, Artificial Sequence
  Ebola virus siRNA sense strand
aaccauuucaacaugcgaaca

SEQ ID NO: 11821 - RNA, 21 nt, Artificial Sequence
  Ebola virus siRNA sense strand
accauuucaacaugcgaacac

SEQ ID NO: 11822 - RNA, 21 nt, Artificial Sequence
  Ebola virus siRNA sense strand
ccauuucaacaugcgaacaca

SEQ ID NO: 11823 - RNA, 21 nt, Artificial Sequence
  Ebola virus siRNA sense strand
cauuucaacaugcgaacacaa

SEQ ID NO: 11824 - RNA, 21 nt, Artificial Sequence
  Ebola virus siRNA sense strand
auuucaacaugcgaacacaac

SEQ ID NO: 11825 - RNA, 21 nt, Artificial Sequence
  Ebola virus siRNA sense strand
uuucaacaugcgaacacaacg

SEQ ID NO: 11826 - RNA, 21 nt, Artificial Sequence
  Ebola virus siRNA sense strand
uucaacaugcgaacacaacgu

SEQ ID NO: 11827 - RNA, 21 nt, Artificial Sequence
  Ebola virus siRNA sense strand
ucaacaugcgaacacaacgug

SEQ ID NO: 11828 - RNA, 21 nt, Artificial Sequence
  Ebola virus siRNA sense strand
caacaugcgaacacaacgugu

SEQ ID NO: 11829 - RNA, 21 nt, Artificial Sequence
  Ebola virus siRNA sense strand
aacaugcgaacacaacguguc

SEQ ID NO: 11830 - RNA, 21 nt, Artificial Sequence
  Ebola virus siRNA sense strand
acaugcgaacacaacguguca

SEQ ID NO: 11831 - RNA, 21 nt, Artificial Sequence
  Ebola virus siRNA sense strand
caugcgaacacaacgugucaa

SEQ ID NO: 11832 - RNA, 21 nt, Artificial Sequence
  Ebola virus siRNA sense strand
augcgaacacaacgugucaag

SEQ ID NO: 11833 - RNA, 21 nt, Artificial Sequence
  Ebola virus siRNA sense strand
ugcgaacacaacgugucaagg

SEQ ID NO: 11834 - RNA, 21 nt, Artificial Sequence
  Ebola virus siRNA sense strand
gcgaacacaacgugucaagga

SEQ ID NO: 11835 - RNA, 21 nt, Artificial Sequence
  Ebola virus siRNA sense strand
cgaacacaacgugucaaggaa

SEQ ID NO: 11836 - RNA, 21 nt, Artificial Sequence
  Ebola virus siRNA sense strand
gaacacaacgugucaaggaac

SEQ ID NO: 11837 - RNA, 21 nt, Artificial Sequence
  Ebola virus siRNA sense strand
aacacaacgugucaaggaaca

SEQ ID NO: 11838 - RNA, 21 nt, Artificial Sequence
  Ebola virus siRNA sense strand
acacaacgugucaaggaacaa

SEQ ID NO: 11839 - RNA, 21 nt, Artificial Sequence
  Ebola virus siRNA sense strand
cacaacgugucaaggaacaau

SEQ ID NO: 11840 - RNA, 21 nt, Artificial Sequence
  Ebola virus siRNA sense strand
acaacgugucaaggaacaauu

SEQ ID NO: 11841 - RNA, 21 nt, Artificial Sequence
  Ebola virus siRNA sense strand
caacgugucaaggaacaauug

SEQ ID NO: 11842 - RNA, 21 nt, Artificial Sequence
  Ebola virus siRNA sense strand
aacgugucaaggaacaauuga

SEQ ID NO: 11843 - RNA, 21 nt, Artificial Sequence
  Ebola virus siRNA sense strand
acgugucaaggaacaauugag

SEQ ID NO: 11844 - RNA, 21 nt, Artificial Sequence
  Ebola virus siRNA sense strand
cgugucaaggaacaauugagc

SEQ ID NO: 11845 - RNA, 21 nt, Artificial Sequence
  Ebola virus siRNA sense strand
gugucaaggaacaauugagcc

SEQ ID NO: 11846 - RNA, 21 nt, Artificial Sequence
  Ebola virus siRNA sense strand
ugucaaggaacaauugagccu

SEQ ID NO: 11847 - RNA, 21 nt, Artificial Sequence
  Ebola virus siRNA sense strand
gucaaggaacaauugagccua

SEQ ID NO: 11848 - RNA, 21 nt, Artificial Sequence
  Ebola virus siRNA sense strand
ucaaggaacaauugagccuaa

SEQ ID NO: 11849 - RNA, 21 nt, Artificial Sequence
  Ebola virus siRNA sense strand
caaggaacaauugagccuaaa

SEQ ID NO: 11850 - RNA, 21 nt, Artificial Sequence
  Ebola virus siRNA sense strand
aaggaacaauugagccuaaaa

SEQ ID NO: 11851 - RNA, 21 nt, Artificial Sequence
  Ebola virus siRNA sense strand
aggaacaauugagccuaaaaa

SEQ ID NO: 11852 - RNA, 21 nt, Artificial Sequence
  Ebola virus siRNA sense strand
ggaacaauugagccuaaaaau

SEQ ID NO: 11853 - RNA, 21 nt, Artificial Sequence
  Ebola virus siRNA sense strand
gaacaauugagccuaaaaaug

SEQ ID NO: 11854 - RNA, 21 nt, Artificial Sequence
  Ebola virus siRNA sense strand
aacaauugagccuaaaaaugc

SEQ ID NO: 11855 - RNA, 21 nt, Artificial Sequence
  Ebola virus siRNA sense strand
acaauugagccuaaaaaugcu

SEQ ID NO: 11856 - RNA, 21 nt, Artificial Sequence
  Ebola virus siRNA sense strand
caauugagccuaaaaaugcug

SEQ ID NO: 11857 - RNA, 21 nt, Artificial Sequence
  Ebola virus siRNA sense strand
aauugagccuaaaaaugcugu

SEQ ID NO: 11858 - RNA, 21 nt, Artificial Sequence
  Ebola virus siRNA sense strand
auugagccuaaaaaugcuguc

SEQ ID NO: 11859 - RNA, 21 nt, Artificial Sequence
  Ebola virus siRNA sense strand
uugagccuaaaaaugcugucg

SEQ ID NO: 11860 - RNA, 21 nt, Artificial Sequence
  Ebola virus siRNA sense strand
ugagccuaaaaaugcugucgu

SEQ ID NO: 11861 - RNA, 21 nt, Artificial Sequence
  Ebola virus siRNA sense strand
gagccuaaaaaugcugucguu

SEQ ID NO: 11862 - RNA, 21 nt, Artificial Sequence
  Ebola virus siRNA sense strand
agccuaaaaaugcugucguug

SEQ ID NO: 11863 - RNA, 21 nt, Artificial Sequence
  Ebola virus siRNA sense strand
gccuaaaaaugcugucguuga

SEQ ID NO: 11864 - RNA, 21 nt, Artificial Sequence
  Ebola virus siRNA sense strand
ccuaaaaaugcugucguugau

SEQ ID NO: 11865 - RNA, 21 nt, Artificial Sequence
  Ebola virus siRNA sense strand
cuaaaaaugcugucguugauu

SEQ ID NO: 11866 - RNA, 21 nt, Artificial Sequence
  Ebola virus siRNA sense strand
uaaaaaugcugucguugauuc

SEQ ID NO: 11867 - RNA, 21 nt, Artificial Sequence
  Ebola virus siRNA sense strand
aaaaaugcugucguugauucg

SEQ ID NO: 11868 - RNA, 21 nt, Artificial Sequence
  Ebola virus siRNA sense strand
aaaaugcugucguugauucga

SEQ ID NO: 11869 - RNA, 21 nt, Artificial Sequence
  Ebola virus siRNA sense strand
aaaugcugucguugauucgau

SEQ ID NO: 11870 - RNA, 21 nt, Artificial Sequence
  Ebola virus siRNA sense strand
aaugcugucguugauucgauc

SEQ ID NO: 11871 - RNA, 21 nt, Artificial Sequence
  Ebola virus siRNA sense strand
augcugucguugauucgaucc

SEQ ID NO: 11872 - RNA, 21 nt, Artificial Sequence
  Ebola virus siRNA sense strand
ugcugucguugauucgaucca

SEQ ID NO: 11873 - RNA, 21 nt, Artificial Sequence
  Ebola virus siRNA sense strand
gcugucguugauucgauccaa

SEQ ID NO: 11874 - RNA, 21 nt, Artificial Sequence
  Ebola virus siRNA sense strand
cugucguugauucgauccaau

SEQ ID NO: 11875 - RNA, 21 nt, Artificial Sequence
  Ebola virus siRNA sense strand
ugucguugauucgauccaaua

SEQ ID NO: 11876 - RNA, 21 nt, Artificial Sequence
  Ebola virus siRNA sense strand
gucguugauucgauccaauau

SEQ ID NO: 11877 - RNA, 21 nt, Artificial Sequence
  Ebola virus siRNA sense strand
ucguugauucgauccaauauu

SEQ ID NO: 11878 - RNA, 21 nt, Artificial Sequence
  Ebola virus siRNA sense strand
cguugauucgauccaauauuc

SEQ ID NO: 11879 - RNA, 21 nt, Artificial Sequence
  Ebola virus siRNA sense strand
guugauucgauccaauauucu

SEQ ID NO: 11880 - RNA, 21 nt, Artificial Sequence
  Ebola virus siRNA sense strand
uugauucgauccaauauucuc

SEQ ID NO: 11881 - RNA, 21 nt, Artificial Sequence
  Ebola virus siRNA sense strand
ugauucgauccaauauucuca

SEQ ID NO: 11882 - RNA, 21 nt, Artificial Sequence
  Ebola virus siRNA sense strand
gauucgauccaauauucucaa

SEQ ID NO: 11883 - RNA, 21 nt, Artificial Sequence
  Ebola virus siRNA sense strand
auucgauccaauauucucaag

SEQ ID NO: 11884 - RNA, 21 nt, Artificial Sequence
  Ebola virus siRNA sense strand
uucgauccaauauucucaagu

SEQ ID NO: 11885 - RNA, 21 nt, Artificial Sequence
  Ebola virus siRNA sense strand
ucgauccaauauucucaaguu

SEQ ID NO: 11886 - RNA, 21 nt, Artificial Sequence
  Ebola virus siRNA sense strand
cgauccaauauucucaaguuu

SEQ ID NO: 11887 - RNA, 21 nt, Artificial Sequence
  Ebola virus siRNA sense strand
gauccaauauucucaaguuua

SEQ ID NO: 11888 - RNA, 21 nt, Artificial Sequence
  Ebola virus siRNA sense strand
auccaauauucucaaguuuau

SEQ ID NO: 11889 - RNA, 21 nt, Artificial Sequence
  Ebola virus siRNA sense strand
uccaauauucucaaguuuauu

SEQ ID NO: 11890 - RNA, 21 nt, Artificial Sequence
  Ebola virus siRNA sense strand
ccaauauucucaaguuuauua

SEQ ID NO: 11891 - RNA, 21 nt, Artificial Sequence
  Ebola virus siRNA sense strand
caauauucucaaguuuauuaa

SEQ ID NO: 11892 - RNA, 21 nt, Artificial Sequence
  Ebola virus siRNA sense strand
aauauucucaaguuuauuaac

SEQ ID NO: 11893 - RNA, 21 nt, Artificial Sequence
  Ebola virus siRNA sense strand
auauucucaaguuuauuaaca

SEQ ID NO: 11894 - RNA, 21 nt, Artificial Sequence
  Ebola virus siRNA sense strand
uauucucaaguuuauuaacaa

SEQ ID NO: 11895 - RNA, 21 nt, Artificial Sequence
  Ebola virus siRNA sense strand
auucucaaguuuauuaacaaa

SEQ ID NO: 11896 - RNA, 21 nt, Artificial Sequence
  Ebola virus siRNA sense strand
uucucaaguuuauuaacaaau

SEQ ID NO: 11897 - RNA, 21 nt, Artificial Sequence
  Ebola virus siRNA sense strand
ucucaaguuuauuaacaaauu

SEQ ID NO: 11898 - RNA, 21 nt, Artificial Sequence
  Ebola virus siRNA sense strand
cucaaguuuauuaacaaauug

SEQ ID NO: 11899 - RNA, 21 nt, Artificial Sequence
  Ebola virus siRNA sense strand
ucaaguuuauuaacaaauugg

SEQ ID NO: 11900 - RNA, 21 nt, Artificial Sequence
  Ebola virus siRNA sense strand
caaguuuauuaacaaauugga

SEQ ID NO: 11901 - RNA, 21 nt, Artificial Sequence
  Ebola virus siRNA sense strand
aaguuuauuaacaaauuggau

SEQ ID NO: 11902 - RNA, 21 nt, Artificial Sequence
  Ebola virus siRNA sense strand
aguuuauuaacaaauuggaug

SEQ ID NO: 11903 - RNA, 21 nt, Artificial Sequence
  Ebola virus siRNA sense strand
guuuauuaacaaauuggaugc

SEQ ID NO: 11904 - RNA, 21 nt, Artificial Sequence
  Ebola virus siRNA sense strand
uuuauuaacaaauuggaugcu

SEQ ID NO: 11905 - RNA, 21 nt, Artificial Sequence
  Ebola virus siRNA sense strand
uuauuaacaaauuggaugcuc

SEQ ID NO: 11906 - RNA, 21 nt, Artificial Sequence
  Ebola virus siRNA sense strand
uauuaacaaauuggaugcucu

SEQ ID NO: 11907 - RNA, 21 nt, Artificial Sequence
  Ebola virus siRNA sense strand
auuaacaaauuggaugcucua

SEQ ID NO: 11908 - RNA, 21 nt, Artificial Sequence
  Ebola virus siRNA sense strand
uuaacaaauuggaugcucuac

SEQ ID NO: 11909 - RNA, 21 nt, Artificial Sequence
  Ebola virus siRNA sense strand
uaacaaauuggaugcucuaca

SEQ ID NO: 11910 - RNA, 21 nt, Artificial Sequence
  Ebola virus siRNA sense strand
aacaaauuggaugcucuacau

SEQ ID NO: 11911 - RNA, 21 nt, Artificial Sequence
  Ebola virus siRNA sense strand
acaaauuggaugcucuacaug

SEQ ID NO: 11912 - RNA, 21 nt, Artificial Sequence
  Ebola virus siRNA sense strand
caaauuggaugcucuacaugu

SEQ ID NO: 11913 - RNA, 21 nt, Artificial Sequence
  Ebola virus siRNA sense strand
aaauuggaugcucuacauguc

SEQ ID NO: 11914 - RNA, 21 nt, Artificial Sequence
  Ebola virus siRNA sense strand
aauuggaugcucuacaugucg

SEQ ID NO: 11915 - RNA, 21 nt, Artificial Sequence
  Ebola virus siRNA sense strand
auuggaugcucuacaugucgu

SEQ ID NO: 11916 - RNA, 21 nt, Artificial Sequence
  Ebola virus siRNA sense strand
uuggaugcucuacaugucgug

SEQ ID NO: 11917 - RNA, 21 nt, Artificial Sequence
  Ebola virus siRNA sense strand
uggaugcucuacaugucguga

SEQ ID NO: 11918 - RNA, 21 nt, Artificial Sequence
  Ebola virus siRNA sense strand
ggaugcucuacaugucgugaa

SEQ ID NO: 11919 - RNA, 21 nt, Artificial Sequence
  Ebola virus siRNA sense strand
gaugcucuacaugucgugaac

SEQ ID NO: 11920 - RNA, 21 nt, Artificial Sequence
  Ebola virus siRNA sense strand
augcucuacaugucgugaacu

SEQ ID NO: 11921 - RNA, 21 nt, Artificial Sequence
  Ebola virus siRNA sense strand
ugcucuacaugucgugaacua

SEQ ID NO: 11922 - RNA, 21 nt, Artificial Sequence
  Ebola virus siRNA sense strand
gcucuacaugucgugaacuac

SEQ ID NO: 11923 - RNA, 21 nt, Artificial Sequence
  Ebola virus siRNA sense strand
cucuacaugucgugaacuaca

SEQ ID NO: 11924 - RNA, 21 nt, Artificial Sequence
  Ebola virus siRNA sense strand
ucuacaugucgugaacuacaa

SEQ ID NO: 11925 - RNA, 21 nt, Artificial Sequence
  Ebola virus siRNA sense strand
cuacaugucgugaacuacaac

SEQ ID NO: 11926 - RNA, 21 nt, Artificial Sequence
  Ebola virus siRNA sense strand
uacaugucgugaacuacaacg

SEQ ID NO: 11927 - RNA, 21 nt, Artificial Sequence
  Ebola virus siRNA sense strand
acaugucgugaacuacaacgg

SEQ ID NO: 11928 - RNA, 21 nt, Artificial Sequence
  Ebola virus siRNA sense strand
caugucgugaacuacaacgga

SEQ ID NO: 11929 - RNA, 21 nt, Artificial Sequence
  Ebola virus siRNA sense strand
augucgugaacuacaacggau

SEQ ID NO: 11930 - RNA, 21 nt, Artificial Sequence
  Ebola virus siRNA sense strand
ugucgugaacuacaacggauu

SEQ ID NO: 11931 - RNA, 21 nt, Artificial Sequence
  Ebola virus siRNA sense strand
gucgugaacuacaacggauug

SEQ ID NO: 11932 - RNA, 21 nt, Artificial Sequence
  Ebola virus siRNA sense strand
ucgugaacuacaacggauugu

SEQ ID NO: 11933 - RNA, 21 nt, Artificial Sequence
  Ebola virus siRNA sense strand
cgugaacuacaacggauuguu

SEQ ID NO: 11934 - RNA, 21 nt, Artificial Sequence
  Ebola virus siRNA sense strand
gugaacuacaacggauuguug

SEQ ID NO: 11935 - RNA, 21 nt, Artificial Sequence
  Ebola virus siRNA sense strand
ugaacuacaacggauuguuga

SEQ ID NO: 11936 - RNA, 21 nt, Artificial Sequence
  Ebola virus siRNA sense strand
gaacuacaacggauuguugag

SEQ ID NO: 11937 - RNA, 21 nt, Artificial Sequence
  Ebola virus siRNA sense strand
aacuacaacggauuguugagc

SEQ ID NO: 11938 - RNA, 21 nt, Artificial Sequence
  Ebola virus siRNA sense strand
acuacaacggauuguugagca

SEQ ID NO: 11939 - RNA, 21 nt, Artificial Sequence
  Ebola virus siRNA sense strand
cuacaacggauuguugagcag

SEQ ID NO: 11940 - RNA, 21 nt, Artificial Sequence
  Ebola virus siRNA sense strand
uacaacggauuguugagcagu

SEQ ID NO: 11941 - RNA, 21 nt, Artificial Sequence
  Ebola virus siRNA sense strand
acaacggauuguugagcagua

SEQ ID NO: 11942 - RNA, 21 nt, Artificial Sequence
  Ebola virus siRNA sense strand
caacggauuguugagcaguau

SEQ ID NO: 11943 - RNA, 21 nt, Artificial Sequence
  Ebola virus siRNA sense strand
aacggauuguugagcaguauu

SEQ ID NO: 11944 - RNA, 21 nt, Artificial Sequence
  Ebola virus siRNA sense strand
acggauuguugagcaguauug

SEQ ID NO: 11945 - RNA, 21 nt, Artificial Sequence
  Ebola virus siRNA sense strand
cggauuguugagcaguauuga

SEQ ID NO: 11946 - RNA, 21 nt, Artificial Sequence
  Ebola virus siRNA sense strand
ggauuguugagcaguauugaa

SEQ ID NO: 11947 - RNA, 21 nt, Artificial Sequence
  Ebola virus siRNA sense strand
gauuguugagcaguauugaaa

SEQ ID NO: 11948 - RNA, 21 nt, Artificial Sequence
  Ebola virus siRNA sense strand
auuguugagcaguauugaaau

SEQ ID NO: 11949 - RNA, 21 nt, Artificial Sequence
  Ebola virus siRNA sense strand
uuguugagcaguauugaaauu

SEQ ID NO: 11950 - RNA, 21 nt, Artificial Sequence
  Ebola virus siRNA sense strand
uguugagcaguauugaaauug

SEQ ID NO: 11951 - RNA, 21 nt, Artificial Sequence
  Ebola virus siRNA sense strand
guugagcaguauugaaauugg

SEQ ID NO: 11952 - RNA, 21 nt, Artificial Sequence
  Ebola virus siRNA sense strand
uugagcaguauugaaauugga

SEQ ID NO: 11953 - RNA, 21 nt, Artificial Sequence
  Ebola virus siRNA sense strand
ugagcaguauugaaauuggaa

SEQ ID NO: 11954 - RNA, 21 nt, Artificial Sequence
  Ebola virus siRNA sense strand
gagcaguauugaaauuggaac

SEQ ID NO: 11955 - RNA, 21 nt, Artificial Sequence
  Ebola virus siRNA sense strand
agcaguauugaaauuggaacu

SEQ ID NO: 11956 - RNA, 21 nt, Artificial Sequence
  Ebola virus siRNA sense strand
gcaguauugaaauuggaacuc

SEQ ID NO: 11957 - RNA, 21 nt, Artificial Sequence
  Ebola virus siRNA sense strand
caguauugaaauuggaacuca

SEQ ID NO: 11958 - RNA, 21 nt, Artificial Sequence
  Ebola virus siRNA sense strand
aguauugaaauuggaacucaa

SEQ ID NO: 11959 - RNA, 21 nt, Artificial Sequence
  Ebola virus siRNA sense strand
guauugaaauuggaacucaaa

SEQ ID NO: 11960 - RNA, 21 nt, Artificial Sequence
  Ebola virus siRNA sense strand
uauugaaauuggaacucaaaa

SEQ ID NO: 11961 - RNA, 21 nt, Artificial Sequence
  Ebola virus siRNA sense strand
auugaaauuggaacucaaaau

SEQ ID NO: 11962 - RNA, 21 nt, Artificial Sequence
  Ebola virus siRNA sense strand
uugaaauuggaacucaaaauc

SEQ ID NO: 11963 - RNA, 21 nt, Artificial Sequence
  Ebola virus siRNA sense strand
ugaaauuggaacucaaaauca

SEQ ID NO: 11964 - RNA, 21 nt, Artificial Sequence
  Ebola virus siRNA sense strand
gaaauuggaacucaaaaucau

SEQ ID NO: 11965 - RNA, 21 nt, Artificial Sequence
  Ebola virus siRNA sense strand
aaauuggaacucaaaaucaua

SEQ ID NO: 11966 - RNA, 21 nt, Artificial Sequence
  Ebola virus siRNA sense strand
aauuggaacucaaaaucauac

SEQ ID NO: 11967 - RNA, 21 nt, Artificial Sequence
  Ebola virus siRNA sense strand
auuggaacucaaaaucauaca

SEQ ID NO: 11968 - RNA, 21 nt, Artificial Sequence
  Ebola virus siRNA sense strand
uuggaacucaaaaucauacaa

SEQ ID NO: 11969 - RNA, 21 nt, Artificial Sequence
  Ebola virus siRNA sense strand
uggaacucaaaaucauacaau

SEQ ID NO: 11970 - RNA, 21 nt, Artificial Sequence
  Ebola virus siRNA sense strand
ggaacucaaaaucauacaauc

SEQ ID NO: 11971 - RNA, 21 nt, Artificial Sequence
  Ebola virus siRNA sense strand
gaacucaaaaucauacaauca

SEQ ID NO: 11972 - RNA, 21 nt, Artificial Sequence
  Ebola virus siRNA sense strand
aacucaaaaucauacaaucau

SEQ ID NO: 11973 - RNA, 21 nt, Artificial Sequence
  Ebola virus siRNA sense strand
acucaaaaucauacaaucauc

SEQ ID NO: 11974 - RNA, 21 nt, Artificial Sequence
  Ebola virus siRNA sense strand
cucaaaaucauacaaucauca

SEQ ID NO: 11975 - RNA, 21 nt, Artificial Sequence
  Ebola virus siRNA sense strand
ucaaaaucauacaaucaucau

SEQ ID NO: 11976 - RNA, 21 nt, Artificial Sequence
  Ebola virus siRNA sense strand
caaaaucauacaaucaucaua

SEQ ID NO: 11977 - RNA, 21 nt, Artificial Sequence
  Ebola virus siRNA sense strand
aaaaucauacaaucaucauaa

SEQ ID NO: 11978 - RNA, 21 nt, Artificial Sequence
  Ebola virus siRNA sense strand
aaaucauacaaucaucauaac

SEQ ID NO: 11979 - RNA, 21 nt, Artificial Sequence
  Ebola virus siRNA sense strand
aaucauacaaucaucauaacu

SEQ ID NO: 11980 - RNA, 21 nt, Artificial Sequence
  Ebola virus siRNA sense strand
aucauacaaucaucauaacuc

SEQ ID NO: 11981 - RNA, 21 nt, Artificial Sequence
  Ebola virus siRNA sense strand
ucauacaaucaucauaacucg

SEQ ID NO: 11982 - RNA, 21 nt, Artificial Sequence
  Ebola virus siRNA sense strand
cauacaaucaucauaacucga

SEQ ID NO: 11983 - RNA, 21 nt, Artificial Sequence
  Ebola virus siRNA sense strand
auacaaucaucauaacucgaa

SEQ ID NO: 11984 - RNA, 21 nt, Artificial Sequence
  Ebola virus siRNA sense strand
uacaaucaucauaacucgaac

SEQ ID NO: 11985 - RNA, 21 nt, Artificial Sequence
  Ebola virus siRNA sense strand
acaaucaucauaacucgaacu

SEQ ID NO: 11986 - RNA, 21 nt, Artificial Sequence
  Ebola virus siRNA sense strand
caaucaucauaacucgaacua

SEQ ID NO: 11987 - RNA, 21 nt, Artificial Sequence
  Ebola virus siRNA sense strand
aaucaucauaacucgaacuaa

SEQ ID NO: 11988 - RNA, 21 nt, Artificial Sequence
  Ebola virus siRNA sense strand
aucaucauaacucgaacuaac

SEQ ID NO: 11989 - RNA, 21 nt, Artificial Sequence
  Ebola virus siRNA sense strand
ucaucauaacucgaacuaaca

SEQ ID NO: 11990 - RNA, 21 nt, Artificial Sequence
  Ebola virus siRNA sense strand
caucauaacucgaacuaacau

SEQ ID NO: 11991 - RNA, 21 nt, Artificial Sequence
  Ebola virus siRNA sense strand
aucauaacucgaacuaacaug

SEQ ID NO: 11992 - RNA, 21 nt, Artificial Sequence
  Ebola virus siRNA sense strand
ucauaacucgaacuaacaugg

SEQ ID NO: 11993 - RNA, 21 nt, Artificial Sequence
  Ebola virus siRNA sense strand
cauaacucgaacuaacauggg

SEQ ID NO: 11994 - RNA, 21 nt, Artificial Sequence
  Ebola virus siRNA sense strand
auaacucgaacuaacaugggu

SEQ ID NO: 11995 - RNA, 21 nt, Artificial Sequence
  Ebola virus siRNA sense strand
uaacucgaacuaacauggguu

SEQ ID NO: 11996 - RNA, 21 nt, Artificial Sequence
  Ebola virus siRNA sense strand
aacucgaacuaacauggguuu

SEQ ID NO: 11997 - RNA, 21 nt, Artificial Sequence
  Ebola virus siRNA sense strand
acucgaacuaacauggguuuu

SEQ ID NO: 11998 - RNA, 21 nt, Artificial Sequence
  Ebola virus siRNA sense strand
cucgaacuaacauggguuuuc

SEQ ID NO: 11999 - RNA, 21 nt, Artificial Sequence
  Ebola virus siRNA sense strand
ucgaacuaacauggguuuucu

SEQ ID NO: 12000 - RNA, 21 nt, Artificial Sequence
  Ebola virus siRNA sense strand
cgaacuaacauggguuuucug

SEQ ID NO: 12001 - RNA, 21 nt, Artificial Sequence
  Ebola virus siRNA sense strand
gaacuaacauggguuuucugg

SEQ ID NO: 12002 - RNA, 21 nt, Artificial Sequence
  Ebola virus siRNA sense strand
aacuaacauggguuuucuggu

SEQ ID NO: 12003 - RNA, 21 nt, Artificial Sequence
  Ebola virus siRNA sense strand
acuaacauggguuuucuggug

SEQ ID NO: 12004 - RNA, 21 nt, Artificial Sequence
  Ebola virus siRNA sense strand
cuaacauggguuuucuggugg

SEQ ID NO: 12005 - RNA, 21 nt, Artificial Sequence
  Ebola virus siRNA sense strand
uaacauggguuuucuggugga

SEQ ID NO: 12006 - RNA, 21 nt, Artificial Sequence
  Ebola virus siRNA sense strand
aacauggguuuucugguggag

SEQ ID NO: 12007 - RNA, 21 nt, Artificial Sequence
  Ebola virus siRNA sense strand
acauggguuuucugguggagc

SEQ ID NO: 12008 - RNA, 21 nt, Artificial Sequence
  Ebola virus siRNA sense strand
cauggguuuucugguggagcu

SEQ ID NO: 12009 - RNA, 21 nt, Artificial Sequence
  Ebola virus siRNA sense strand
auggguuuucugguggagcuc

SEQ ID NO: 12010 - RNA, 21 nt, Artificial Sequence
  Ebola virus siRNA sense strand
uggguuuucugguggagcucc

SEQ ID NO: 12011 - RNA, 21 nt, Artificial Sequence
  Ebola virus siRNA sense strand
ggguuuucugguggagcucca

SEQ ID NO: 12012 - RNA, 21 nt, Artificial Sequence
  Ebola virus siRNA sense strand
gguuuucugguggagcuccaa

SEQ ID NO: 12013 - RNA, 21 nt, Artificial Sequence
  Ebola virus siRNA sense strand
guuuucugguggagcuccaag

SEQ ID NO: 12014 - RNA, 21 nt, Artificial Sequence
  Ebola virus siRNA sense strand
uuuucugguggagcuccaaga

SEQ ID NO: 12015 - RNA, 21 nt, Artificial Sequence
  Ebola virus siRNA sense strand
uuucugguggagcuccaagaa

SEQ ID NO: 12016 - RNA, 21 nt, Artificial Sequence
  Ebola virus siRNA sense strand
uucugguggagcuccaagaac

SEQ ID NO: 12017 - RNA, 21 nt, Artificial Sequence
  Ebola virus siRNA sense strand
ucugguggagcuccaagaacc

SEQ ID NO: 12018 - RNA, 21 nt, Artificial Sequence
  Ebola virus siRNA sense strand
cugguggagcuccaagaaccc

SEQ ID NO: 12019 - RNA, 21 nt, Artificial Sequence
  Ebola virus siRNA sense strand
ugguggagcuccaagaacccg

SEQ ID NO: 12020 - RNA, 21 nt, Artificial Sequence
  Ebola virus siRNA sense strand
gguggagcuccaagaacccga

SEQ ID NO: 12021 - RNA, 21 nt, Artificial Sequence
  Ebola virus siRNA sense strand
guggagcuccaagaacccgac

SEQ ID NO: 12022 - RNA, 21 nt, Artificial Sequence
  Ebola virus siRNA sense strand
uggagcuccaagaacccgaca

SEQ ID NO: 12023 - RNA, 21 nt, Artificial Sequence
  Ebola virus siRNA sense strand
ggagcuccaagaacccgacaa

SEQ ID NO: 12024 - RNA, 21 nt, Artificial Sequence
  Ebola virus siRNA sense strand
gagcuccaagaacccgacaaa

SEQ ID NO: 12025 - RNA, 21 nt, Artificial Sequence
  Ebola virus siRNA sense strand
agcuccaagaacccgacaaau

SEQ ID NO: 12026 - RNA, 21 nt, Artificial Sequence
  Ebola virus siRNA sense strand
gcuccaagaacccgacaaauc

SEQ ID NO: 12027 - RNA, 21 nt, Artificial Sequence
  Ebola virus siRNA sense strand
cuccaagaacccgacaaaucg

SEQ ID NO: 12028 - RNA, 21 nt, Artificial Sequence
  Ebola virus siRNA sense strand
uccaagaacccgacaaaucgg

SEQ ID NO: 12029 - RNA, 21 nt, Artificial Sequence
  Ebola virus siRNA sense strand
ccaagaacccgacaaaucggc

SEQ ID NO: 12030 - RNA, 21 nt, Artificial Sequence
  Ebola virus siRNA sense strand
caagaacccgacaaaucggca

SEQ ID NO: 12031 - RNA, 21 nt, Artificial Sequence
  Ebola virus siRNA sense strand
aagaacccgacaaaucggcaa

SEQ ID NO: 12032 - RNA, 21 nt, Artificial Sequence
  Ebola virus siRNA sense strand
agaacccgacaaaucggcaau

SEQ ID NO: 12033 - RNA, 21 nt, Artificial Sequence
  Ebola virus siRNA sense strand
gaacccgacaaaucggcaaug

SEQ ID NO: 12034 - RNA, 21 nt, Artificial Sequence
  Ebola virus siRNA sense strand
aacccgacaaaucggcaauga

SEQ ID NO: 12035 - RNA, 21 nt, Artificial Sequence
  Ebola virus siRNA sense strand
acccgacaaaucggcaaugaa

SEQ ID NO: 12036 - RNA, 21 nt, Artificial Sequence
  Ebola virus siRNA sense strand
cccgacaaaucggcaaugaac

SEQ ID NO: 12037 - RNA, 21 nt, Artificial Sequence
  Ebola virus siRNA sense strand
ccgacaaaucggcaaugaacc

SEQ ID NO: 12038 - RNA, 21 nt, Artificial Sequence
  Ebola virus siRNA sense strand
cgacaaaucggcaaugaaccg

SEQ ID NO: 12039 - RNA, 21 nt, Artificial Sequence
  Ebola virus siRNA sense strand
gacaaaucggcaaugaaccgc

SEQ ID NO: 12040 - RNA, 21 nt, Artificial Sequence
  Ebola virus siRNA sense strand
acaaaucggcaaugaaccgca

SEQ ID NO: 12041 - RNA, 21 nt, Artificial Sequence
  Ebola virus siRNA sense strand
caaaucggcaaugaaccgcau

SEQ ID NO: 12042 - RNA, 21 nt, Artificial Sequence
  Ebola virus siRNA sense strand
aaaucggcaaugaaccgcaug

SEQ ID NO: 12043 - RNA, 21 nt, Artificial Sequence
  Ebola virus siRNA sense strand
aaucggcaaugaaccgcauga

SEQ ID NO: 12044 - RNA, 21 nt, Artificial Sequence
  Ebola virus siRNA sense strand
aucggcaaugaaccgcaugaa

SEQ ID NO: 12045 - RNA, 21 nt, Artificial Sequence
  Ebola virus siRNA sense strand
ucggcaaugaaccgcaugaag

SEQ ID NO: 12046 - RNA, 21 nt, Artificial Sequence
  Ebola virus siRNA sense strand
cggcaaugaaccgcaugaagc

SEQ ID NO: 12047 - RNA, 21 nt, Artificial Sequence
  Ebola virus siRNA sense strand
ggcaaugaaccgcaugaagcc

SEQ ID NO: 12048 - RNA, 21 nt, Artificial Sequence
  Ebola virus siRNA sense strand
gcaaugaaccgcaugaagccu

SEQ ID NO: 12049 - RNA, 21 nt, Artificial Sequence
  Ebola virus siRNA sense strand
caaugaaccgcaugaagccug

SEQ ID NO: 12050 - RNA, 21 nt, Artificial Sequence
  Ebola virus siRNA sense strand
aaugaaccgcaugaagccugg

SEQ ID NO: 12051 - RNA, 21 nt, Artificial Sequence
  Ebola virus siRNA sense strand
augaaccgcaugaagccuggg

SEQ ID NO: 12052 - RNA, 21 nt, Artificial Sequence
  Ebola virus siRNA sense strand
ugaaccgcaugaagccugggc

SEQ ID NO: 12053 - RNA, 21 nt, Artificial Sequence
  Ebola virus siRNA sense strand
gaaccgcaugaagccugggcc

SEQ ID NO: 12054 - RNA, 21 nt, Artificial Sequence
  Ebola virus siRNA sense strand
aaccgcaugaagccugggccg

SEQ ID NO: 12055 - RNA, 21 nt, Artificial Sequence
  Ebola virus siRNA sense strand
accgcaugaagccugggccgg

SEQ ID NO: 12056 - RNA, 21 nt, Artificial Sequence
  Ebola virus siRNA sense strand
ccgcaugaagccugggccggc

SEQ ID NO: 12057 - RNA, 21 nt, Artificial Sequence
  Ebola virus siRNA sense strand
cgcaugaagccugggccggcg

SEQ ID NO: 12058 - RNA, 21 nt, Artificial Sequence
  Ebola virus siRNA sense strand
gcaugaagccugggccggcga

SEQ ID NO: 12059 - RNA, 21 nt, Artificial Sequence
  Ebola virus siRNA sense strand
caugaagccugggccggcgaa

SEQ ID NO: 12060 - RNA, 21 nt, Artificial Sequence
  Ebola virus siRNA sense strand
augaagccugggccggcgaaa

SEQ ID NO: 12061 - RNA, 21 nt, Artificial Sequence
  Ebola virus siRNA sense strand
ugaagccugggccggcgaaau

SEQ ID NO: 12062 - RNA, 21 nt, Artificial Sequence
  Ebola virus siRNA sense strand
gaagccugggccggcgaaauu

SEQ ID NO: 12063 - RNA, 21 nt, Artificial Sequence
  Ebola virus siRNA sense strand
aagccugggccggcgaaauuu

SEQ ID NO: 12064 - RNA, 21 nt, Artificial Sequence
  Ebola virus siRNA sense strand
agccugggccggcgaaauuuu

SEQ ID NO: 12065 - RNA, 21 nt, Artificial Sequence
  Ebola virus siRNA sense strand
gccugggccggcgaaauuuuc

SEQ ID NO: 12066 - RNA, 21 nt, Artificial Sequence
  Ebola virus siRNA sense strand
ccugggccggcgaaauuuucc

SEQ ID NO: 12067 - RNA, 21 nt, Artificial Sequence
  Ebola virus siRNA sense strand
cugggccggcgaaauuuuccc

SEQ ID NO: 12068 - RNA, 21 nt, Artificial Sequence
  Ebola virus siRNA sense strand
ugggccggcgaaauuuucccu

SEQ ID NO: 12069 - RNA, 21 nt, Artificial Sequence
  Ebola virus siRNA sense strand
gggccggcgaaauuuucccuc

SEQ ID NO: 12070 - RNA, 21 nt, Artificial Sequence
  Ebola virus siRNA sense strand
ggccggcgaaauuuucccucc

SEQ ID NO: 12071 - RNA, 21 nt, Artificial Sequence
  Ebola virus siRNA sense strand
gccggcgaaauuuucccuccu

SEQ ID NO: 12072 - RNA, 21 nt, Artificial Sequence
  Ebola virus siRNA sense strand
ccggcgaaauuuucccuccuu

SEQ ID NO: 12073 - RNA, 21 nt, Artificial Sequence
  Ebola virus siRNA sense strand
cggcgaaauuuucccuccuuc

SEQ ID NO: 12074 - RNA, 21 nt, Artificial Sequence
  Ebola virus siRNA sense strand
ggcgaaauuuucccuccuuca

SEQ ID NO: 12075 - RNA, 21 nt, Artificial Sequence
  Ebola virus siRNA sense strand
gcgaaauuuucccuccuucau

SEQ ID NO: 12076 - RNA, 21 nt, Artificial Sequence
  Ebola virus siRNA sense strand
cgaaauuuucccuccuucaug

SEQ ID NO: 12077 - RNA, 21 nt, Artificial Sequence
  Ebola virus siRNA sense strand
gaaauuuucccuccuucauga

SEQ ID NO: 12078 - RNA, 21 nt, Artificial Sequence
  Ebola virus siRNA sense strand
aaauuuucccuccuucaugag

SEQ ID NO: 12079 - RNA, 21 nt, Artificial Sequence
  Ebola virus siRNA sense strand
aauuuucccuccuucaugagu

SEQ ID NO: 12080 - RNA, 21 nt, Artificial Sequence
  Ebola virus siRNA sense strand
auuuucccuccuucaugaguc

SEQ ID NO: 12081 - RNA, 21 nt, Artificial Sequence
  Ebola virus siRNA sense strand
uuuucccuccuucaugagucc

SEQ ID NO: 12082 - RNA, 21 nt, Artificial Sequence
  Ebola virus siRNA sense strand
uuucccuccuucaugagucca

SEQ ID NO: 12083 - RNA, 21 nt, Artificial Sequence
  Ebola virus siRNA sense strand
uucccuccuucaugaguccac

SEQ ID NO: 12084 - RNA, 21 nt, Artificial Sequence
  Ebola virus siRNA sense strand
ucccuccuucaugaguccaca

SEQ ID NO: 12085 - RNA, 21 nt, Artificial Sequence
  Ebola virus siRNA sense strand
cccuccuucaugaguccacac

SEQ ID NO: 12086 - RNA, 21 nt, Artificial Sequence
  Ebola virus siRNA sense strand
ccuccuucaugaguccacacu

SEQ ID NO: 12087 - RNA, 21 nt, Artificial Sequence
  Ebola virus siRNA sense strand
cuccuucaugaguccacacug

SEQ ID NO: 12088 - RNA, 21 nt, Artificial Sequence
  Ebola virus siRNA sense strand
uccuucaugaguccacacuga

SEQ ID NO: 12089 - RNA, 21 nt, Artificial Sequence
  Ebola virus siRNA sense strand
ccuucaugaguccacacugaa

SEQ ID NO: 12090 - RNA, 21 nt, Artificial Sequence
  Ebola virus siRNA sense strand
cuucaugaguccacacugaaa

SEQ ID NO: 12091 - RNA, 21 nt, Artificial Sequence
  Ebola virus siRNA sense strand
uucaugaguccacacugaaag

SEQ ID NO: 12092 - RNA, 21 nt, Artificial Sequence
  Ebola virus siRNA sense strand
ucaugaguccacacugaaagc

SEQ ID NO: 12093 - RNA, 21 nt, Artificial Sequence
  Ebola virus siRNA sense strand
caugaguccacacugaaagca

SEQ ID NO: 12094 - RNA, 21 nt, Artificial Sequence
  Ebola virus siRNA sense strand
augaguccacacugaaagcau

SEQ ID NO: 12095 - RNA, 21 nt, Artificial Sequence
  Ebola virus siRNA sense strand
ugaguccacacugaaagcauu

SEQ ID NO: 12096 - RNA, 21 nt, Artificial Sequence
  Ebola virus siRNA sense strand
gaguccacacugaaagcauuu

SEQ ID NO: 12097 - RNA, 21 nt, Artificial Sequence
  Ebola virus siRNA sense strand
aguccacacugaaagcauuua

SEQ ID NO: 12098 - RNA, 21 nt, Artificial Sequence
  Ebola virus siRNA sense strand
guccacacugaaagcauuuac

SEQ ID NO: 12099 - RNA, 21 nt, Artificial Sequence
  Ebola virus siRNA sense strand
uccacacugaaagcauuuaca

SEQ ID NO: 12100 - RNA, 21 nt, Artificial Sequence
  Ebola virus siRNA sense strand
ccacacugaaagcauuuacac

SEQ ID NO: 12101 - RNA, 21 nt, Artificial Sequence
  Ebola virus siRNA sense strand
cacacugaaagcauuuacaca

SEQ ID NO: 12102 - RNA, 21 nt, Artificial Sequence
  Ebola virus siRNA sense strand
acacugaaagcauuuacacaa

SEQ ID NO: 12103 - RNA, 21 nt, Artificial Sequence
  Ebola virus siRNA sense strand
cacugaaagcauuuacacaag

SEQ ID NO: 12104 - RNA, 21 nt, Artificial Sequence
  Ebola virus siRNA sense strand
acugaaagcauuuacacaagg

SEQ ID NO: 12105 - RNA, 21 nt, Artificial Sequence
  Ebola virus siRNA sense strand
cugaaagcauuuacacaagga

SEQ ID NO: 12106 - RNA, 21 nt, Artificial Sequence
  Ebola virus siRNA sense strand
ugaaagcauuuacacaaggau

SEQ ID NO: 12107 - RNA, 21 nt, Artificial Sequence
  Ebola virus siRNA sense strand
gaaagcauuuacacaaggauc

SEQ ID NO: 12108 - RNA, 21 nt, Artificial Sequence
  Ebola virus siRNA sense strand
aaagcauuuacacaaggaucc

SEQ ID NO: 12109 - RNA, 21 nt, Artificial Sequence
  Ebola virus siRNA sense strand
aagcauuuacacaaggauccu

SEQ ID NO: 12110 - RNA, 21 nt, Artificial Sequence
  Ebola virus siRNA sense strand
agcauuuacacaaggauccuc

SEQ ID NO: 12111 - RNA, 21 nt, Artificial Sequence
  Ebola virus siRNA sense strand
gcauuuacacaaggauccucg

SEQ ID NO: 12112 - RNA, 21 nt, Artificial Sequence
  Ebola virus siRNA sense strand
cauuuacacaaggauccucga

SEQ ID NO: 12113 - RNA, 21 nt, Artificial Sequence
  Ebola virus siRNA sense strand
auuuacacaaggauccucgac

SEQ ID NO: 12114 - RNA, 21 nt, Artificial Sequence
  Ebola virus siRNA sense strand
uuuacacaaggauccucgaca

SEQ ID NO: 12115 - RNA, 21 nt, Artificial Sequence
  Ebola virus siRNA sense strand
uuacacaaggauccucgacac

SEQ ID NO: 12116 - RNA, 21 nt, Artificial Sequence
  Ebola virus siRNA sense strand
uacacaaggauccucgacacg

SEQ ID NO: 12117 - RNA, 21 nt, Artificial Sequence
  Ebola virus siRNA sense strand
acacaaggauccucgacacga

SEQ ID NO: 12118 - RNA, 21 nt, Artificial Sequence
  Ebola virus siRNA sense strand
cacaaggauccucgacacgaa

SEQ ID NO: 12119 - RNA, 21 nt, Artificial Sequence
  Ebola virus siRNA sense strand
acaaggauccucgacacgaau

SEQ ID NO: 12120 - RNA, 21 nt, Artificial Sequence
  Ebola virus siRNA sense strand
caaggauccucgacacgaaug

SEQ ID NO: 12121 - RNA, 21 nt, Artificial Sequence
  Ebola virus siRNA sense strand
aaggauccucgacacgaaugc

SEQ ID NO: 12122 - RNA, 21 nt, Artificial Sequence
  Ebola virus siRNA sense strand
aggauccucgacacgaaugca

SEQ ID NO: 12123 - RNA, 21 nt, Artificial Sequence
  Ebola virus siRNA sense strand
ggauccucgacacgaaugcaa

SEQ ID NO: 12124 - RNA, 21 nt, Artificial Sequence
  Ebola virus siRNA sense strand
gauccucgacacgaaugcaaa

SEQ ID NO: 12125 - RNA, 21 nt, Artificial Sequence
  Ebola virus siRNA sense strand
auccucgacacgaaugcaaag

SEQ ID NO: 12126 - RNA, 21 nt, Artificial Sequence
  Ebola virus siRNA sense strand
uccucgacacgaaugcaaagu

SEQ ID NO: 12127 - RNA, 21 nt, Artificial Sequence
  Ebola virus siRNA sense strand
ccucgacacgaaugcaaaguu

SEQ ID NO: 12128 - RNA, 21 nt, Artificial Sequence
  Ebola virus siRNA sense strand
cucgacacgaaugcaaaguuu

SEQ ID NO: 12129 - RNA, 21 nt, Artificial Sequence
  Ebola virus siRNA sense strand
ucgacacgaaugcaaaguuug

SEQ ID NO: 12130 - RNA, 21 nt, Artificial Sequence
  Ebola virus siRNA sense strand
cgacacgaaugcaaaguuuga

SEQ ID NO: 12131 - RNA, 21 nt, Artificial Sequence
  Ebola virus siRNA sense strand
gacacgaaugcaaaguuugau

SEQ ID NO: 12132 - RNA, 21 nt, Artificial Sequence
  Ebola virus siRNA sense strand
acacgaaugcaaaguuugauu

SEQ ID NO: 12133 - RNA, 21 nt, Artificial Sequence
  Ebola virus siRNA sense strand
cacgaaugcaaaguuugauuc

SEQ ID NO: 12134 - RNA, 21 nt, Artificial Sequence
  Ebola virus siRNA sense strand
acgaaugcaaaguuugauucu

SEQ ID NO: 12135 - RNA, 21 nt, Artificial Sequence
  Ebola virus siRNA sense strand
cgaaugcaaaguuugauucuu

SEQ ID NO: 12136 - RNA, 21 nt, Artificial Sequence
  Ebola virus siRNA sense strand
gaaugcaaaguuugauucuug

SEQ ID NO: 12137 - RNA, 21 nt, Artificial Sequence
  Ebola virus siRNA sense strand
aaugcaaaguuugauucuuga

SEQ ID NO: 12138 - RNA, 21 nt, Artificial Sequence
  Ebola virus siRNA sense strand
augcaaaguuugauucuugaa

SEQ ID NO: 12139 - RNA, 21 nt, Artificial Sequence
  Ebola virus siRNA sense strand
ugcaaaguuugauucuugaau

SEQ ID NO: 12140 - RNA, 21 nt, Artificial Sequence
  Ebola virus siRNA sense strand
gcaaaguuugauucuugaauu

SEQ ID NO: 12141 - RNA, 21 nt, Artificial Sequence
  Ebola virus siRNA sense strand
caaaguuugauucuugaauuu

SEQ ID NO: 12142 - RNA, 21 nt, Artificial Sequence
  Ebola virus siRNA sense strand
aaaguuugauucuugaauuua

SEQ ID NO: 12143 - RNA, 21 nt, Artificial Sequence
  Ebola virus siRNA sense strand
aaguuugauucuugaauuuaa

SEQ ID NO: 12144 - RNA, 21 nt, Artificial Sequence
  Ebola virus siRNA sense strand
aguuugauucuugaauuuaau

SEQ ID NO: 12145 - RNA, 21 nt, Artificial Sequence
  Ebola virus siRNA sense strand
guuugauucuugaauuuaaua

SEQ ID NO: 12146 - RNA, 21 nt, Artificial Sequence
  Ebola virus siRNA sense strand
uuugauucuugaauuuaauag

SEQ ID NO: 12147 - RNA, 21 nt, Artificial Sequence
  Ebola virus siRNA sense strand
uugauucuugaauuuaauagc

SEQ ID NO: 12148 - RNA, 21 nt, Artificial Sequence
  Ebola virus siRNA sense strand
ugauucuugaauuuaauagcu

SEQ ID NO: 12149 - RNA, 21 nt, Artificial Sequence
  Ebola virus siRNA sense strand
gauucuugaauuuaauagcuc

SEQ ID NO: 12150 - RNA, 21 nt, Artificial Sequence
  Ebola virus siRNA sense strand
auucuugaauuuaauagcucu

SEQ ID NO: 12151 - RNA, 21 nt, Artificial Sequence
  Ebola virus siRNA sense strand
uucuugaauuuaauagcucuc

SEQ ID NO: 12152 - RNA, 21 nt, Artificial Sequence
  Ebola virus siRNA sense strand
ucuugaauuuaauagcucucu

SEQ ID NO: 12153 - RNA, 21 nt, Artificial Sequence
  Ebola virus siRNA sense strand
cuugaauuuaauagcucucuu

SEQ ID NO: 12154 - RNA, 21 nt, Artificial Sequence
  Ebola virus siRNA sense strand
uugaauuuaauagcucucuug

SEQ ID NO: 12155 - RNA, 21 nt, Artificial Sequence
  Ebola virus siRNA sense strand
ugaauuuaauagcucucuugc

SEQ ID NO: 12156 - RNA, 21 nt, Artificial Sequence
  Ebola virus siRNA sense strand
gaauuuaauagcucucuugcu

SEQ ID NO: 12157 - RNA, 21 nt, Artificial Sequence
  Ebola virus siRNA sense strand
aauuuaauagcucucuugcua

SEQ ID NO: 12158 - RNA, 21 nt, Artificial Sequence
  Ebola virus siRNA sense strand
auuuaauagcucucuugcuau

SEQ ID NO: 12159 - RNA, 21 nt, Artificial Sequence
  Ebola virus siRNA sense strand
uuuaauagcucucuugcuauc

SEQ ID NO: 12160 - RNA, 21 nt, Artificial Sequence
  Ebola virus siRNA sense strand
uuaauagcucucuugcuaucu

SEQ ID NO: 12161 - RNA, 21 nt, Artificial Sequence
  Ebola virus siRNA sense strand
uaauagcucucuugcuaucua

SEQ ID NO: 12162 - RNA, 21 nt, Artificial Sequence
  Ebola virus siRNA sense strand
aauagcucucuugcuaucuaa

SEQ ID NO: 12163 - RNA, 21 nt, Artificial Sequence
  Ebola virus siRNA sense strand
auagcucucuugcuaucuaac

SEQ ID NO: 12164 - RNA, 21 nt, Artificial Sequence
  Ebola virus siRNA sense strand
uagcucucuugcuaucuaacu

SEQ ID NO: 12165 - RNA, 21 nt, Artificial Sequence
  Ebola virus siRNA sense strand
agcucucuugcuaucuaacua

SEQ ID NO: 12166 - RNA, 21 nt, Artificial Sequence
  Ebola virus siRNA sense strand
gcucucuugcuaucuaacuaa

SEQ ID NO: 12167 - RNA, 21 nt, Artificial Sequence
  Ebola virus siRNA sense strand
cucucuugcuaucuaacuaag

SEQ ID NO: 12168 - RNA, 21 nt, Artificial Sequence
  Ebola virus siRNA sense strand
ucucuugcuaucuaacuaagg

SEQ ID NO: 12169 - RNA, 21 nt, Artificial Sequence
  Ebola virus siRNA sense strand
cucuugcuaucuaacuaaggu

SEQ ID NO: 12170 - RNA, 21 nt, Artificial Sequence
  Ebola virus siRNA sense strand
ucuugcuaucuaacuaaggua

SEQ ID NO: 12171 - RNA, 21 nt, Artificial Sequence
  Ebola virus siRNA sense strand
cuugcuaucuaacuaagguag

SEQ ID NO: 12172 - RNA, 21 nt, Artificial Sequence
  Ebola virus siRNA sense strand
uugcuaucuaacuaagguaga

SEQ ID NO: 12173 - RNA, 21 nt, Artificial Sequence
  Ebola virus siRNA sense strand
ugcuaucuaacuaagguagaa

SEQ ID NO: 12174 - RNA, 21 nt, Artificial Sequence
  Ebola virus siRNA sense strand
gcuaucuaacuaagguagaau

SEQ ID NO: 12175 - RNA, 21 nt, Artificial Sequence
  Ebola virus siRNA sense strand
cuaucuaacuaagguagaaua

SEQ ID NO: 12176 - RNA, 21 nt, Artificial Sequence
  Ebola virus siRNA sense strand
uaucuaacuaagguagaauac

SEQ ID NO: 12177 - RNA, 21 nt, Artificial Sequence
  Ebola virus siRNA sense strand
aucuaacuaagguagaauacu

SEQ ID NO: 12178 - RNA, 21 nt, Artificial Sequence
  Ebola virus siRNA sense strand
ucuaacuaagguagaauacuu

SEQ ID NO: 12179 - RNA, 21 nt, Artificial Sequence
  Ebola virus siRNA sense strand
cuaacuaagguagaauacuuc

SEQ ID NO: 12180 - RNA, 21 nt, Artificial Sequence
  Ebola virus siRNA sense strand
uaacuaagguagaauacuuca

SEQ ID NO: 12181 - RNA, 21 nt, Artificial Sequence
  Ebola virus siRNA sense strand
aacuaagguagaauacuucau

SEQ ID NO: 12182 - RNA, 21 nt, Artificial Sequence
  Ebola virus siRNA sense strand
acuaagguagaauacuucaua

SEQ ID NO: 12183 - RNA, 21 nt, Artificial Sequence
  Ebola virus siRNA sense strand
cuaagguagaauacuucauau

SEQ ID NO: 12184 - RNA, 21 nt, Artificial Sequence
  Ebola virus siRNA sense strand
uaagguagaauacuucauauu

SEQ ID NO: 12185 - RNA, 21 nt, Artificial Sequence
  Ebola virus siRNA sense strand
aagguagaauacuucauauug

SEQ ID NO: 12186 - RNA, 21 nt, Artificial Sequence
  Ebola virus siRNA sense strand
agguagaauacuucauauuga

SEQ ID NO: 12187 - RNA, 21 nt, Artificial Sequence
  Ebola virus siRNA sense strand
gguagaauacuucauauugag

SEQ ID NO: 12188 - RNA, 21 nt, Artificial Sequence
  Ebola virus siRNA sense strand
guagaauacuucauauugagc

SEQ ID NO: 12189 - RNA, 21 nt, Artificial Sequence
  Ebola virus siRNA sense strand
uagaauacuucauauugagcu

SEQ ID NO: 12190 - RNA, 21 nt, Artificial Sequence
  Ebola virus siRNA sense strand
agaauacuucauauugagcua

SEQ ID NO: 12191 - RNA, 21 nt, Artificial Sequence
  Ebola virus siRNA sense strand
gaauacuucauauugagcuaa

SEQ ID NO: 12192 - RNA, 21 nt, Artificial Sequence
  Ebola virus siRNA sense strand
aauacuucauauugagcuaac

SEQ ID NO: 12193 - RNA, 21 nt, Artificial Sequence
  Ebola virus siRNA sense strand
auacuucauauugagcuaacu

SEQ ID NO: 12194 - RNA, 21 nt, Artificial Sequence
  Ebola virus siRNA sense strand
uacuucauauugagcuaacuc

SEQ ID NO: 12195 - RNA, 21 nt, Artificial Sequence
  Ebola virus siRNA sense strand
acuucauauugagcuaacuca

SEQ ID NO: 12196 - RNA, 21 nt, Artificial Sequence
  Ebola virus siRNA sense strand
cuucauauugagcuaacucau

SEQ ID NO: 12197 - RNA, 21 nt, Artificial Sequence
  Ebola virus siRNA sense strand
uucauauugagcuaacucaua

SEQ ID NO: 12198 - RNA, 21 nt, Artificial Sequence
  Ebola virus siRNA sense strand
ucauauugagcuaacucauau

SEQ ID NO: 12199 - RNA, 21 nt, Artificial Sequence
  Ebola virus siRNA sense strand
cauauugagcuaacucauaua

SEQ ID NO: 12200 - RNA, 21 nt, Artificial Sequence
  Ebola virus siRNA sense strand
auauugagcuaacucauauau

SEQ ID NO: 12201 - RNA, 21 nt, Artificial Sequence
  Ebola virus siRNA sense strand
uauugagcuaacucauauaug

SEQ ID NO: 12202 - RNA, 21 nt, Artificial Sequence
  Ebola virus siRNA sense strand
auugagcuaacucauauaugc

SEQ ID NO: 12203 - RNA, 21 nt, Artificial Sequence
  Ebola virus siRNA sense strand
uugagcuaacucauauaugcu

SEQ ID NO: 12204 - RNA, 21 nt, Artificial Sequence
  Ebola virus siRNA sense strand
ugagcuaacucauauaugcug

SEQ ID NO: 12205 - RNA, 21 nt, Artificial Sequence
  Ebola virus siRNA sense strand
gagcuaacucauauaugcuga

SEQ ID NO: 12206 - RNA, 21 nt, Artificial Sequence
  Ebola virus siRNA sense strand
agcuaacucauauaugcugac

SEQ ID NO: 12207 - RNA, 21 nt, Artificial Sequence
  Ebola virus siRNA sense strand
gcuaacucauauaugcugacu

SEQ ID NO: 12208 - RNA, 21 nt, Artificial Sequence
  Ebola virus siRNA sense strand
cuaacucauauaugcugacuc

SEQ ID NO: 12209 - RNA, 21 nt, Artificial Sequence
  Ebola virus siRNA sense strand
uaacucauauaugcugacuca

SEQ ID NO: 12210 - RNA, 21 nt, Artificial Sequence
  Ebola virus siRNA sense strand
aacucauauaugcugacucaa

SEQ ID NO: 12211 - RNA, 21 nt, Artificial Sequence
  Ebola virus siRNA sense strand
acucauauaugcugacucaau

SEQ ID NO: 12212 - RNA, 21 nt, Artificial Sequence
  Ebola virus siRNA sense strand
cucauauaugcugacucaaua

SEQ ID NO: 12213 - RNA, 21 nt, Artificial Sequence
  Ebola virus siRNA sense strand
ucauauaugcugacucaauag

SEQ ID NO: 12214 - RNA, 21 nt, Artificial Sequence
  Ebola virus siRNA sense strand
cauauaugcugacucaauagu

SEQ ID NO: 12215 - RNA, 21 nt, Artificial Sequence
  Ebola virus siRNA sense strand
auauaugcugacucaauaguu

SEQ ID NO: 12216 - RNA, 21 nt, Artificial Sequence
  Ebola virus siRNA sense strand
uauaugcugacucaauaguua

SEQ ID NO: 12217 - RNA, 21 nt, Artificial Sequence
  Ebola virus siRNA sense strand
auaugcugacucaauaguuau

SEQ ID NO: 12218 - RNA, 21 nt, Artificial Sequence
  Ebola virus siRNA sense strand
uaugcugacucaauaguuauc

SEQ ID NO: 12219 - RNA, 21 nt, Artificial Sequence
  Ebola virus siRNA sense strand
augcugacucaauaguuaucu

SEQ ID NO: 12220 - RNA, 21 nt, Artificial Sequence
  Ebola virus siRNA sense strand
ugcugacucaauaguuaucuu

SEQ ID NO: 12221 - RNA, 21 nt, Artificial Sequence
  Ebola virus siRNA sense strand
gcugacucaauaguuaucuug

SEQ ID NO: 12222 - RNA, 21 nt, Artificial Sequence
  Ebola virus siRNA sense strand
cugacucaauaguuaucuuga

SEQ ID NO: 12223 - RNA, 21 nt, Artificial Sequence
  Ebola virus siRNA sense strand
ugacucaauaguuaucuugac

SEQ ID NO: 12224 - RNA, 21 nt, Artificial Sequence
  Ebola virus siRNA sense strand
gacucaauaguuaucuugaca

SEQ ID NO: 12225 - RNA, 21 nt, Artificial Sequence
  Ebola virus siRNA sense strand
acucaauaguuaucuugacau

SEQ ID NO: 12226 - RNA, 21 nt, Artificial Sequence
  Ebola virus siRNA sense strand
cucaauaguuaucuugacauc

SEQ ID NO: 12227 - RNA, 21 nt, Artificial Sequence
  Ebola virus siRNA sense strand
ucaauaguuaucuugacaucu

SEQ ID NO: 12228 - RNA, 21 nt, Artificial Sequence
  Ebola virus siRNA sense strand
caauaguuaucuugacaucuc

SEQ ID NO: 12229 - RNA, 21 nt, Artificial Sequence
  Ebola virus siRNA sense strand
aauaguuaucuugacaucucu

SEQ ID NO: 12230 - RNA, 21 nt, Artificial Sequence
  Ebola virus siRNA sense strand
auaguuaucuugacaucucug

SEQ ID NO: 12231 - RNA, 21 nt, Artificial Sequence
  Ebola virus siRNA sense strand
uaguuaucuugacaucucugc

SEQ ID NO: 12232 - RNA, 21 nt, Artificial Sequence
  Ebola virus siRNA sense strand
aguuaucuugacaucucugcu

SEQ ID NO: 12233 - RNA, 21 nt, Artificial Sequence
  Ebola virus siRNA sense strand
guuaucuugacaucucugcuu

SEQ ID NO: 12234 - RNA, 21 nt, Artificial Sequence
  Ebola virus siRNA sense strand
uuaucuugacaucucugcuuu

SEQ ID NO: 12235 - RNA, 21 nt, Artificial Sequence
  Ebola virus siRNA sense strand
uaucuugacaucucugcuuuc

SEQ ID NO: 12236 - RNA, 21 nt, Artificial Sequence
  Ebola virus siRNA sense strand
aucuugacaucucugcuuuca

SEQ ID NO: 12237 - RNA, 21 nt, Artificial Sequence
  Ebola virus siRNA sense strand
ucuugacaucucugcuuucau

SEQ ID NO: 12238 - RNA, 21 nt, Artificial Sequence
  Ebola virus siRNA sense strand
cuugacaucucugcuuucaua

SEQ ID NO: 12239 - RNA, 21 nt, Artificial Sequence
  Ebola virus siRNA sense strand
uugacaucucugcuuucauaa

SEQ ID NO: 12240 - RNA, 21 nt, Artificial Sequence
  Ebola virus siRNA sense strand
ugacaucucugcuuucauaau

SEQ ID NO: 12241 - RNA, 21 nt, Artificial Sequence
  Ebola virus siRNA sense strand
gacaucucugcuuucauaauc

SEQ ID NO: 12242 - RNA, 21 nt, Artificial Sequence
  Ebola virus siRNA sense strand
acaucucugcuuucauaauca

SEQ ID NO: 12243 - RNA, 21 nt, Artificial Sequence
  Ebola virus siRNA sense strand
caucucugcuuucauaaucag

SEQ ID NO: 12244 - RNA, 21 nt, Artificial Sequence
  Ebola virus siRNA sense strand
aucucugcuuucauaaucaga

SEQ ID NO: 12245 - RNA, 21 nt, Artificial Sequence
  Ebola virus siRNA sense strand
ucucugcuuucauaaucagau

SEQ ID NO: 12246 - RNA, 21 nt, Artificial Sequence
  Ebola virus siRNA sense strand
cucugcuuucauaaucagaua

SEQ ID NO: 12247 - RNA, 21 nt, Artificial Sequence
  Ebola virus siRNA sense strand
ucugcuuucauaaucagauau

SEQ ID NO: 12248 - RNA, 21 nt, Artificial Sequence
  Ebola virus siRNA sense strand
cugcuuucauaaucagauaua

SEQ ID NO: 12249 - RNA, 21 nt, Artificial Sequence
  Ebola virus siRNA sense strand
ugcuuucauaaucagauauau

SEQ ID NO: 12250 - RNA, 21 nt, Artificial Sequence
  Ebola virus siRNA sense strand
gcuuucauaaucagauauaua

SEQ ID NO: 12251 - RNA, 21 nt, Artificial Sequence
  Ebola virus siRNA sense strand
cuuucauaaucagauauauaa

SEQ ID NO: 12252 - RNA, 21 nt, Artificial Sequence
  Ebola virus siRNA sense strand
uuucauaaucagauauauaag

SEQ ID NO: 12253 - RNA, 21 nt, Artificial Sequence
  Ebola virus siRNA sense strand
uucauaaucagauauauaagc

SEQ ID NO: 12254 - RNA, 21 nt, Artificial Sequence
  Ebola virus siRNA sense strand
ucauaaucagauauauaagca

SEQ ID NO: 12255 - RNA, 21 nt, Artificial Sequence
  Ebola virus siRNA sense strand
cauaaucagauauauaagcau

SEQ ID NO: 12256 - RNA, 21 nt, Artificial Sequence
  Ebola virus siRNA sense strand
auaaucagauauauaagcaua

SEQ ID NO: 12257 - RNA, 21 nt, Artificial Sequence
  Ebola virus siRNA sense strand
uaaucagauauauaagcauaa

SEQ ID NO: 12258 - RNA, 21 nt, Artificial Sequence
  Ebola virus siRNA sense strand
aaucagauauauaagcauaau

SEQ ID NO: 12259 - RNA, 21 nt, Artificial Sequence
  Ebola virus siRNA sense strand
aucagauauauaagcauaaua

SEQ ID NO: 12260 - RNA, 21 nt, Artificial Sequence
  Ebola virus siRNA sense strand
ucagauauauaagcauaauaa

SEQ ID NO: 12261 - RNA, 21 nt, Artificial Sequence
  Ebola virus siRNA sense strand
cagauauauaagcauaauaaa

SEQ ID NO: 12262 - RNA, 21 nt, Artificial Sequence
  Ebola virus siRNA sense strand
agauauauaagcauaauaaau

SEQ ID NO: 12263 - RNA, 21 nt, Artificial Sequence
  Ebola virus siRNA sense strand
gauauauaagcauaauaaaua

SEQ ID NO: 12264 - RNA, 21 nt, Artificial Sequence
  Ebola virus siRNA sense strand
auauauaagcauaauaaauaa

SEQ ID NO: 12265 - RNA, 21 nt, Artificial Sequence
  Ebola virus siRNA sense strand
uauauaagcauaauaaauaaa

SEQ ID NO: 12266 - RNA, 21 nt, Artificial Sequence
  Ebola virus siRNA sense strand
auauaagcauaauaaauaaau

SEQ ID NO: 12267 - RNA, 21 nt, Artificial Sequence
  Ebola virus siRNA sense strand
uauaagcauaauaaauaaaua

SEQ ID NO: 12268 - RNA, 21 nt, Artificial Sequence
  Ebola virus siRNA sense strand
auaagcauaauaaauaaauac

SEQ ID NO: 12269 - RNA, 21 nt, Artificial Sequence
  Ebola virus siRNA sense strand
uaagcauaauaaauaaauacu

SEQ ID NO: 12270 - RNA, 21 nt, Artificial Sequence
  Ebola virus siRNA sense strand
aagcauaauaaauaaauacuc

SEQ ID NO: 12271 - RNA, 21 nt, Artificial Sequence
  Ebola virus siRNA sense strand
agcauaauaaauaaauacuca

SEQ ID NO: 12272 - RNA, 21 nt, Artificial Sequence
  Ebola virus siRNA sense strand
gcauaauaaauaaauacucau

SEQ ID NO: 12273 - RNA, 21 nt, Artificial Sequence
  Ebola virus siRNA sense strand
cauaauaaauaaauacucaua

SEQ ID NO: 12274 - RNA, 21 nt, Artificial Sequence
  Ebola virus siRNA sense strand
auaauaaauaaauacucauau

SEQ ID NO: 12275 - RNA, 21 nt, Artificial Sequence
  Ebola virus siRNA sense strand
uaauaaauaaauacucauauu

SEQ ID NO: 12276 - RNA, 21 nt, Artificial Sequence
  Ebola virus siRNA sense strand
aauaaauaaauacucauauuu

SEQ ID NO: 12277 - RNA, 21 nt, Artificial Sequence
  Ebola virus siRNA sense strand
auaaauaaauacucauauuuc

SEQ ID NO: 12278 - RNA, 21 nt, Artificial Sequence
  Ebola virus siRNA sense strand
uaaauaaauacucauauuucu

SEQ ID NO: 12279 - RNA, 21 nt, Artificial Sequence
  Ebola virus siRNA sense strand
aaauaaauacucauauuucuu

SEQ ID NO: 12280 - RNA, 21 nt, Artificial Sequence
  Ebola virus siRNA sense strand
aauaaauacucauauuucuug

SEQ ID NO: 12281 - RNA, 21 nt, Artificial Sequence
  Ebola virus siRNA sense strand
auaaauacucauauuucuuga

SEQ ID NO: 12282 - RNA, 21 nt, Artificial Sequence
  Ebola virus siRNA sense strand
uaaauacucauauuucuugau

SEQ ID NO: 12283 - RNA, 21 nt, Artificial Sequence
  Ebola virus siRNA sense strand
aaauacucauauuucuugaua

SEQ ID NO: 12284 - RNA, 21 nt, Artificial Sequence
  Ebola virus siRNA sense strand
aauacucauauuucuugauaa

SEQ ID NO: 12285 - RNA, 21 nt, Artificial Sequence
  Ebola virus siRNA sense strand
auacucauauuucuugauaau

SEQ ID NO: 12286 - RNA, 21 nt, Artificial Sequence
  Ebola virus siRNA sense strand
uacucauauuucuugauaauu

SEQ ID NO: 12287 - RNA, 21 nt, Artificial Sequence
  Ebola virus siRNA sense strand
acucauauuucuugauaauuu

SEQ ID NO: 12288 - RNA, 21 nt, Artificial Sequence
  Ebola virus siRNA sense strand
cucauauuucuugauaauuug

SEQ ID NO: 12289 - RNA, 21 nt, Artificial Sequence
  Ebola virus siRNA sense strand
ucauauuucuugauaauuugu

SEQ ID NO: 12290 - RNA, 21 nt, Artificial Sequence
  Ebola virus siRNA sense strand
cauauuucuugauaauuuguu

SEQ ID NO: 12291 - RNA, 21 nt, Artificial Sequence
  Ebola virus siRNA sense strand
auauuucuugauaauuuguuu

SEQ ID NO: 12292 - RNA, 21 nt, Artificial Sequence
  Ebola virus siRNA sense strand
uauuucuugauaauuuguuua

SEQ ID NO: 12293 - RNA, 21 nt, Artificial Sequence
  Ebola virus siRNA sense strand
auuucuugauaauuuguuuaa

SEQ ID NO: 12294 - RNA, 21 nt, Artificial Sequence
  Ebola virus siRNA sense strand
uuucuugauaauuuguuuaac

SEQ ID NO: 12295 - RNA, 21 nt, Artificial Sequence
  Ebola virus siRNA sense strand
uucuugauaauuuguuuaacc

SEQ ID NO: 12296 - RNA, 21 nt, Artificial Sequence
  Ebola virus siRNA sense strand
ucuugauaauuuguuuaacca

SEQ ID NO: 12297 - RNA, 21 nt, Artificial Sequence
  Ebola virus siRNA sense strand
cuugauaauuuguuuaaccac

SEQ ID NO: 12298 - RNA, 21 nt, Artificial Sequence
  Ebola virus siRNA sense strand
uugauaauuuguuuaaccaca

SEQ ID NO: 12299 - RNA, 21 nt, Artificial Sequence
  Ebola virus siRNA sense strand
ugauaauuuguuuaaccacag

SEQ ID NO: 12300 - RNA, 21 nt, Artificial Sequence
  Ebola virus siRNA sense strand
gauaauuuguuuaaccacaga

SEQ ID NO: 12301 - RNA, 21 nt, Artificial Sequence
  Ebola virus siRNA sense strand
auaauuuguuuaaccacagau

SEQ ID NO: 12302 - RNA, 21 nt, Artificial Sequence
  Ebola virus siRNA sense strand
uaauuuguuuaaccacagaua

SEQ ID NO: 12303 - RNA, 21 nt, Artificial Sequence
  Ebola virus siRNA sense strand
aauuuguuuaaccacagauaa

SEQ ID NO: 12304 - RNA, 21 nt, Artificial Sequence
  Ebola virus siRNA sense strand
auuuguuuaaccacagauaaa

SEQ ID NO: 12305 - RNA, 21 nt, Artificial Sequence
  Ebola virus siRNA sense strand
uuuguuuaaccacagauaaau

SEQ ID NO: 12306 - RNA, 21 nt, Artificial Sequence
  Ebola virus siRNA sense strand
uuguuuaaccacagauaaauc

SEQ ID NO: 12307 - RNA, 21 nt, Artificial Sequence
  Ebola virus siRNA sense strand
uguuuaaccacagauaaaucc

SEQ ID NO: 12308 - RNA, 21 nt, Artificial Sequence
  Ebola virus siRNA sense strand
guuuaaccacagauaaauccu

SEQ ID NO: 12309 - RNA, 21 nt, Artificial Sequence
  Ebola virus siRNA sense strand
uuuaaccacagauaaauccuc

SEQ ID NO: 12310 - RNA, 21 nt, Artificial Sequence
  Ebola virus siRNA sense strand
uuaaccacagauaaauccuca

SEQ ID NO: 12311 - RNA, 21 nt, Artificial Sequence
  Ebola virus siRNA sense strand
uaaccacagauaaauccucac

SEQ ID NO: 12312 - RNA, 21 nt, Artificial Sequence
  Ebola virus siRNA sense strand
aaccacagauaaauccucacu

SEQ ID NO: 12313 - RNA, 21 nt, Artificial Sequence
  Ebola virus siRNA sense strand
accacagauaaauccucacug

SEQ ID NO: 12314 - RNA, 21 nt, Artificial Sequence
  Ebola virus siRNA sense strand
ccacagauaaauccucacugu

SEQ ID NO: 12315 - RNA, 21 nt, Artificial Sequence
  Ebola virus siRNA sense strand
cacagauaaauccucacugua

SEQ ID NO: 12316 - RNA, 21 nt, Artificial Sequence
  Ebola virus siRNA sense strand
acagauaaauccucacuguaa

SEQ ID NO: 12317 - RNA, 21 nt, Artificial Sequence
  Ebola virus siRNA sense strand
cagauaaauccucacuguaag

SEQ ID NO: 12318 - RNA, 21 nt, Artificial Sequence
  Ebola virus siRNA sense strand
agauaaauccucacuguaagc

SEQ ID NO: 12319 - RNA, 21 nt, Artificial Sequence
  Ebola virus siRNA sense strand
gauaaauccucacuguaagcc

SEQ ID NO: 12320 - RNA, 21 nt, Artificial Sequence
  Ebola virus siRNA sense strand
auaaauccucacuguaagcca

SEQ ID NO: 12321 - RNA, 21 nt, Artificial Sequence
  Ebola virus siRNA sense strand
uaaauccucacuguaagccag

SEQ ID NO: 12322 - RNA, 21 nt, Artificial Sequence
  Ebola virus siRNA sense strand
aaauccucacuguaagccagc

SEQ ID NO: 12323 - RNA, 21 nt, Artificial Sequence
  Ebola virus siRNA sense strand
aauccucacuguaagccagcu

SEQ ID NO: 12324 - RNA, 21 nt, Artificial Sequence
  Ebola virus siRNA sense strand
auccucacuguaagccagcuu

SEQ ID NO: 12325 - RNA, 21 nt, Artificial Sequence
  Ebola virus siRNA sense strand
uccucacuguaagccagcuuc

SEQ ID NO: 12326 - RNA, 21 nt, Artificial Sequence
  Ebola virus siRNA sense strand
ccucacuguaagccagcuucc

SEQ ID NO: 12327 - RNA, 21 nt, Artificial Sequence
  Ebola virus siRNA sense strand
cucacuguaagccagcuucca

SEQ ID NO: 12328 - RNA, 21 nt, Artificial Sequence
  Ebola virus siRNA sense strand
ucacuguaagccagcuuccaa

SEQ ID NO: 12329 - RNA, 21 nt, Artificial Sequence
  Ebola virus siRNA sense strand
cacuguaagccagcuuccaag

SEQ ID NO: 12330 - RNA, 21 nt, Artificial Sequence
  Ebola virus siRNA sense strand
acuguaagccagcuuccaagu

SEQ ID NO: 12331 - RNA, 21 nt, Artificial Sequence
  Ebola virus siRNA sense strand
cuguaagccagcuuccaaguu

SEQ ID NO: 12332 - RNA, 21 nt, Artificial Sequence
  Ebola virus siRNA sense strand
uguaagccagcuuccaaguug

SEQ ID NO: 12333 - RNA, 21 nt, Artificial Sequence
  Ebola virus siRNA sense strand
guaagccagcuuccaaguuga

SEQ ID NO: 12334 - RNA, 21 nt, Artificial Sequence
  Ebola virus siRNA sense strand
uaagccagcuuccaaguugac

SEQ ID NO: 12335 - RNA, 21 nt, Artificial Sequence
  Ebola virus siRNA sense strand
aagccagcuuccaaguugaca

SEQ ID NO: 12336 - RNA, 21 nt, Artificial Sequence
  Ebola virus siRNA sense strand
agccagcuuccaaguugacac

SEQ ID NO: 12337 - RNA, 21 nt, Artificial Sequence
  Ebola virus siRNA sense strand
gccagcuuccaaguugacacc

SEQ ID NO: 12338 - RNA, 21 nt, Artificial Sequence
  Ebola virus siRNA sense strand
ccagcuuccaaguugacaccc

SEQ ID NO: 12339 - RNA, 21 nt, Artificial Sequence
  Ebola virus siRNA sense strand
cagcuuccaaguugacacccu

SEQ ID NO: 12340 - RNA, 21 nt, Artificial Sequence
  Ebola virus siRNA sense strand
agcuuccaaguugacacccuu

SEQ ID NO: 12341 - RNA, 21 nt, Artificial Sequence
  Ebola virus siRNA sense strand
gcuuccaaguugacacccuua

SEQ ID NO: 12342 - RNA, 21 nt, Artificial Sequence
  Ebola virus siRNA sense strand
cuuccaaguugacacccuuac

SEQ ID NO: 12343 - RNA, 21 nt, Artificial Sequence
  Ebola virus siRNA sense strand
uuccaaguugacacccuuaca

SEQ ID NO: 12344 - RNA, 21 nt, Artificial Sequence
  Ebola virus siRNA sense strand
uccaaguugacacccuuacaa

SEQ ID NO: 12345 - RNA, 21 nt, Artificial Sequence
  Ebola virus siRNA sense strand
ccaaguugacacccuuacaaa

SEQ ID NO: 12346 - RNA, 21 nt, Artificial Sequence
  Ebola virus siRNA sense strand
caaguugacacccuuacaaaa

SEQ ID NO: 12347 - RNA, 21 nt, Artificial Sequence
  Ebola virus siRNA sense strand
aaguugacacccuuacaaaaa

SEQ ID NO: 12348 - RNA, 21 nt, Artificial Sequence
  Ebola virus siRNA sense strand
aguugacacccuuacaaaaac

SEQ ID NO: 12349 - RNA, 21 nt, Artificial Sequence
  Ebola virus siRNA sense strand
guugacacccuuacaaaaacc

SEQ ID NO: 12350 - RNA, 21 nt, Artificial Sequence
  Ebola virus siRNA sense strand
uugacacccuuacaaaaacca

SEQ ID NO: 12351 - RNA, 21 nt, Artificial Sequence
  Ebola virus siRNA sense strand
ugacacccuuacaaaaaccag

SEQ ID NO: 12352 - RNA, 21 nt, Artificial Sequence
  Ebola virus siRNA sense strand
gacacccuuacaaaaaccagg

SEQ ID NO: 12353 - RNA, 21 nt, Artificial Sequence
  Ebola virus siRNA sense strand
acacccuuacaaaaaccagga

SEQ ID NO: 12354 - RNA, 21 nt, Artificial Sequence
  Ebola virus siRNA sense strand
cacccuuacaaaaaccaggac

SEQ ID NO: 12355 - RNA, 21 nt, Artificial Sequence
  Ebola virus siRNA sense strand
acccuuacaaaaaccaggacu

SEQ ID NO: 12356 - RNA, 21 nt, Artificial Sequence
  Ebola virus siRNA sense strand
cccuuacaaaaaccaggacuc

SEQ ID NO: 12357 - RNA, 21 nt, Artificial Sequence
  Ebola virus siRNA sense strand
ccuuacaaaaaccaggacuca

SEQ ID NO: 12358 - RNA, 21 nt, Artificial Sequence
  Ebola virus siRNA sense strand
cuuacaaaaaccaggacucag

SEQ ID NO: 12359 - RNA, 21 nt, Artificial Sequence
  Ebola virus siRNA sense strand
uuacaaaaaccaggacucaga

SEQ ID NO: 12360 - RNA, 21 nt, Artificial Sequence
  Ebola virus siRNA sense strand
uacaaaaaccaggacucagaa

SEQ ID NO: 12361 - RNA, 21 nt, Artificial Sequence
  Ebola virus siRNA sense strand
acaaaaaccaggacucagaau

SEQ ID NO: 12362 - RNA, 21 nt, Artificial Sequence
  Ebola virus siRNA sense strand
caaaaaccaggacucagaauc

SEQ ID NO: 12363 - RNA, 21 nt, Artificial Sequence
  Ebola virus siRNA sense strand
aaaaaccaggacucagaaucc

SEQ ID NO: 12364 - RNA, 21 nt, Artificial Sequence
  Ebola virus siRNA sense strand
aaaaccaggacucagaauccc

SEQ ID NO: 12365 - RNA, 21 nt, Artificial Sequence
  Ebola virus siRNA sense strand
aaaccaggacucagaaucccu

SEQ ID NO: 12366 - RNA, 21 nt, Artificial Sequence
  Ebola virus siRNA sense strand
aaccaggacucagaaucccuc

SEQ ID NO: 12367 - RNA, 21 nt, Artificial Sequence
  Ebola virus siRNA sense strand
accaggacucagaaucccuca

SEQ ID NO: 12368 - RNA, 21 nt, Artificial Sequence
  Ebola virus siRNA sense strand
ccaggacucagaaucccucaa

SEQ ID NO: 12369 - RNA, 21 nt, Artificial Sequence
  Ebola virus siRNA sense strand
caggacucagaaucccucaaa

SEQ ID NO: 12370 - RNA, 21 nt, Artificial Sequence
  Ebola virus siRNA sense strand
aggacucagaaucccucaaac

SEQ ID NO: 12371 - RNA, 21 nt, Artificial Sequence
  Ebola virus siRNA sense strand
ggacucagaaucccucaaaca

SEQ ID NO: 12372 - RNA, 21 nt, Artificial Sequence
  Ebola virus siRNA sense strand
gacucagaaucccucaaacaa

SEQ ID NO: 12373 - RNA, 21 nt, Artificial Sequence
  Ebola virus siRNA sense strand
acucagaaucccucaaacaag

SEQ ID NO: 12374 - RNA, 21 nt, Artificial Sequence
  Ebola virus siRNA sense strand
cucagaaucccucaaacaaga

SEQ ID NO: 12375 - RNA, 21 nt, Artificial Sequence
  Ebola virus siRNA sense strand
ucagaaucccucaaacaagag

SEQ ID NO: 12376 - RNA, 21 nt, Artificial Sequence
  Ebola virus siRNA sense strand
cagaaucccucaaacaagaga

SEQ ID NO: 12377 - RNA, 21 nt, Artificial Sequence
  Ebola virus siRNA sense strand
agaaucccucaaacaagagau

SEQ ID NO: 12378 - RNA, 21 nt, Artificial Sequence
  Ebola virus siRNA sense strand
gaaucccucaaacaagagauu

SEQ ID NO: 12379 - RNA, 21 nt, Artificial Sequence
  Ebola virus siRNA sense strand
aaucccucaaacaagagauuc

SEQ ID NO: 12380 - RNA, 21 nt, Artificial Sequence
  Ebola virus siRNA sense strand
aucccucaaacaagagauucc

SEQ ID NO: 12381 - RNA, 21 nt, Artificial Sequence
  Ebola virus siRNA sense strand
ucccucaaacaagagauucca

SEQ ID NO: 12382 - RNA, 21 nt, Artificial Sequence
  Ebola virus siRNA sense strand
cccucaaacaagagauuccaa

SEQ ID NO: 12383 - RNA, 21 nt, Artificial Sequence
  Ebola virus siRNA sense strand
ccucaaacaagagauuccaag

SEQ ID NO: 12384 - RNA, 21 nt, Artificial Sequence
  Ebola virus siRNA sense strand
cucaaacaagagauuccaaga

SEQ ID NO: 12385 - RNA, 21 nt, Artificial Sequence
  Ebola virus siRNA sense strand
ucaaacaagagauuccaagac

SEQ ID NO: 12386 - RNA, 21 nt, Artificial Sequence
  Ebola virus siRNA sense strand
caaacaagagauuccaagaca

SEQ ID NO: 12387 - RNA, 21 nt, Artificial Sequence
  Ebola virus siRNA sense strand
aaacaagagauuccaagacaa

SEQ ID NO: 12388 - RNA, 21 nt, Artificial Sequence
  Ebola virus siRNA sense strand
aacaagagauuccaagacaac

SEQ ID NO: 12389 - RNA, 21 nt, Artificial Sequence
  Ebola virus siRNA sense strand
acaagagauuccaagacaaca

SEQ ID NO: 12390 - RNA, 21 nt, Artificial Sequence
  Ebola virus siRNA sense strand
caagagauuccaagacaacau

SEQ ID NO: 12391 - RNA, 21 nt, Artificial Sequence
  Ebola virus siRNA sense strand
aagagauuccaagacaacauc

SEQ ID NO: 12392 - RNA, 21 nt, Artificial Sequence
  Ebola virus siRNA sense strand
agagauuccaagacaacauca

SEQ ID NO: 12393 - RNA, 21 nt, Artificial Sequence
  Ebola virus siRNA sense strand
gagauuccaagacaacaucau

SEQ ID NO: 12394 - RNA, 21 nt, Artificial Sequence
  Ebola virus siRNA sense strand
agauuccaagacaacaucaua

SEQ ID NO: 12395 - RNA, 21 nt, Artificial Sequence
  Ebola virus siRNA sense strand
gauuccaagacaacaucauag

SEQ ID NO: 12396 - RNA, 21 nt, Artificial Sequence
  Ebola virus siRNA sense strand
auuccaagacaacaucauaga

SEQ ID NO: 12397 - RNA, 21 nt, Artificial Sequence
  Ebola virus siRNA sense strand
uuccaagacaacaucauagaa

SEQ ID NO: 12398 - RNA, 21 nt, Artificial Sequence
  Ebola virus siRNA sense strand
uccaagacaacaucauagaau

SEQ ID NO: 12399 - RNA, 21 nt, Artificial Sequence
  Ebola virus siRNA sense strand
ccaagacaacaucauagaauu

SEQ ID NO: 12400 - RNA, 21 nt, Artificial Sequence
  Ebola virus siRNA sense strand
caagacaacaucauagaauug

SEQ ID NO: 12401 - RNA, 21 nt, Artificial Sequence
  Ebola virus siRNA sense strand
aagacaacaucauagaauugc

SEQ ID NO: 12402 - RNA, 21 nt, Artificial Sequence
  Ebola virus siRNA sense strand
agacaacaucauagaauugcu

SEQ ID NO: 12403 - RNA, 21 nt, Artificial Sequence
  Ebola virus siRNA sense strand
gacaacaucauagaauugcuu

SEQ ID NO: 12404 - RNA, 21 nt, Artificial Sequence
  Ebola virus siRNA sense strand
acaacaucauagaauugcuuu

SEQ ID NO: 12405 - RNA, 21 nt, Artificial Sequence
  Ebola virus siRNA sense strand
caacaucauagaauugcuuua

SEQ ID NO: 12406 - RNA, 21 nt, Artificial Sequence
  Ebola virus siRNA sense strand
aacaucauagaauugcuuuau

SEQ ID NO: 12407 - RNA, 21 nt, Artificial Sequence
  Ebola virus siRNA sense strand
acaucauagaauugcuuuauu

SEQ ID NO: 12408 - RNA, 21 nt, Artificial Sequence
  Ebola virus siRNA sense strand
caucauagaauugcuuuauua

SEQ ID NO: 12409 - RNA, 21 nt, Artificial Sequence
  Ebola virus siRNA sense strand
aucauagaauugcuuuauuau

SEQ ID NO: 12410 - RNA, 21 nt, Artificial Sequence
  Ebola virus siRNA sense strand
ucauagaauugcuuuauuaua

SEQ ID NO: 12411 - RNA, 21 nt, Artificial Sequence
  Ebola virus siRNA sense strand
cauagaauugcuuuauuauau

SEQ ID NO: 12412 - RNA, 21 nt, Artificial Sequence
  Ebola virus siRNA sense strand
auagaauugcuuuauuauaug

SEQ ID NO: 12413 - RNA, 21 nt, Artificial Sequence
  Ebola virus siRNA sense strand
uagaauugcuuuauuauauga

SEQ ID NO: 12414 - RNA, 21 nt, Artificial Sequence
  Ebola virus siRNA sense strand
agaauugcuuuauuauaugaa

SEQ ID NO: 12415 - RNA, 21 nt, Artificial Sequence
  Ebola virus siRNA sense strand
gaauugcuuuauuauaugaau

SEQ ID NO: 12416 - RNA, 21 nt, Artificial Sequence
  Ebola virus siRNA sense strand
aauugcuuuauuauaugaaua

SEQ ID NO: 12417 - RNA, 21 nt, Artificial Sequence
  Ebola virus siRNA sense strand
auugcuuuauuauaugaauaa

SEQ ID NO: 12418 - RNA, 21 nt, Artificial Sequence
  Ebola virus siRNA sense strand
uugcuuuauuauaugaauaag

SEQ ID NO: 12419 - RNA, 21 nt, Artificial Sequence
  Ebola virus siRNA sense strand
ugcuuuauuauaugaauaagc

SEQ ID NO: 12420 - RNA, 21 nt, Artificial Sequence
  Ebola virus siRNA sense strand
gcuuuauuauaugaauaagca

SEQ ID NO: 12421 - RNA, 21 nt, Artificial Sequence
  Ebola virus siRNA sense strand
cuuuauuauaugaauaagcau

SEQ ID NO: 12422 - RNA, 21 nt, Artificial Sequence
  Ebola virus siRNA sense strand
uuuauuauaugaauaagcauu

SEQ ID NO: 12423 - RNA, 21 nt, Artificial Sequence
  Ebola virus siRNA sense strand
uuauuauaugaauaagcauuu

SEQ ID NO: 12424 - RNA, 21 nt, Artificial Sequence
  Ebola virus siRNA sense strand
uauuauaugaauaagcauuuu

SEQ ID NO: 12425 - RNA, 21 nt, Artificial Sequence
  Ebola virus siRNA sense strand
auuauaugaauaagcauuuua

SEQ ID NO: 12426 - RNA, 21 nt, Artificial Sequence
  Ebola virus siRNA sense strand
uuauaugaauaagcauuuuau

SEQ ID NO: 12427 - RNA, 21 nt, Artificial Sequence
  Ebola virus siRNA sense strand
uauaugaauaagcauuuuauc

SEQ ID NO: 12428 - RNA, 21 nt, Artificial Sequence
  Ebola virus siRNA sense strand
auaugaauaagcauuuuauca

SEQ ID NO: 12429 - RNA, 21 nt, Artificial Sequence
  Ebola virus siRNA sense strand
uaugaauaagcauuuuaucac

SEQ ID NO: 12430 - RNA, 21 nt, Artificial Sequence
  Ebola virus siRNA sense strand
augaauaagcauuuuaucacc

SEQ ID NO: 12431 - RNA, 21 nt, Artificial Sequence
  Ebola virus siRNA sense strand
ugaauaagcauuuuaucacca

SEQ ID NO: 12432 - RNA, 21 nt, Artificial Sequence
  Ebola virus siRNA sense strand
gaauaagcauuuuaucaccag

SEQ ID NO: 12433 - RNA, 21 nt, Artificial Sequence
  Ebola virus siRNA sense strand
aauaagcauuuuaucaccaga

SEQ ID NO: 12434 - RNA, 21 nt, Artificial Sequence
  Ebola virus siRNA sense strand
auaagcauuuuaucaccagaa

SEQ ID NO: 12435 - RNA, 21 nt, Artificial Sequence
  Ebola virus siRNA sense strand
uaagcauuuuaucaccagaaa

SEQ ID NO: 12436 - RNA, 21 nt, Artificial Sequence
  Ebola virus siRNA sense strand
aagcauuuuaucaccagaaau

SEQ ID NO: 12437 - RNA, 21 nt, Artificial Sequence
  Ebola virus siRNA sense strand
agcauuuuaucaccagaaauc

SEQ ID NO: 12438 - RNA, 21 nt, Artificial Sequence
  Ebola virus siRNA sense strand
gcauuuuaucaccagaaaucc

SEQ ID NO: 12439 - RNA, 21 nt, Artificial Sequence
  Ebola virus siRNA sense strand
cauuuuaucaccagaaauccu

SEQ ID NO: 12440 - RNA, 21 nt, Artificial Sequence
  Ebola virus siRNA sense strand
auuuuaucaccagaaauccua

SEQ ID NO: 12441 - RNA, 21 nt, Artificial Sequence
  Ebola virus siRNA sense strand
uuuuaucaccagaaauccuau

SEQ ID NO: 12442 - RNA, 21 nt, Artificial Sequence
  Ebola virus siRNA sense strand
uuuaucaccagaaauccuaua

SEQ ID NO: 12443 - RNA, 21 nt, Artificial Sequence
  Ebola virus siRNA sense strand
uuaucaccagaaauccuauau

SEQ ID NO: 12444 - RNA, 21 nt, Artificial Sequence
  Ebola virus siRNA sense strand
uaucaccagaaauccuauaua

SEQ ID NO: 12445 - RNA, 21 nt, Artificial Sequence
  Ebola virus siRNA sense strand
aucaccagaaauccuauauac

SEQ ID NO: 12446 - RNA, 21 nt, Artificial Sequence
  Ebola virus siRNA sense strand
ucaccagaaauccuauauacu

SEQ ID NO: 12447 - RNA, 21 nt, Artificial Sequence
  Ebola virus siRNA sense strand
caccagaaauccuauauacua

SEQ ID NO: 12448 - RNA, 21 nt, Artificial Sequence
  Ebola virus siRNA sense strand
accagaaauccuauauacuaa

SEQ ID NO: 12449 - RNA, 21 nt, Artificial Sequence
  Ebola virus siRNA sense strand
ccagaaauccuauauacuaaa

SEQ ID NO: 12450 - RNA, 21 nt, Artificial Sequence
  Ebola virus siRNA sense strand
cagaaauccuauauacuaaau

SEQ ID NO: 12451 - RNA, 21 nt, Artificial Sequence
  Ebola virus siRNA sense strand
agaaauccuauauacuaaaug

SEQ ID NO: 12452 - RNA, 21 nt, Artificial Sequence
  Ebola virus siRNA sense strand
gaaauccuauauacuaaaugg

SEQ ID NO: 12453 - RNA, 21 nt, Artificial Sequence
  Ebola virus siRNA sense strand
aaauccuauauacuaaauggu

SEQ ID NO: 12454 - RNA, 21 nt, Artificial Sequence
  Ebola virus siRNA sense strand
aauccuauauacuaaaugguu

SEQ ID NO: 12455 - RNA, 21 nt, Artificial Sequence
  Ebola virus siRNA sense strand
auccuauauacuaaaugguua

SEQ ID NO: 12456 - RNA, 21 nt, Artificial Sequence
  Ebola virus siRNA sense strand
uccuauauacuaaaugguuaa

SEQ ID NO: 12457 - RNA, 21 nt, Artificial Sequence
  Ebola virus siRNA sense strand
ccuauauacuaaaugguuaau

SEQ ID NO: 12458 - RNA, 21 nt, Artificial Sequence
  Ebola virus siRNA sense strand
cuauauacuaaaugguuaauu

SEQ ID NO: 12459 - RNA, 21 nt, Artificial Sequence
  Ebola virus siRNA sense strand
uauauacuaaaugguuaauug

SEQ ID NO: 12460 - RNA, 21 nt, Artificial Sequence
  Ebola virus siRNA sense strand
auauacuaaaugguuaauugu

SEQ ID NO: 12461 - RNA, 21 nt, Artificial Sequence
  Ebola virus siRNA sense strand
uauacuaaaugguuaauugua

SEQ ID NO: 12462 - RNA, 21 nt, Artificial Sequence
  Ebola virus siRNA sense strand
auacuaaaugguuaauuguaa

SEQ ID NO: 12463 - RNA, 21 nt, Artificial Sequence
  Ebola virus siRNA sense strand
uacuaaaugguuaauuguaac

SEQ ID NO: 12464 - RNA, 21 nt, Artificial Sequence
  Ebola virus siRNA sense strand
acuaaaugguuaauuguaacu

SEQ ID NO: 12465 - RNA, 21 nt, Artificial Sequence
  Ebola virus siRNA sense strand
cuaaaugguuaauuguaacug

SEQ ID NO: 12466 - RNA, 21 nt, Artificial Sequence
  Ebola virus siRNA sense strand
uaaaugguuaauuguaacuga

SEQ ID NO: 12467 - RNA, 21 nt, Artificial Sequence
  Ebola virus siRNA sense strand
aaaugguuaauuguaacugaa

SEQ ID NO: 12468 - RNA, 21 nt, Artificial Sequence
  Ebola virus siRNA sense strand
aaugguuaauuguaacugaac

SEQ ID NO: 12469 - RNA, 21 nt, Artificial Sequence
  Ebola virus siRNA sense strand
augguuaauuguaacugaacc

SEQ ID NO: 12470 - RNA, 21 nt, Artificial Sequence
  Ebola virus siRNA sense strand
ugguuaauuguaacugaaccc

SEQ ID NO: 12471 - RNA, 21 nt, Artificial Sequence
  Ebola virus siRNA sense strand
gguuaauuguaacugaacccg

SEQ ID NO: 12472 - RNA, 21 nt, Artificial Sequence
  Ebola virus siRNA sense strand
guuaauuguaacugaacccgc

SEQ ID NO: 12473 - RNA, 21 nt, Artificial Sequence
  Ebola virus siRNA sense strand
uuaauuguaacugaacccgca

SEQ ID NO: 12474 - RNA, 21 nt, Artificial Sequence
  Ebola virus siRNA sense strand
uaauuguaacugaacccgcag

SEQ ID NO: 12475 - RNA, 21 nt, Artificial Sequence
  Ebola virus siRNA sense strand
aauuguaacugaacccgcagg

SEQ ID NO: 12476 - RNA, 21 nt, Artificial Sequence
  Ebola virus siRNA sense strand
auuguaacugaacccgcaggu

SEQ ID NO: 12477 - RNA, 21 nt, Artificial Sequence
  Ebola virus siRNA sense strand
uuguaacugaacccgcagguc

SEQ ID NO: 12478 - RNA, 21 nt, Artificial Sequence
  Ebola virus siRNA sense strand
uguaacugaacccgcagguca

SEQ ID NO: 12479 - RNA, 21 nt, Artificial Sequence
  Ebola virus siRNA sense strand
guaacugaacccgcaggucac

SEQ ID NO: 12480 - RNA, 21 nt, Artificial Sequence
  Ebola virus siRNA sense strand
uaacugaacccgcaggucaca

SEQ ID NO: 12481 - RNA, 21 nt, Artificial Sequence
  Ebola virus siRNA sense strand
aacugaacccgcaggucacau

SEQ ID NO: 12482 - RNA, 21 nt, Artificial Sequence
  Ebola virus siRNA sense strand
acugaacccgcaggucacaug

SEQ ID NO: 12483 - RNA, 21 nt, Artificial Sequence
  Ebola virus siRNA sense strand
cugaacccgcaggucacaugu

SEQ ID NO: 12484 - RNA, 21 nt, Artificial Sequence
  Ebola virus siRNA sense strand
ugaacccgcaggucacaugug

SEQ ID NO: 12485 - RNA, 21 nt, Artificial Sequence
  Ebola virus siRNA sense strand
gaacccgcaggucacaugugu

SEQ ID NO: 12486 - RNA, 21 nt, Artificial Sequence
  Ebola virus siRNA sense strand
aacccgcaggucacauguguu

SEQ ID NO: 12487 - RNA, 21 nt, Artificial Sequence
  Ebola virus siRNA sense strand
acccgcaggucacauguguua

SEQ ID NO: 12488 - RNA, 21 nt, Artificial Sequence
  Ebola virus siRNA sense strand
cccgcaggucacauguguuag

SEQ ID NO: 12489 - RNA, 21 nt, Artificial Sequence
  Ebola virus siRNA sense strand
ccgcaggucacauguguuagg

SEQ ID NO: 12490 - RNA, 21 nt, Artificial Sequence
  Ebola virus siRNA sense strand
cgcaggucacauguguuaggu

SEQ ID NO: 12491 - RNA, 21 nt, Artificial Sequence
  Ebola virus siRNA sense strand
gcaggucacauguguuagguu

SEQ ID NO: 12492 - RNA, 21 nt, Artificial Sequence
  Ebola virus siRNA sense strand
caggucacauguguuagguuu

SEQ ID NO: 12493 - RNA, 21 nt, Artificial Sequence
  Ebola virus siRNA sense strand
aggucacauguguuagguuuc

SEQ ID NO: 12494 - RNA, 21 nt, Artificial Sequence
  Ebola virus siRNA sense strand
ggucacauguguuagguuuca

SEQ ID NO: 12495 - RNA, 21 nt, Artificial Sequence
  Ebola virus siRNA sense strand
gucacauguguuagguuucac

SEQ ID NO: 12496 - RNA, 21 nt, Artificial Sequence
  Ebola virus siRNA sense strand
ucacauguguuagguuucaca

SEQ ID NO: 12497 - RNA, 21 nt, Artificial Sequence
  Ebola virus siRNA sense strand
cacauguguuagguuucacag

SEQ ID NO: 12498 - RNA, 21 nt, Artificial Sequence
  Ebola virus siRNA sense strand
acauguguuagguuucacaga

SEQ ID NO: 12499 - RNA, 21 nt, Artificial Sequence
  Ebola virus siRNA sense strand
cauguguuagguuucacagau

SEQ ID NO: 12500 - RNA, 21 nt, Artificial Sequence
  Ebola virus siRNA sense strand
auguguuagguuucacagauu

SEQ ID NO: 12501 - RNA, 21 nt, Artificial Sequence
  Ebola virus siRNA sense strand
uguguuagguuucacagauuc

SEQ ID NO: 12502 - RNA, 21 nt, Artificial Sequence
  Ebola virus siRNA sense strand
guguuagguuucacagauucu

SEQ ID NO: 12503 - RNA, 21 nt, Artificial Sequence
  Ebola virus siRNA sense strand
uguuagguuucacagauucua

SEQ ID NO: 12504 - RNA, 21 nt, Artificial Sequence
  Ebola virus siRNA sense strand
guuagguuucacagauucuau

SEQ ID NO: 12505 - RNA, 21 nt, Artificial Sequence
  Ebola virus siRNA sense strand
uuagguuucacagauucuaua

SEQ ID NO: 12506 - RNA, 21 nt, Artificial Sequence
  Ebola virus siRNA sense strand
uagguuucacagauucuauau

SEQ ID NO: 12507 - RNA, 21 nt, Artificial Sequence
  Ebola virus siRNA sense strand
agguuucacagauucuauaua

SEQ ID NO: 12508 - RNA, 21 nt, Artificial Sequence
  Ebola virus siRNA sense strand
gguuucacagauucuauauau

SEQ ID NO: 12509 - RNA, 21 nt, Artificial Sequence
  Ebola virus siRNA sense strand
guuucacagauucuauauauu

SEQ ID NO: 12510 - RNA, 21 nt, Artificial Sequence
  Ebola virus siRNA sense strand
uuucacagauucuauauauua

SEQ ID NO: 12511 - RNA, 21 nt, Artificial Sequence
  Ebola virus siRNA sense strand
uucacagauucuauauauuac

SEQ ID NO: 12512 - RNA, 21 nt, Artificial Sequence
  Ebola virus siRNA sense strand
ucacagauucuauauauuacu

SEQ ID NO: 12513 - RNA, 21 nt, Artificial Sequence
  Ebola virus siRNA sense strand
cacagauucuauauauuacua

SEQ ID NO: 12514 - RNA, 21 nt, Artificial Sequence
  Ebola virus siRNA sense strand
acagauucuauauauuacuaa

SEQ ID NO: 12515 - RNA, 21 nt, Artificial Sequence
  Ebola virus siRNA sense strand
cagauucuauauauuacuaac

SEQ ID NO: 12516 - RNA, 21 nt, Artificial Sequence
  Ebola virus siRNA sense strand
agauucuauauauuacuaacu

SEQ ID NO: 12517 - RNA, 21 nt, Artificial Sequence
  Ebola virus siRNA sense strand
gauucuauauauuacuaacuc

SEQ ID NO: 12518 - RNA, 21 nt, Artificial Sequence
  Ebola virus siRNA sense strand
auucuauauauuacuaacucu

SEQ ID NO: 12519 - RNA, 21 nt, Artificial Sequence
  Ebola virus siRNA sense strand
uucuauauauuacuaacucua

SEQ ID NO: 12520 - RNA, 21 nt, Artificial Sequence
  Ebola virus siRNA sense strand
ucuauauauuacuaacucuau

SEQ ID NO: 12521 - RNA, 21 nt, Artificial Sequence
  Ebola virus siRNA sense strand
cuauauauuacuaacucuaua

SEQ ID NO: 12522 - RNA, 21 nt, Artificial Sequence
  Ebola virus siRNA sense strand
uauauauuacuaacucuauac

SEQ ID NO: 12523 - RNA, 21 nt, Artificial Sequence
  Ebola virus siRNA sense strand
auauauuacuaacucuauacu

SEQ ID NO: 12524 - RNA, 21 nt, Artificial Sequence
  Ebola virus siRNA sense strand
uauauuacuaacucuauacuc

SEQ ID NO: 12525 - RNA, 21 nt, Artificial Sequence
  Ebola virus siRNA sense strand
auauuacuaacucuauacucg

SEQ ID NO: 12526 - RNA, 21 nt, Artificial Sequence
  Ebola virus siRNA sense strand
uauuacuaacucuauacucgu

SEQ ID NO: 12527 - RNA, 21 nt, Artificial Sequence
  Ebola virus siRNA sense strand
auuacuaacucuauacucgua

SEQ ID NO: 12528 - RNA, 21 nt, Artificial Sequence
  Ebola virus siRNA sense strand
uuacuaacucuauacucguaa

SEQ ID NO: 12529 - RNA, 21 nt, Artificial Sequence
  Ebola virus siRNA sense strand
uacuaacucuauacucguaau

SEQ ID NO: 12530 - RNA, 21 nt, Artificial Sequence
  Ebola virus siRNA sense strand
acuaacucuauacucguaauu

SEQ ID NO: 12531 - RNA, 21 nt, Artificial Sequence
  Ebola virus siRNA sense strand
cuaacucuauacucguaauua

SEQ ID NO: 12532 - RNA, 21 nt, Artificial Sequence
  Ebola virus siRNA sense strand
uaacucuauacucguaauuaa

SEQ ID NO: 12533 - RNA, 21 nt, Artificial Sequence
  Ebola virus siRNA sense strand
aacucuauacucguaauuaac

SEQ ID NO: 12534 - RNA, 21 nt, Artificial Sequence
  Ebola virus siRNA sense strand
acucuauacucguaauuaaca

SEQ ID NO: 12535 - RNA, 21 nt, Artificial Sequence
  Ebola virus siRNA sense strand
cucuauacucguaauuaacau

SEQ ID NO: 12536 - RNA, 21 nt, Artificial Sequence
  Ebola virus siRNA sense strand
ucuauacucguaauuaacauu

SEQ ID NO: 12537 - RNA, 21 nt, Artificial Sequence
  Ebola virus siRNA sense strand
cuauacucguaauuaacauua

SEQ ID NO: 12538 - RNA, 21 nt, Artificial Sequence
  Ebola virus siRNA sense strand
uauacucguaauuaacauuag

SEQ ID NO: 12539 - RNA, 21 nt, Artificial Sequence
  Ebola virus siRNA sense strand
auacucguaauuaacauuaga

SEQ ID NO: 12540 - RNA, 21 nt, Artificial Sequence
  Ebola virus siRNA sense strand
uacucguaauuaacauuagau

SEQ ID NO: 12541 - RNA, 21 nt, Artificial Sequence
  Ebola virus siRNA sense strand
acucguaauuaacauuagaua

SEQ ID NO: 12542 - RNA, 21 nt, Artificial Sequence
  Ebola virus siRNA sense strand
cucguaauuaacauuagauaa

SEQ ID NO: 12543 - RNA, 21 nt, Artificial Sequence
  Ebola virus siRNA sense strand
ucguaauuaacauuagauaag

SEQ ID NO: 12544 - RNA, 21 nt, Artificial Sequence
  Ebola virus siRNA sense strand
cguaauuaacauuagauaagu

SEQ ID NO: 12545 - RNA, 21 nt, Artificial Sequence
  Ebola virus siRNA sense strand
guaauuaacauuagauaagua

SEQ ID NO: 12546 - RNA, 21 nt, Artificial Sequence
  Ebola virus siRNA sense strand
uaauuaacauuagauaaguag

SEQ ID NO: 12547 - RNA, 21 nt, Artificial Sequence
  Ebola virus siRNA sense strand
aauuaacauuagauaaguaga

SEQ ID NO: 12548 - RNA, 21 nt, Artificial Sequence
  Ebola virus siRNA sense strand
auuaacauuagauaaguagau

SEQ ID NO: 12549 - RNA, 21 nt, Artificial Sequence
  Ebola virus siRNA sense strand
uuaacauuagauaaguagauu

SEQ ID NO: 12550 - RNA, 21 nt, Artificial Sequence
  Ebola virus siRNA sense strand
uaacauuagauaaguagauua

SEQ ID NO: 12551 - RNA, 21 nt, Artificial Sequence
  Ebola virus siRNA sense strand
aacauuagauaaguagauuaa

SEQ ID NO: 12552 - RNA, 21 nt, Artificial Sequence
  Ebola virus siRNA sense strand
acauuagauaaguagauuaag

SEQ ID NO: 12553 - RNA, 21 nt, Artificial Sequence
  Ebola virus siRNA sense strand
cauuagauaaguagauuaaga

SEQ ID NO: 12554 - RNA, 21 nt, Artificial Sequence
  Ebola virus siRNA sense strand
auuagauaaguagauuaagaa

SEQ ID NO: 12555 - RNA, 21 nt, Artificial Sequence
  Ebola virus siRNA sense strand
uuagauaaguagauuaagaaa

SEQ ID NO: 12556 - RNA, 21 nt, Artificial Sequence
  Ebola virus siRNA sense strand
uagauaaguagauuaagaaaa

SEQ ID NO: 12557 - RNA, 21 nt, Artificial Sequence
  Ebola virus siRNA sense strand
agauaaguagauuaagaaaaa

SEQ ID NO: 12558 - RNA, 21 nt, Artificial Sequence
  Ebola virus siRNA sense strand
gauaaguagauuaagaaaaaa

SEQ ID NO: 12559 - RNA, 21 nt, Artificial Sequence
  Ebola virus siRNA sense strand
auaaguagauuaagaaaaaag

SEQ ID NO: 12560 - RNA, 21 nt, Artificial Sequence
  Ebola virus siRNA sense strand
uaaguagauuaagaaaaaagc

SEQ ID NO: 12561 - RNA, 21 nt, Artificial Sequence
  Ebola virus siRNA sense strand
aaguagauuaagaaaaaagcc

SEQ ID NO: 12562 - RNA, 21 nt, Artificial Sequence
  Ebola virus siRNA sense strand
aguagauuaagaaaaaagccu

SEQ ID NO: 12563 - RNA, 21 nt, Artificial Sequence
  Ebola virus siRNA sense strand
guagauuaagaaaaaagccug

SEQ ID NO: 12564 - RNA, 21 nt, Artificial Sequence
  Ebola virus siRNA sense strand
uagauuaagaaaaaagccuga

SEQ ID NO: 12565 - RNA, 21 nt, Artificial Sequence
  Ebola virus siRNA sense strand
agauuaagaaaaaagccugag

SEQ ID NO: 12566 - RNA, 21 nt, Artificial Sequence
  Ebola virus siRNA sense strand
gauuaagaaaaaagccugagg

SEQ ID NO: 12567 - RNA, 21 nt, Artificial Sequence
  Ebola virus siRNA sense strand
auuaagaaaaaagccugagga

SEQ ID NO: 12568 - RNA, 21 nt, Artificial Sequence
  Ebola virus siRNA sense strand
uuaagaaaaaagccugaggaa

SEQ ID NO: 12569 - RNA, 21 nt, Artificial Sequence
  Ebola virus siRNA sense strand
uaagaaaaaagccugaggaag

SEQ ID NO: 12570 - RNA, 21 nt, Artificial Sequence
  Ebola virus siRNA sense strand
aagaaaaaagccugaggaaga

SEQ ID NO: 12571 - RNA, 21 nt, Artificial Sequence
  Ebola virus siRNA sense strand
agaaaaaagccugaggaagau

SEQ ID NO: 12572 - RNA, 21 nt, Artificial Sequence
  Ebola virus siRNA sense strand
gaaaaaagccugaggaagauu

SEQ ID NO: 12573 - RNA, 21 nt, Artificial Sequence
  Ebola virus siRNA sense strand
aaaaaagccugaggaagauua

SEQ ID NO: 12574 - RNA, 21 nt, Artificial Sequence
  Ebola virus siRNA sense strand
aaaaagccugaggaagauuaa

SEQ ID NO: 12575 - RNA, 21 nt, Artificial Sequence
  Ebola virus siRNA sense strand
aaaagccugaggaagauuaag

SEQ ID NO: 12576 - RNA, 21 nt, Artificial Sequence
  Ebola virus siRNA sense strand
aaagccugaggaagauuaaga

SEQ ID NO: 12577 - RNA, 21 nt, Artificial Sequence
  Ebola virus siRNA sense strand
aagccugaggaagauuaagaa

SEQ ID NO: 12578 - RNA, 21 nt, Artificial Sequence
  Ebola virus siRNA sense strand
agccugaggaagauuaagaaa

SEQ ID NO: 12579 - RNA, 21 nt, Artificial Sequence
  Ebola virus siRNA sense strand
gccugaggaagauuaagaaaa

SEQ ID NO: 12580 - RNA, 21 nt, Artificial Sequence
  Ebola virus siRNA sense strand
ccugaggaagauuaagaaaaa

SEQ ID NO: 12581 - RNA, 21 nt, Artificial Sequence
  Ebola virus siRNA sense strand
cugaggaagauuaagaaaaac

SEQ ID NO: 12582 - RNA, 21 nt, Artificial Sequence
  Ebola virus siRNA sense strand
ugaggaagauuaagaaaaacu

SEQ ID NO: 12583 - RNA, 21 nt, Artificial Sequence
  Ebola virus siRNA sense strand
gaggaagauuaagaaaaacug

SEQ ID NO: 12584 - RNA, 21 nt, Artificial Sequence
  Ebola virus siRNA sense strand
aggaagauuaagaaaaacugc

SEQ ID NO: 12585 - RNA, 21 nt, Artificial Sequence
  Ebola virus siRNA sense strand
ggaagauuaagaaaaacugcu

SEQ ID NO: 12586 - RNA, 21 nt, Artificial Sequence
  Ebola virus siRNA sense strand
gaagauuaagaaaaacugcuu

SEQ ID NO: 12587 - RNA, 21 nt, Artificial Sequence
  Ebola virus siRNA sense strand
aagauuaagaaaaacugcuua

SEQ ID NO: 12588 - RNA, 21 nt, Artificial Sequence
  Ebola virus siRNA sense strand
agauuaagaaaaacugcuuau

SEQ ID NO: 12589 - RNA, 21 nt, Artificial Sequence
  Ebola virus siRNA sense strand
gauuaagaaaaacugcuuauu

SEQ ID NO: 12590 - RNA, 21 nt, Artificial Sequence
  Ebola virus siRNA sense strand
auuaagaaaaacugcuuauug

SEQ ID NO: 12591 - RNA, 21 nt, Artificial Sequence
  Ebola virus siRNA sense strand
uuaagaaaaacugcuuauugg

SEQ ID NO: 12592 - RNA, 21 nt, Artificial Sequence
  Ebola virus siRNA sense strand
uaagaaaaacugcuuauuggg

SEQ ID NO: 12593 - RNA, 21 nt, Artificial Sequence
  Ebola virus siRNA sense strand
aagaaaaacugcuuauugggu

SEQ ID NO: 12594 - RNA, 21 nt, Artificial Sequence
  Ebola virus siRNA sense strand
agaaaaacugcuuauuggguc

SEQ ID NO: 12595 - RNA, 21 nt, Artificial Sequence
  Ebola virus siRNA sense strand
gaaaaacugcuuauugggucu

SEQ ID NO: 12596 - RNA, 21 nt, Artificial Sequence
  Ebola virus siRNA sense strand
aaaaacugcuuauugggucuu

SEQ ID NO: 12597 - RNA, 21 nt, Artificial Sequence
  Ebola virus siRNA sense strand
aaaacugcuuauugggucuuu

SEQ ID NO: 12598 - RNA, 21 nt, Artificial Sequence
  Ebola virus siRNA sense strand
aaacugcuuauugggucuuuc

SEQ ID NO: 12599 - RNA, 21 nt, Artificial Sequence
  Ebola virus siRNA sense strand
aacugcuuauugggucuuucc

SEQ ID NO: 12600 - RNA, 21 nt, Artificial Sequence
  Ebola virus siRNA sense strand
acugcuuauugggucuuuccg

SEQ ID NO: 12601 - RNA, 21 nt, Artificial Sequence
  Ebola virus siRNA sense strand
cugcuuauugggucuuuccgu

SEQ ID NO: 12602 - RNA, 21 nt, Artificial Sequence
  Ebola virus siRNA sense strand
ugcuuauugggucuuuccgug

SEQ ID NO: 12603 - RNA, 21 nt, Artificial Sequence
  Ebola virus siRNA sense strand
gcuuauugggucuuuccgugu

SEQ ID NO: 12604 - RNA, 21 nt, Artificial Sequence
  Ebola virus siRNA sense strand
cuuauugggucuuuccguguu

SEQ ID NO: 12605 - RNA, 21 nt, Artificial Sequence
  Ebola virus siRNA sense strand
uuauugggucuuuccguguuu

SEQ ID NO: 12606 - RNA, 21 nt, Artificial Sequence
  Ebola virus siRNA sense strand
uauugggucuuuccguguuuu

SEQ ID NO: 12607 - RNA, 21 nt, Artificial Sequence
  Ebola virus siRNA sense strand
auugggucuuuccguguuuua

SEQ ID NO: 12608 - RNA, 21 nt, Artificial Sequence
  Ebola virus siRNA sense strand
uugggucuuuccguguuuuag

SEQ ID NO: 12609 - RNA, 21 nt, Artificial Sequence
  Ebola virus siRNA sense strand
ugggucuuuccguguuuuaga

SEQ ID NO: 12610 - RNA, 21 nt, Artificial Sequence
  Ebola virus siRNA sense strand
gggucuuuccguguuuuagau

SEQ ID NO: 12611 - RNA, 21 nt, Artificial Sequence
  Ebola virus siRNA sense strand
ggucuuuccguguuuuagaug

SEQ ID NO: 12612 - RNA, 21 nt, Artificial Sequence
  Ebola virus siRNA sense strand
gucuuuccguguuuuagauga

SEQ ID NO: 12613 - RNA, 21 nt, Artificial Sequence
  Ebola virus siRNA sense strand
ucuuuccguguuuuagaugaa

SEQ ID NO: 12614 - RNA, 21 nt, Artificial Sequence
  Ebola virus siRNA sense strand
cuuuccguguuuuagaugaag

SEQ ID NO: 12615 - RNA, 21 nt, Artificial Sequence
  Ebola virus siRNA sense strand
uuuccguguuuuagaugaagc

SEQ ID NO: 12616 - RNA, 21 nt, Artificial Sequence
  Ebola virus siRNA sense strand
uuccguguuuuagaugaagca

SEQ ID NO: 12617 - RNA, 21 nt, Artificial Sequence
  Ebola virus siRNA sense strand
uccguguuuuagaugaagcag

SEQ ID NO: 12618 - RNA, 21 nt, Artificial Sequence
  Ebola virus siRNA sense strand
ccguguuuuagaugaagcagu

SEQ ID NO: 12619 - RNA, 21 nt, Artificial Sequence
  Ebola virus siRNA sense strand
cguguuuuagaugaagcaguu

SEQ ID NO: 12620 - RNA, 21 nt, Artificial Sequence
  Ebola virus siRNA sense strand
guguuuuagaugaagcaguug

SEQ ID NO: 12621 - RNA, 21 nt, Artificial Sequence
  Ebola virus siRNA sense strand
uguuuuagaugaagcaguuga

SEQ ID NO: 12622 - RNA, 21 nt, Artificial Sequence
  Ebola virus siRNA sense strand
guuuuagaugaagcaguugaa

SEQ ID NO: 12623 - RNA, 21 nt, Artificial Sequence
  Ebola virus siRNA sense strand
uuuuagaugaagcaguugaaa

SEQ ID NO: 12624 - RNA, 21 nt, Artificial Sequence
  Ebola virus siRNA sense strand
uuuagaugaagcaguugaaau

SEQ ID NO: 12625 - RNA, 21 nt, Artificial Sequence
  Ebola virus siRNA sense strand
uuagaugaagcaguugaaauu

SEQ ID NO: 12626 - RNA, 21 nt, Artificial Sequence
  Ebola virus siRNA sense strand
uagaugaagcaguugaaauuc

SEQ ID NO: 12627 - RNA, 21 nt, Artificial Sequence
  Ebola virus siRNA sense strand
agaugaagcaguugaaauucu

SEQ ID NO: 12628 - RNA, 21 nt, Artificial Sequence
  Ebola virus siRNA sense strand
gaugaagcaguugaaauucuu

SEQ ID NO: 12629 - RNA, 21 nt, Artificial Sequence
  Ebola virus siRNA sense strand
augaagcaguugaaauucuuc

SEQ ID NO: 12630 - RNA, 21 nt, Artificial Sequence
  Ebola virus siRNA sense strand
ugaagcaguugaaauucuucc

SEQ ID NO: 12631 - RNA, 21 nt, Artificial Sequence
  Ebola virus siRNA sense strand
gaagcaguugaaauucuuccu

SEQ ID NO: 12632 - RNA, 21 nt, Artificial Sequence
  Ebola virus siRNA sense strand
aagcaguugaaauucuuccuc

SEQ ID NO: 12633 - RNA, 21 nt, Artificial Sequence
  Ebola virus siRNA sense strand
agcaguugaaauucuuccucu

SEQ ID NO: 12634 - RNA, 21 nt, Artificial Sequence
  Ebola virus siRNA sense strand
gcaguugaaauucuuccucuu

SEQ ID NO: 12635 - RNA, 21 nt, Artificial Sequence
  Ebola virus siRNA sense strand
caguugaaauucuuccucuug

SEQ ID NO: 12636 - RNA, 21 nt, Artificial Sequence
  Ebola virus siRNA sense strand
aguugaaauucuuccucuuga

SEQ ID NO: 12637 - RNA, 21 nt, Artificial Sequence
  Ebola virus siRNA sense strand
guugaaauucuuccucuugau

SEQ ID NO: 12638 - RNA, 21 nt, Artificial Sequence
  Ebola virus siRNA sense strand
uugaaauucuuccucuugaua

SEQ ID NO: 12639 - RNA, 21 nt, Artificial Sequence
  Ebola virus siRNA sense strand
ugaaauucuuccucuugauau

SEQ ID NO: 12640 - RNA, 21 nt, Artificial Sequence
  Ebola virus siRNA sense strand
gaaauucuuccucuugauauu

SEQ ID NO: 12641 - RNA, 21 nt, Artificial Sequence
  Ebola virus siRNA sense strand
aaauucuuccucuugauauua

SEQ ID NO: 12642 - RNA, 21 nt, Artificial Sequence
  Ebola virus siRNA sense strand
aauucuuccucuugauauuaa

SEQ ID NO: 12643 - RNA, 21 nt, Artificial Sequence
  Ebola virus siRNA sense strand
auucuuccucuugauauuaaa

SEQ ID NO: 12644 - RNA, 21 nt, Artificial Sequence
  Ebola virus siRNA sense strand
uucuuccucuugauauuaaau

SEQ ID NO: 12645 - RNA, 21 nt, Artificial Sequence
  Ebola virus siRNA sense strand
ucuuccucuugauauuaaaug

SEQ ID NO: 12646 - RNA, 21 nt, Artificial Sequence
  Ebola virus siRNA sense strand
cuuccucuugauauuaaaugg

SEQ ID NO: 12647 - RNA, 21 nt, Artificial Sequence
  Ebola virus siRNA sense strand
uuccucuugauauuaaauggc

SEQ ID NO: 12648 - RNA, 21 nt, Artificial Sequence
  Ebola virus siRNA sense strand
uccucuugauauuaaauggcu

SEQ ID NO: 12649 - RNA, 21 nt, Artificial Sequence
  Ebola virus siRNA sense strand
ccucuugauauuaaauggcua

SEQ ID NO: 12650 - RNA, 21 nt, Artificial Sequence
  Ebola virus siRNA sense strand
cucuugauauuaaauggcuac

SEQ ID NO: 12651 - RNA, 21 nt, Artificial Sequence
  Ebola virus siRNA sense strand
ucuugauauuaaauggcuaca

SEQ ID NO: 12652 - RNA, 21 nt, Artificial Sequence
  Ebola virus siRNA sense strand
cuugauauuaaauggcuacac

SEQ ID NO: 12653 - RNA, 21 nt, Artificial Sequence
  Ebola virus siRNA sense strand
uugauauuaaauggcuacaca

SEQ ID NO: 12654 - RNA, 21 nt, Artificial Sequence
  Ebola virus siRNA sense strand
ugauauuaaauggcuacacaa

SEQ ID NO: 12655 - RNA, 21 nt, Artificial Sequence
  Ebola virus siRNA sense strand
gauauuaaauggcuacacaac

SEQ ID NO: 12656 - RNA, 21 nt, Artificial Sequence
  Ebola virus siRNA sense strand
auauuaaauggcuacacaaca

SEQ ID NO: 12657 - RNA, 21 nt, Artificial Sequence
  Ebola virus siRNA sense strand
uauuaaauggcuacacaacau

SEQ ID NO: 12658 - RNA, 21 nt, Artificial Sequence
  Ebola virus siRNA sense strand
auuaaauggcuacacaacaua

SEQ ID NO: 12659 - RNA, 21 nt, Artificial Sequence
  Ebola virus siRNA sense strand
uuaaauggcuacacaacauac

SEQ ID NO: 12660 - RNA, 21 nt, Artificial Sequence
  Ebola virus siRNA sense strand
uaaauggcuacacaacauacc

SEQ ID NO: 12661 - RNA, 21 nt, Artificial Sequence
  Ebola virus siRNA sense strand
aaauggcuacacaacauaccc

SEQ ID NO: 12662 - RNA, 21 nt, Artificial Sequence
  Ebola virus siRNA sense strand
aauggcuacacaacauaccca

SEQ ID NO: 12663 - RNA, 21 nt, Artificial Sequence
  Ebola virus siRNA sense strand
auggcuacacaacauacccaa

SEQ ID NO: 12664 - RNA, 21 nt, Artificial Sequence
  Ebola virus siRNA sense strand
uggcuacacaacauacccaau

SEQ ID NO: 12665 - RNA, 21 nt, Artificial Sequence
  Ebola virus siRNA sense strand
ggcuacacaacauacccaaua

SEQ ID NO: 12666 - RNA, 21 nt, Artificial Sequence
  Ebola virus siRNA sense strand
gcuacacaacauacccaauac

SEQ ID NO: 12667 - RNA, 21 nt, Artificial Sequence
  Ebola virus siRNA sense strand
cuacacaacauacccaauacc

SEQ ID NO: 12668 - RNA, 21 nt, Artificial Sequence
  Ebola virus siRNA sense strand
uacacaacauacccaauaccc

SEQ ID NO: 12669 - RNA, 21 nt, Artificial Sequence
  Ebola virus siRNA sense strand
acacaacauacccaauaccca

SEQ ID NO: 12670 - RNA, 21 nt, Artificial Sequence
  Ebola virus siRNA sense strand
cacaacauacccaauacccag

SEQ ID NO: 12671 - RNA, 21 nt, Artificial Sequence
  Ebola virus siRNA sense strand
acaacauacccaauacccaga

SEQ ID NO: 12672 - RNA, 21 nt, Artificial Sequence
  Ebola virus siRNA sense strand
caacauacccaauacccagac

SEQ ID NO: 12673 - RNA, 21 nt, Artificial Sequence
  Ebola virus siRNA sense strand
aacauacccaauacccagacg

SEQ ID NO: 12674 - RNA, 21 nt, Artificial Sequence
  Ebola virus siRNA sense strand
acauacccaauacccagacgc

SEQ ID NO: 12675 - RNA, 21 nt, Artificial Sequence
  Ebola virus siRNA sense strand
cauacccaauacccagacgcu

SEQ ID NO: 12676 - RNA, 21 nt, Artificial Sequence
  Ebola virus siRNA sense strand
auacccaauacccagacgcua

SEQ ID NO: 12677 - RNA, 21 nt, Artificial Sequence
  Ebola virus siRNA sense strand
uacccaauacccagacgcuag

SEQ ID NO: 12678 - RNA, 21 nt, Artificial Sequence
  Ebola virus siRNA sense strand
acccaauacccagacgcuagg

SEQ ID NO: 12679 - RNA, 21 nt, Artificial Sequence
  Ebola virus siRNA sense strand
cccaauacccagacgcuaggu

SEQ ID NO: 12680 - RNA, 21 nt, Artificial Sequence
  Ebola virus siRNA sense strand
ccaauacccagacgcuagguu

SEQ ID NO: 12681 - RNA, 21 nt, Artificial Sequence
  Ebola virus siRNA sense strand
caauacccagacgcuagguua

SEQ ID NO: 12682 - RNA, 21 nt, Artificial Sequence
  Ebola virus siRNA sense strand
aauacccagacgcuagguuau

SEQ ID NO: 12683 - RNA, 21 nt, Artificial Sequence
  Ebola virus siRNA sense strand
auacccagacgcuagguuauc

SEQ ID NO: 12684 - RNA, 21 nt, Artificial Sequence
  Ebola virus siRNA sense strand
uacccagacgcuagguuauca

SEQ ID NO: 12685 - RNA, 21 nt, Artificial Sequence
  Ebola virus siRNA sense strand
acccagacgcuagguuaucau

SEQ ID NO: 12686 - RNA, 21 nt, Artificial Sequence
  Ebola virus siRNA sense strand
cccagacgcuagguuaucauc

SEQ ID NO: 12687 - RNA, 21 nt, Artificial Sequence
  Ebola virus siRNA sense strand
ccagacgcuagguuaucauca

SEQ ID NO: 12688 - RNA, 21 nt, Artificial Sequence
  Ebola virus siRNA sense strand
cagacgcuagguuaucaucac

SEQ ID NO: 12689 - RNA, 21 nt, Artificial Sequence
  Ebola virus siRNA sense strand
agacgcuagguuaucaucacc

SEQ ID NO: 12690 - RNA, 21 nt, Artificial Sequence
  Ebola virus siRNA sense strand
gacgcuagguuaucaucacca

SEQ ID NO: 12691 - RNA, 21 nt, Artificial Sequence
  Ebola virus siRNA sense strand
acgcuagguuaucaucaccaa

SEQ ID NO: 12692 - RNA, 21 nt, Artificial Sequence
  Ebola virus siRNA sense strand
cgcuagguuaucaucaccaau

SEQ ID NO: 12693 - RNA, 21 nt, Artificial Sequence
  Ebola virus siRNA sense strand
gcuagguuaucaucaccaauu

SEQ ID NO: 12694 - RNA, 21 nt, Artificial Sequence
  Ebola virus siRNA sense strand
cuagguuaucaucaccaauug

SEQ ID NO: 12695 - RNA, 21 nt, Artificial Sequence
  Ebola virus siRNA sense strand
uagguuaucaucaccaauugu

SEQ ID NO: 12696 - RNA, 21 nt, Artificial Sequence
  Ebola virus siRNA sense strand
agguuaucaucaccaauugua

SEQ ID NO: 12697 - RNA, 21 nt, Artificial Sequence
  Ebola virus siRNA sense strand
gguuaucaucaccaauuguau

SEQ ID NO: 12698 - RNA, 21 nt, Artificial Sequence
  Ebola virus siRNA sense strand
guuaucaucaccaauuguauu

SEQ ID NO: 12699 - RNA, 21 nt, Artificial Sequence
  Ebola virus siRNA sense strand
uuaucaucaccaauuguauug

SEQ ID NO: 12700 - RNA, 21 nt, Artificial Sequence
  Ebola virus siRNA sense strand
uaucaucaccaauuguauugg

SEQ ID NO: 12701 - RNA, 21 nt, Artificial Sequence
  Ebola virus siRNA sense strand
aucaucaccaauuguauugga

SEQ ID NO: 12702 - RNA, 21 nt, Artificial Sequence
  Ebola virus siRNA sense strand
ucaucaccaauuguauuggac

SEQ ID NO: 12703 - RNA, 21 nt, Artificial Sequence
  Ebola virus siRNA sense strand
caucaccaauuguauuggacc

SEQ ID NO: 12704 - RNA, 21 nt, Artificial Sequence
  Ebola virus siRNA sense strand
aucaccaauuguauuggacca

SEQ ID NO: 12705 - RNA, 21 nt, Artificial Sequence
  Ebola virus siRNA sense strand
ucaccaauuguauuggaccaa

SEQ ID NO: 12706 - RNA, 21 nt, Artificial Sequence
  Ebola virus siRNA sense strand
caccaauuguauuggaccaau

SEQ ID NO: 12707 - RNA, 21 nt, Artificial Sequence
  Ebola virus siRNA sense strand
accaauuguauuggaccaaug

SEQ ID NO: 12708 - RNA, 21 nt, Artificial Sequence
  Ebola virus siRNA sense strand
ccaauuguauuggaccaaugu

SEQ ID NO: 12709 - RNA, 21 nt, Artificial Sequence
  Ebola virus siRNA sense strand
caauuguauuggaccaaugug

SEQ ID NO: 12710 - RNA, 21 nt, Artificial Sequence
  Ebola virus siRNA sense strand
aauuguauuggaccaauguga

SEQ ID NO: 12711 - RNA, 21 nt, Artificial Sequence
  Ebola virus siRNA sense strand
auuguauuggaccaaugugac

SEQ ID NO: 12712 - RNA, 21 nt, Artificial Sequence
  Ebola virus siRNA sense strand
uuguauuggaccaaugugacc

SEQ ID NO: 12713 - RNA, 21 nt, Artificial Sequence
  Ebola virus siRNA sense strand
uguauuggaccaaugugaccu

SEQ ID NO: 12714 - RNA, 21 nt, Artificial Sequence
  Ebola virus siRNA sense strand
guauuggaccaaugugaccua

SEQ ID NO: 12715 - RNA, 21 nt, Artificial Sequence
  Ebola virus siRNA sense strand
uauuggaccaaugugaccuag

SEQ ID NO: 12716 - RNA, 21 nt, Artificial Sequence
  Ebola virus siRNA sense strand
auuggaccaaugugaccuagu

SEQ ID NO: 12717 - RNA, 21 nt, Artificial Sequence
  Ebola virus siRNA sense strand
uuggaccaaugugaccuaguc

SEQ ID NO: 12718 - RNA, 21 nt, Artificial Sequence
  Ebola virus siRNA sense strand
uggaccaaugugaccuaguca

SEQ ID NO: 12719 - RNA, 21 nt, Artificial Sequence
  Ebola virus siRNA sense strand
ggaccaaugugaccuagucac

SEQ ID NO: 12720 - RNA, 21 nt, Artificial Sequence
  Ebola virus siRNA sense strand
gaccaaugugaccuagucacu

SEQ ID NO: 12721 - RNA, 21 nt, Artificial Sequence
  Ebola virus siRNA sense strand
accaaugugaccuagucacua

SEQ ID NO: 12722 - RNA, 21 nt, Artificial Sequence
  Ebola virus siRNA sense strand
ccaaugugaccuagucacuag

SEQ ID NO: 12723 - RNA, 21 nt, Artificial Sequence
  Ebola virus siRNA sense strand
caaugugaccuagucacuaga

SEQ ID NO: 12724 - RNA, 21 nt, Artificial Sequence
  Ebola virus siRNA sense strand
aaugugaccuagucacuagag

SEQ ID NO: 12725 - RNA, 21 nt, Artificial Sequence
  Ebola virus siRNA sense strand
augugaccuagucacuagagc

SEQ ID NO: 12726 - RNA, 21 nt, Artificial Sequence
  Ebola virus siRNA sense strand
ugugaccuagucacuagagcu

SEQ ID NO: 12727 - RNA, 21 nt, Artificial Sequence
  Ebola virus siRNA sense strand
gugaccuagucacuagagcuu

SEQ ID NO: 12728 - RNA, 21 nt, Artificial Sequence
  Ebola virus siRNA sense strand
ugaccuagucacuagagcuug

SEQ ID NO: 12729 - RNA, 21 nt, Artificial Sequence
  Ebola virus siRNA sense strand
gaccuagucacuagagcuugc

SEQ ID NO: 12730 - RNA, 21 nt, Artificial Sequence
  Ebola virus siRNA sense strand
accuagucacuagagcuugcg

SEQ ID NO: 12731 - RNA, 21 nt, Artificial Sequence
  Ebola virus siRNA sense strand
ccuagucacuagagcuugcgg

SEQ ID NO: 12732 - RNA, 21 nt, Artificial Sequence
  Ebola virus siRNA sense strand
cuagucacuagagcuugcggg

SEQ ID NO: 12733 - RNA, 21 nt, Artificial Sequence
  Ebola virus siRNA sense strand
uagucacuagagcuugcgggu

SEQ ID NO: 12734 - RNA, 21 nt, Artificial Sequence
  Ebola virus siRNA sense strand
agucacuagagcuugcggguu

SEQ ID NO: 12735 - RNA, 21 nt, Artificial Sequence
  Ebola virus siRNA sense strand
gucacuagagcuugcggguua

SEQ ID NO: 12736 - RNA, 21 nt, Artificial Sequence
  Ebola virus siRNA sense strand
ucacuagagcuugcggguuau

SEQ ID NO: 12737 - RNA, 21 nt, Artificial Sequence
  Ebola virus siRNA sense strand
cacuagagcuugcggguuaua

SEQ ID NO: 12738 - RNA, 21 nt, Artificial Sequence
  Ebola virus siRNA sense strand
acuagagcuugcggguuauau

SEQ ID NO: 12739 - RNA, 21 nt, Artificial Sequence
  Ebola virus siRNA sense strand
cuagagcuugcggguuauauu

SEQ ID NO: 12740 - RNA, 21 nt, Artificial Sequence
  Ebola virus siRNA sense strand
uagagcuugcggguuauauuc

SEQ ID NO: 12741 - RNA, 21 nt, Artificial Sequence
  Ebola virus siRNA sense strand
agagcuugcggguuauauuca

SEQ ID NO: 12742 - RNA, 21 nt, Artificial Sequence
  Ebola virus siRNA sense strand
gagcuugcggguuauauucau

SEQ ID NO: 12743 - RNA, 21 nt, Artificial Sequence
  Ebola virus siRNA sense strand
agcuugcggguuauauucauc

SEQ ID NO: 12744 - RNA, 21 nt, Artificial Sequence
  Ebola virus siRNA sense strand
gcuugcggguuauauucauca

SEQ ID NO: 12745 - RNA, 21 nt, Artificial Sequence
  Ebola virus siRNA sense strand
cuugcggguuauauucaucau

SEQ ID NO: 12746 - RNA, 21 nt, Artificial Sequence
  Ebola virus siRNA sense strand
uugcggguuauauucaucaua

SEQ ID NO: 12747 - RNA, 21 nt, Artificial Sequence
  Ebola virus siRNA sense strand
ugcggguuauauucaucauac

SEQ ID NO: 12748 - RNA, 21 nt, Artificial Sequence
  Ebola virus siRNA sense strand
gcggguuauauucaucauacu

SEQ ID NO: 12749 - RNA, 21 nt, Artificial Sequence
  Ebola virus siRNA sense strand
cggguuauauucaucauacuc

SEQ ID NO: 12750 - RNA, 21 nt, Artificial Sequence
  Ebola virus siRNA sense strand
ggguuauauucaucauacucc

SEQ ID NO: 12751 - RNA, 21 nt, Artificial Sequence
  Ebola virus siRNA sense strand
gguuauauucaucauacuccc

SEQ ID NO: 12752 - RNA, 21 nt, Artificial Sequence
  Ebola virus siRNA sense strand
guuauauucaucauacucccu

SEQ ID NO: 12753 - RNA, 21 nt, Artificial Sequence
  Ebola virus siRNA sense strand
uuauauucaucauacucccuu

SEQ ID NO: 12754 - RNA, 21 nt, Artificial Sequence
  Ebola virus siRNA sense strand
uauauucaucauacucccuua

SEQ ID NO: 12755 - RNA, 21 nt, Artificial Sequence
  Ebola virus siRNA sense strand
auauucaucauacucccuuaa

SEQ ID NO: 12756 - RNA, 21 nt, Artificial Sequence
  Ebola virus siRNA sense strand
uauucaucauacucccuuaau

SEQ ID NO: 12757 - RNA, 21 nt, Artificial Sequence
  Ebola virus siRNA sense strand
auucaucauacucccuuaauc

SEQ ID NO: 12758 - RNA, 21 nt, Artificial Sequence
  Ebola virus siRNA sense strand
uucaucauacucccuuaaucc

SEQ ID NO: 12759 - RNA, 21 nt, Artificial Sequence
  Ebola virus siRNA sense strand
ucaucauacucccuuaauccg

SEQ ID NO: 12760 - RNA, 21 nt, Artificial Sequence
  Ebola virus siRNA sense strand
caucauacucccuuaauccgc

SEQ ID NO: 12761 - RNA, 21 nt, Artificial Sequence
  Ebola virus siRNA sense strand
aucauacucccuuaauccgca

SEQ ID NO: 12762 - RNA, 21 nt, Artificial Sequence
  Ebola virus siRNA sense strand
ucauacucccuuaauccgcaa

SEQ ID NO: 12763 - RNA, 21 nt, Artificial Sequence
  Ebola virus siRNA sense strand
cauacucccuuaauccgcaac

SEQ ID NO: 12764 - RNA, 21 nt, Artificial Sequence
  Ebola virus siRNA sense strand
auacucccuuaauccgcaacu

SEQ ID NO: 12765 - RNA, 21 nt, Artificial Sequence
  Ebola virus siRNA sense strand
uacucccuuaauccgcaacua

SEQ ID NO: 12766 - RNA, 21 nt, Artificial Sequence
  Ebola virus siRNA sense strand
acucccuuaauccgcaacuac

SEQ ID NO: 12767 - RNA, 21 nt, Artificial Sequence
  Ebola virus siRNA sense strand
cucccuuaauccgcaacuacg

SEQ ID NO: 12768 - RNA, 21 nt, Artificial Sequence
  Ebola virus siRNA sense strand
ucccuuaauccgcaacuacgc

SEQ ID NO: 12769 - RNA, 21 nt, Artificial Sequence
  Ebola virus siRNA sense strand
cccuuaauccgcaacuacgca

SEQ ID NO: 12770 - RNA, 21 nt, Artificial Sequence
  Ebola virus siRNA sense strand
ccuuaauccgcaacuacgcaa

SEQ ID NO: 12771 - RNA, 21 nt, Artificial Sequence
  Ebola virus siRNA sense strand
cuuaauccgcaacuacgcaac

SEQ ID NO: 12772 - RNA, 21 nt, Artificial Sequence
  Ebola virus siRNA sense strand
uuaauccgcaacuacgcaacu

SEQ ID NO: 12773 - RNA, 21 nt, Artificial Sequence
  Ebola virus siRNA sense strand
uaauccgcaacuacgcaacug

SEQ ID NO: 12774 - RNA, 21 nt, Artificial Sequence
  Ebola virus siRNA sense strand
aauccgcaacuacgcaacugu

SEQ ID NO: 12775 - RNA, 21 nt, Artificial Sequence
  Ebola virus siRNA sense strand
auccgcaacuacgcaacugua

SEQ ID NO: 12776 - RNA, 21 nt, Artificial Sequence
  Ebola virus siRNA sense strand
uccgcaacuacgcaacuguaa

SEQ ID NO: 12777 - RNA, 21 nt, Artificial Sequence
  Ebola virus siRNA sense strand
ccgcaacuacgcaacuguaaa

SEQ ID NO: 12778 - RNA, 21 nt, Artificial Sequence
  Ebola virus siRNA sense strand
cgcaacuacgcaacuguaaac

SEQ ID NO: 12779 - RNA, 21 nt, Artificial Sequence
  Ebola virus siRNA sense strand
gcaacuacgcaacuguaaacu

SEQ ID NO: 12780 - RNA, 21 nt, Artificial Sequence
  Ebola virus siRNA sense strand
caacuacgcaacuguaaacuc

SEQ ID NO: 12781 - RNA, 21 nt, Artificial Sequence
  Ebola virus siRNA sense strand
aacuacgcaacuguaaacucc

SEQ ID NO: 12782 - RNA, 21 nt, Artificial Sequence
  Ebola virus siRNA sense strand
acuacgcaacuguaaacuccc

SEQ ID NO: 12783 - RNA, 21 nt, Artificial Sequence
  Ebola virus siRNA sense strand
cuacgcaacuguaaacucccg

SEQ ID NO: 12784 - RNA, 21 nt, Artificial Sequence
  Ebola virus siRNA sense strand
uacgcaacuguaaacucccga

SEQ ID NO: 12785 - RNA, 21 nt, Artificial Sequence
  Ebola virus siRNA sense strand
acgcaacuguaaacucccgaa

SEQ ID NO: 12786 - RNA, 21 nt, Artificial Sequence
  Ebola virus siRNA sense strand
cgcaacuguaaacucccgaaa

SEQ ID NO: 12787 - RNA, 21 nt, Artificial Sequence
  Ebola virus siRNA sense strand
gcaacuguaaacucccgaaac

SEQ ID NO: 12788 - RNA, 21 nt, Artificial Sequence
  Ebola virus siRNA sense strand
caacuguaaacucccgaaaca

SEQ ID NO: 12789 - RNA, 21 nt, Artificial Sequence
  Ebola virus siRNA sense strand
aacuguaaacucccgaaacau

SEQ ID NO: 12790 - RNA, 21 nt, Artificial Sequence
  Ebola virus siRNA sense strand
acuguaaacucccgaaacaua

SEQ ID NO: 12791 - RNA, 21 nt, Artificial Sequence
  Ebola virus siRNA sense strand
cuguaaacucccgaaacauau

SEQ ID NO: 12792 - RNA, 21 nt, Artificial Sequence
  Ebola virus siRNA sense strand
uguaaacucccgaaacauauc

SEQ ID NO: 12793 - RNA, 21 nt, Artificial Sequence
  Ebola virus siRNA sense strand
guaaacucccgaaacauaucu

SEQ ID NO: 12794 - RNA, 21 nt, Artificial Sequence
  Ebola virus siRNA sense strand
uaaacucccgaaacauaucua

SEQ ID NO: 12795 - RNA, 21 nt, Artificial Sequence
  Ebola virus siRNA sense strand
aaacucccgaaacauaucuac

SEQ ID NO: 12796 - RNA, 21 nt, Artificial Sequence
  Ebola virus siRNA sense strand
aacucccgaaacauaucuacc

SEQ ID NO: 12797 - RNA, 21 nt, Artificial Sequence
  Ebola virus siRNA sense strand
acucccgaaacauaucuaccg

SEQ ID NO: 12798 - RNA, 21 nt, Artificial Sequence
  Ebola virus siRNA sense strand
cucccgaaacauaucuaccgu

SEQ ID NO: 12799 - RNA, 21 nt, Artificial Sequence
  Ebola virus siRNA sense strand
ucccgaaacauaucuaccguu

SEQ ID NO: 12800 - RNA, 21 nt, Artificial Sequence
  Ebola virus siRNA sense strand
cccgaaacauaucuaccguuu

SEQ ID NO: 12801 - RNA, 21 nt, Artificial Sequence
  Ebola virus siRNA sense strand
ccgaaacauaucuaccguuug

SEQ ID NO: 12802 - RNA, 21 nt, Artificial Sequence
  Ebola virus siRNA sense strand
cgaaacauaucuaccguuuga

SEQ ID NO: 12803 - RNA, 21 nt, Artificial Sequence
  Ebola virus siRNA sense strand
gaaacauaucuaccguuugaa

SEQ ID NO: 12804 - RNA, 21 nt, Artificial Sequence
  Ebola virus siRNA sense strand
aaacauaucuaccguuugaaa

SEQ ID NO: 12805 - RNA, 21 nt, Artificial Sequence
  Ebola virus siRNA sense strand
aacauaucuaccguuugaaau

SEQ ID NO: 12806 - RNA, 21 nt, Artificial Sequence
  Ebola virus siRNA sense strand
acauaucuaccguuugaaaua

SEQ ID NO: 12807 - RNA, 21 nt, Artificial Sequence
  Ebola virus siRNA sense strand
cauaucuaccguuugaaauac

SEQ ID NO: 12808 - RNA, 21 nt, Artificial Sequence
  Ebola virus siRNA sense strand
auaucuaccguuugaaauacg

SEQ ID NO: 12809 - RNA, 21 nt, Artificial Sequence
  Ebola virus siRNA sense strand
uaucuaccguuugaaauacga

SEQ ID NO: 12810 - RNA, 21 nt, Artificial Sequence
  Ebola virus siRNA sense strand
aucuaccguuugaaauacgau

SEQ ID NO: 12811 - RNA, 21 nt, Artificial Sequence
  Ebola virus siRNA sense strand
ucuaccguuugaaauacgaug

SEQ ID NO: 12812 - RNA, 21 nt, Artificial Sequence
  Ebola virus siRNA sense strand
cuaccguuugaaauacgaugu

SEQ ID NO: 12813 - RNA, 21 nt, Artificial Sequence
  Ebola virus siRNA sense strand
uaccguuugaaauacgaugua

SEQ ID NO: 12814 - RNA, 21 nt, Artificial Sequence
  Ebola virus siRNA sense strand
accguuugaaauacgauguaa

SEQ ID NO: 12815 - RNA, 21 nt, Artificial Sequence
  Ebola virus siRNA sense strand
ccguuugaaauacgauguaac

SEQ ID NO: 12816 - RNA, 21 nt, Artificial Sequence
  Ebola virus siRNA sense strand
cguuugaaauacgauguaacu

SEQ ID NO: 12817 - RNA, 21 nt, Artificial Sequence
  Ebola virus siRNA sense strand
guuugaaauacgauguaacug

SEQ ID NO: 12818 - RNA, 21 nt, Artificial Sequence
  Ebola virus siRNA sense strand
uuugaaauacgauguaacugu

SEQ ID NO: 12819 - RNA, 21 nt, Artificial Sequence
  Ebola virus siRNA sense strand
uugaaauacgauguaacuguu

SEQ ID NO: 12820 - RNA, 21 nt, Artificial Sequence
  Ebola virus siRNA sense strand
ugaaauacgauguaacuguua

SEQ ID NO: 12821 - RNA, 21 nt, Artificial Sequence
  Ebola virus siRNA sense strand
gaaauacgauguaacuguuac

SEQ ID NO: 12822 - RNA, 21 nt, Artificial Sequence
  Ebola virus siRNA sense strand
aaauacgauguaacuguuacc

SEQ ID NO: 12823 - RNA, 21 nt, Artificial Sequence
  Ebola virus siRNA sense strand
aauacgauguaacuguuacca

SEQ ID NO: 12824 - RNA, 21 nt, Artificial Sequence
  Ebola virus siRNA sense strand
auacgauguaacuguuaccaa

SEQ ID NO: 12825 - RNA, 21 nt, Artificial Sequence
  Ebola virus siRNA sense strand
uacgauguaacuguuaccaag

SEQ ID NO: 12826 - RNA, 21 nt, Artificial Sequence
  Ebola virus siRNA sense strand
acgauguaacuguuaccaagu

SEQ ID NO: 12827 - RNA, 21 nt, Artificial Sequence
  Ebola virus siRNA sense strand
cgauguaacuguuaccaaguu

SEQ ID NO: 12828 - RNA, 21 nt, Artificial Sequence
  Ebola virus siRNA sense strand
gauguaacuguuaccaaguuc

SEQ ID NO: 12829 - RNA, 21 nt, Artificial Sequence
  Ebola virus siRNA sense strand
auguaacuguuaccaaguucu

SEQ ID NO: 12830 - RNA, 21 nt, Artificial Sequence
  Ebola virus siRNA sense strand
uguaacuguuaccaaguucuu

SEQ ID NO: 12831 - RNA, 21 nt, Artificial Sequence
  Ebola virus siRNA sense strand
guaacuguuaccaaguucuug

SEQ ID NO: 12832 - RNA, 21 nt, Artificial Sequence
  Ebola virus siRNA sense strand
uaacuguuaccaaguucuuga

SEQ ID NO: 12833 - RNA, 21 nt, Artificial Sequence
  Ebola virus siRNA sense strand
aacuguuaccaaguucuugag

SEQ ID NO: 12834 - RNA, 21 nt, Artificial Sequence
  Ebola virus siRNA sense strand
acuguuaccaaguucuugagu

SEQ ID NO: 12835 - RNA, 21 nt, Artificial Sequence
  Ebola virus siRNA sense strand
cuguuaccaaguucuugagug

SEQ ID NO: 12836 - RNA, 21 nt, Artificial Sequence
  Ebola virus siRNA sense strand
uguuaccaaguucuugaguga

SEQ ID NO: 12837 - RNA, 21 nt, Artificial Sequence
  Ebola virus siRNA sense strand
guuaccaaguucuugagugau

SEQ ID NO: 12838 - RNA, 21 nt, Artificial Sequence
  Ebola virus siRNA sense strand
uuaccaaguucuugagugaug

SEQ ID NO: 12839 - RNA, 21 nt, Artificial Sequence
  Ebola virus siRNA sense strand
uaccaaguucuugagugaugu

SEQ ID NO: 12840 - RNA, 21 nt, Artificial Sequence
  Ebola virus siRNA sense strand
accaaguucuugagugaugua

SEQ ID NO: 12841 - RNA, 21 nt, Artificial Sequence
  Ebola virus siRNA sense strand
ccaaguucuugagugauguac

SEQ ID NO: 12842 - RNA, 21 nt, Artificial Sequence
  Ebola virus siRNA sense strand
caaguucuugagugauguacc

SEQ ID NO: 12843 - RNA, 21 nt, Artificial Sequence
  Ebola virus siRNA sense strand
aaguucuugagugauguacca

SEQ ID NO: 12844 - RNA, 21 nt, Artificial Sequence
  Ebola virus siRNA sense strand
aguucuugagugauguaccag

SEQ ID NO: 12845 - RNA, 21 nt, Artificial Sequence
  Ebola virus siRNA sense strand
guucuugagugauguaccagu

SEQ ID NO: 12846 - RNA, 21 nt, Artificial Sequence
  Ebola virus siRNA sense strand
uucuugagugauguaccagug

SEQ ID NO: 12847 - RNA, 21 nt, Artificial Sequence
  Ebola virus siRNA sense strand
ucuugagugauguaccagugg

SEQ ID NO: 12848 - RNA, 21 nt, Artificial Sequence
  Ebola virus siRNA sense strand
cuugagugauguaccaguggc

SEQ ID NO: 12849 - RNA, 21 nt, Artificial Sequence
  Ebola virus siRNA sense strand
uugagugauguaccaguggcg

SEQ ID NO: 12850 - RNA, 21 nt, Artificial Sequence
  Ebola virus siRNA sense strand
ugagugauguaccaguggcga

SEQ ID NO: 12851 - RNA, 21 nt, Artificial Sequence
  Ebola virus siRNA sense strand
gagugauguaccaguggcgac

SEQ ID NO: 12852 - RNA, 21 nt, Artificial Sequence
  Ebola virus siRNA sense strand
agugauguaccaguggcgaca

SEQ ID NO: 12853 - RNA, 21 nt, Artificial Sequence
  Ebola virus siRNA sense strand
gugauguaccaguggcgacau

SEQ ID NO: 12854 - RNA, 21 nt, Artificial Sequence
  Ebola virus siRNA sense strand
ugauguaccaguggcgacauu

SEQ ID NO: 12855 - RNA, 21 nt, Artificial Sequence
  Ebola virus siRNA sense strand
gauguaccaguggcgacauug

SEQ ID NO: 12856 - RNA, 21 nt, Artificial Sequence
  Ebola virus siRNA sense strand
auguaccaguggcgacauugc

SEQ ID NO: 12857 - RNA, 21 nt, Artificial Sequence
  Ebola virus siRNA sense strand
uguaccaguggcgacauugcc

SEQ ID NO: 12858 - RNA, 21 nt, Artificial Sequence
  Ebola virus siRNA sense strand
guaccaguggcgacauugccc

SEQ ID NO: 12859 - RNA, 21 nt, Artificial Sequence
  Ebola virus siRNA sense strand
uaccaguggcgacauugccca

SEQ ID NO: 12860 - RNA, 21 nt, Artificial Sequence
  Ebola virus siRNA sense strand
accaguggcgacauugcccau

SEQ ID NO: 12861 - RNA, 21 nt, Artificial Sequence
  Ebola virus siRNA sense strand
ccaguggcgacauugcccaua

SEQ ID NO: 12862 - RNA, 21 nt, Artificial Sequence
  Ebola virus siRNA sense strand
caguggcgacauugcccauag

SEQ ID NO: 12863 - RNA, 21 nt, Artificial Sequence
  Ebola virus siRNA sense strand
aguggcgacauugcccauaga

SEQ ID NO: 12864 - RNA, 21 nt, Artificial Sequence
  Ebola virus siRNA sense strand
guggcgacauugcccauagau

SEQ ID NO: 12865 - RNA, 21 nt, Artificial Sequence
  Ebola virus siRNA sense strand
uggcgacauugcccauagauu

SEQ ID NO: 12866 - RNA, 21 nt, Artificial Sequence
  Ebola virus siRNA sense strand
ggcgacauugcccauagauuu

SEQ ID NO: 12867 - RNA, 21 nt, Artificial Sequence
  Ebola virus siRNA sense strand
gcgacauugcccauagauuuc

SEQ ID NO: 12868 - RNA, 21 nt, Artificial Sequence
  Ebola virus siRNA sense strand
cgacauugcccauagauuuca

SEQ ID NO: 12869 - RNA, 21 nt, Artificial Sequence
  Ebola virus siRNA sense strand
gacauugcccauagauuucau

SEQ ID NO: 12870 - RNA, 21 nt, Artificial Sequence
  Ebola virus siRNA sense strand
acauugcccauagauuucaua

SEQ ID NO: 12871 - RNA, 21 nt, Artificial Sequence
  Ebola virus siRNA sense strand
cauugcccauagauuucauag

SEQ ID NO: 12872 - RNA, 21 nt, Artificial Sequence
  Ebola virus siRNA sense strand
auugcccauagauuucauagu

SEQ ID NO: 12873 - RNA, 21 nt, Artificial Sequence
  Ebola virus siRNA sense strand
uugcccauagauuucauaguc

SEQ ID NO: 12874 - RNA, 21 nt, Artificial Sequence
  Ebola virus siRNA sense strand
ugcccauagauuucauagucc

SEQ ID NO: 12875 - RNA, 21 nt, Artificial Sequence
  Ebola virus siRNA sense strand
gcccauagauuucauaguccc

SEQ ID NO: 12876 - RNA, 21 nt, Artificial Sequence
  Ebola virus siRNA sense strand
cccauagauuucauaguccca

SEQ ID NO: 12877 - RNA, 21 nt, Artificial Sequence
  Ebola virus siRNA sense strand
ccauagauuucauagucccag

SEQ ID NO: 12878 - RNA, 21 nt, Artificial Sequence
  Ebola virus siRNA sense strand
cauagauuucauagucccagu

SEQ ID NO: 12879 - RNA, 21 nt, Artificial Sequence
  Ebola virus siRNA sense strand
auagauuucauagucccaguu

SEQ ID NO: 12880 - RNA, 21 nt, Artificial Sequence
  Ebola virus siRNA sense strand
uagauuucauagucccaguuc

SEQ ID NO: 12881 - RNA, 21 nt, Artificial Sequence
  Ebola virus siRNA sense strand
agauuucauagucccaguucu

SEQ ID NO: 12882 - RNA, 21 nt, Artificial Sequence
  Ebola virus siRNA sense strand
gauuucauagucccaguucuu

SEQ ID NO: 12883 - RNA, 21 nt, Artificial Sequence
  Ebola virus siRNA sense strand
auuucauagucccaguucuuc

SEQ ID NO: 12884 - RNA, 21 nt, Artificial Sequence
  Ebola virus siRNA sense strand
uuucauagucccaguucuucu

SEQ ID NO: 12885 - RNA, 21 nt, Artificial Sequence
  Ebola virus siRNA sense strand
uucauagucccaguucuucuc

SEQ ID NO: 12886 - RNA, 21 nt, Artificial Sequence
  Ebola virus siRNA sense strand
ucauagucccaguucuucuca

SEQ ID NO: 12887 - RNA, 21 nt, Artificial Sequence
  Ebola virus siRNA sense strand
cauagucccaguucuucucaa

SEQ ID NO: 12888 - RNA, 21 nt, Artificial Sequence
  Ebola virus siRNA sense strand
auagucccaguucuucucaag

SEQ ID NO: 12889 - RNA, 21 nt, Artificial Sequence
  Ebola virus siRNA sense strand
uagucccaguucuucucaagg

SEQ ID NO: 12890 - RNA, 21 nt, Artificial Sequence
  Ebola virus siRNA sense strand
agucccaguucuucucaaggc

SEQ ID NO: 12891 - RNA, 21 nt, Artificial Sequence
  Ebola virus siRNA sense strand
gucccaguucuucucaaggca

SEQ ID NO: 12892 - RNA, 21 nt, Artificial Sequence
  Ebola virus siRNA sense strand
ucccaguucuucucaaggcac

SEQ ID NO: 12893 - RNA, 21 nt, Artificial Sequence
  Ebola virus siRNA sense strand
cccaguucuucucaaggcacu

SEQ ID NO: 12894 - RNA, 21 nt, Artificial Sequence
  Ebola virus siRNA sense strand
ccaguucuucucaaggcacug

SEQ ID NO: 12895 - RNA, 21 nt, Artificial Sequence
  Ebola virus siRNA sense strand
caguucuucucaaggcacugu

SEQ ID NO: 12896 - RNA, 21 nt, Artificial Sequence
  Ebola virus siRNA sense strand
aguucuucucaaggcacuguc

SEQ ID NO: 12897 - RNA, 21 nt, Artificial Sequence
  Ebola virus siRNA sense strand
guucuucucaaggcacuguca

SEQ ID NO: 12898 - RNA, 21 nt, Artificial Sequence
  Ebola virus siRNA sense strand
uucuucucaaggcacugucag

SEQ ID NO: 12899 - RNA, 21 nt, Artificial Sequence
  Ebola virus siRNA sense strand
ucuucucaaggcacugucagg

SEQ ID NO: 12900 - RNA, 21 nt, Artificial Sequence
  Ebola virus siRNA sense strand
cuucucaaggcacugucaggc

SEQ ID NO: 12901 - RNA, 21 nt, Artificial Sequence
  Ebola virus siRNA sense strand
uucucaaggcacugucaggca

SEQ ID NO: 12902 - RNA, 21 nt, Artificial Sequence
  Ebola virus siRNA sense strand
ucucaaggcacugucaggcaa

SEQ ID NO: 12903 - RNA, 21 nt, Artificial Sequence
  Ebola virus siRNA sense strand
cucaaggcacugucaggcaau

SEQ ID NO: 12904 - RNA, 21 nt, Artificial Sequence
  Ebola virus siRNA sense strand
ucaaggcacugucaggcaaug

SEQ ID NO: 12905 - RNA, 21 nt, Artificial Sequence
  Ebola virus siRNA sense strand
caaggcacugucaggcaaugg

SEQ ID NO: 12906 - RNA, 21 nt, Artificial Sequence
  Ebola virus siRNA sense strand
aaggcacugucaggcaaugga

SEQ ID NO: 12907 - RNA, 21 nt, Artificial Sequence
  Ebola virus siRNA sense strand
aggcacugucaggcaauggau

SEQ ID NO: 12908 - RNA, 21 nt, Artificial Sequence
  Ebola virus siRNA sense strand
ggcacugucaggcaauggauu

SEQ ID NO: 12909 - RNA, 21 nt, Artificial Sequence
  Ebola virus siRNA sense strand
gcacugucaggcaauggauuc

SEQ ID NO: 12910 - RNA, 21 nt, Artificial Sequence
  Ebola virus siRNA sense strand
cacugucaggcaauggauucu

SEQ ID NO: 12911 - RNA, 21 nt, Artificial Sequence
  Ebola virus siRNA sense strand
acugucaggcaauggauucug

SEQ ID NO: 12912 - RNA, 21 nt, Artificial Sequence
  Ebola virus siRNA sense strand
cugucaggcaauggauucugu

SEQ ID NO: 12913 - RNA, 21 nt, Artificial Sequence
  Ebola virus siRNA sense strand
ugucaggcaauggauucuguc

SEQ ID NO: 12914 - RNA, 21 nt, Artificial Sequence
  Ebola virus siRNA sense strand
gucaggcaauggauucugucc

SEQ ID NO: 12915 - RNA, 21 nt, Artificial Sequence
  Ebola virus siRNA sense strand
ucaggcaauggauucuguccu

SEQ ID NO: 12916 - RNA, 21 nt, Artificial Sequence
  Ebola virus siRNA sense strand
caggcaauggauucuguccug

SEQ ID NO: 12917 - RNA, 21 nt, Artificial Sequence
  Ebola virus siRNA sense strand
aggcaauggauucuguccugu

SEQ ID NO: 12918 - RNA, 21 nt, Artificial Sequence
  Ebola virus siRNA sense strand
ggcaauggauucuguccuguu

SEQ ID NO: 12919 - RNA, 21 nt, Artificial Sequence
  Ebola virus siRNA sense strand
gcaauggauucuguccuguug

SEQ ID NO: 12920 - RNA, 21 nt, Artificial Sequence
  Ebola virus siRNA sense strand
caauggauucuguccuguuga

SEQ ID NO: 12921 - RNA, 21 nt, Artificial Sequence
  Ebola virus siRNA sense strand
aauggauucuguccuguugag

SEQ ID NO: 12922 - RNA, 21 nt, Artificial Sequence
  Ebola virus siRNA sense strand
auggauucuguccuguugagc

SEQ ID NO: 12923 - RNA, 21 nt, Artificial Sequence
  Ebola virus siRNA sense strand
uggauucuguccuguugagcc

SEQ ID NO: 12924 - RNA, 21 nt, Artificial Sequence
  Ebola virus siRNA sense strand
ggauucuguccuguugagccg

SEQ ID NO: 12925 - RNA, 21 nt, Artificial Sequence
  Ebola virus siRNA sense strand
gauucuguccuguugagccgc

SEQ ID NO: 12926 - RNA, 21 nt, Artificial Sequence
  Ebola virus siRNA sense strand
auucuguccuguugagccgcg

SEQ ID NO: 12927 - RNA, 21 nt, Artificial Sequence
  Ebola virus siRNA sense strand
uucuguccuguugagccgcgg

SEQ ID NO: 12928 - RNA, 21 nt, Artificial Sequence
  Ebola virus siRNA sense strand
ucuguccuguugagccgcggu

SEQ ID NO: 12929 - RNA, 21 nt, Artificial Sequence
  Ebola virus siRNA sense strand
cuguccuguugagccgcggug

SEQ ID NO: 12930 - RNA, 21 nt, Artificial Sequence
  Ebola virus siRNA sense strand
uguccuguugagccgcggugc

SEQ ID NO: 12931 - RNA, 21 nt, Artificial Sequence
  Ebola virus siRNA sense strand
guccuguugagccgcggugcc

SEQ ID NO: 12932 - RNA, 21 nt, Artificial Sequence
  Ebola virus siRNA sense strand
uccuguugagccgcggugcca

SEQ ID NO: 12933 - RNA, 21 nt, Artificial Sequence
  Ebola virus siRNA sense strand
ccuguugagccgcggugccaa

SEQ ID NO: 12934 - RNA, 21 nt, Artificial Sequence
  Ebola virus siRNA sense strand
cuguugagccgcggugccaac

SEQ ID NO: 12935 - RNA, 21 nt, Artificial Sequence
  Ebola virus siRNA sense strand
uguugagccgcggugccaaca

SEQ ID NO: 12936 - RNA, 21 nt, Artificial Sequence
  Ebola virus siRNA sense strand
guugagccgcggugccaacag

SEQ ID NO: 12937 - RNA, 21 nt, Artificial Sequence
  Ebola virus siRNA sense strand
uugagccgcggugccaacagu

SEQ ID NO: 12938 - RNA, 21 nt, Artificial Sequence
  Ebola virus siRNA sense strand
ugagccgcggugccaacaguu

SEQ ID NO: 12939 - RNA, 21 nt, Artificial Sequence
  Ebola virus siRNA sense strand
gagccgcggugccaacaguuc

SEQ ID NO: 12940 - RNA, 21 nt, Artificial Sequence
  Ebola virus siRNA sense strand
agccgcggugccaacaguucu

SEQ ID NO: 12941 - RNA, 21 nt, Artificial Sequence
  Ebola virus siRNA sense strand
gccgcggugccaacaguucuu

SEQ ID NO: 12942 - RNA, 21 nt, Artificial Sequence
  Ebola virus siRNA sense strand
ccgcggugccaacaguucuua

SEQ ID NO: 12943 - RNA, 21 nt, Artificial Sequence
  Ebola virus siRNA sense strand
cgcggugccaacaguucuuag

SEQ ID NO: 12944 - RNA, 21 nt, Artificial Sequence
  Ebola virus siRNA sense strand
gcggugccaacaguucuuaga

SEQ ID NO: 12945 - RNA, 21 nt, Artificial Sequence
  Ebola virus siRNA sense strand
cggugccaacaguucuuagau

SEQ ID NO: 12946 - RNA, 21 nt, Artificial Sequence
  Ebola virus siRNA sense strand
ggugccaacaguucuuagaug

SEQ ID NO: 12947 - RNA, 21 nt, Artificial Sequence
  Ebola virus siRNA sense strand
gugccaacaguucuuagauga

SEQ ID NO: 12948 - RNA, 21 nt, Artificial Sequence
  Ebola virus siRNA sense strand
ugccaacaguucuuagaugaa

SEQ ID NO: 12949 - RNA, 21 nt, Artificial Sequence
  Ebola virus siRNA sense strand
gccaacaguucuuagaugaaa

SEQ ID NO: 12950 - RNA, 21 nt, Artificial Sequence
  Ebola virus siRNA sense strand
ccaacaguucuuagaugaaau

SEQ ID NO: 12951 - RNA, 21 nt, Artificial Sequence
  Ebola virus siRNA sense strand
caacaguucuuagaugaaauc

SEQ ID NO: 12952 - RNA, 21 nt, Artificial Sequence
  Ebola virus siRNA sense strand
aacaguucuuagaugaaauca

SEQ ID NO: 12953 - RNA, 21 nt, Artificial Sequence
  Ebola virus siRNA sense strand
acaguucuuagaugaaaucau

SEQ ID NO: 12954 - RNA, 21 nt, Artificial Sequence
  Ebola virus siRNA sense strand
caguucuuagaugaaaucauu

SEQ ID NO: 12955 - RNA, 21 nt, Artificial Sequence
  Ebola virus siRNA sense strand
aguucuuagaugaaaucauua

SEQ ID NO: 12956 - RNA, 21 nt, Artificial Sequence
  Ebola virus siRNA sense strand
guucuuagaugaaaucauuaa

SEQ ID NO: 12957 - RNA, 21 nt, Artificial Sequence
  Ebola virus siRNA sense strand
uucuuagaugaaaucauuaag

SEQ ID NO: 12958 - RNA, 21 nt, Artificial Sequence
  Ebola virus siRNA sense strand
ucuuagaugaaaucauuaagu

SEQ ID NO: 12959 - RNA, 21 nt, Artificial Sequence
  Ebola virus siRNA sense strand
cuuagaugaaaucauuaagua

SEQ ID NO: 12960 - RNA, 21 nt, Artificial Sequence
  Ebola virus siRNA sense strand
uuagaugaaaucauuaaguac

SEQ ID NO: 12961 - RNA, 21 nt, Artificial Sequence
  Ebola virus siRNA sense strand
uagaugaaaucauuaaguaca

SEQ ID NO: 12962 - RNA, 21 nt, Artificial Sequence
  Ebola virus siRNA sense strand
agaugaaaucauuaaguacac

SEQ ID NO: 12963 - RNA, 21 nt, Artificial Sequence
  Ebola virus siRNA sense strand
gaugaaaucauuaaguacaca

SEQ ID NO: 12964 - RNA, 21 nt, Artificial Sequence
  Ebola virus siRNA sense strand
augaaaucauuaaguacacaa

SEQ ID NO: 12965 - RNA, 21 nt, Artificial Sequence
  Ebola virus siRNA sense strand
ugaaaucauuaaguacacaau

SEQ ID NO: 12966 - RNA, 21 nt, Artificial Sequence
  Ebola virus siRNA sense strand
gaaaucauuaaguacacaaug

SEQ ID NO: 12967 - RNA, 21 nt, Artificial Sequence
  Ebola virus siRNA sense strand
aaaucauuaaguacacaaugc

SEQ ID NO: 12968 - RNA, 21 nt, Artificial Sequence
  Ebola virus siRNA sense strand
aaucauuaaguacacaaugca

SEQ ID NO: 12969 - RNA, 21 nt, Artificial Sequence
  Ebola virus siRNA sense strand
aucauuaaguacacaaugcaa

SEQ ID NO: 12970 - RNA, 21 nt, Artificial Sequence
  Ebola virus siRNA sense strand
ucauuaaguacacaaugcaag

SEQ ID NO: 12971 - RNA, 21 nt, Artificial Sequence
  Ebola virus siRNA sense strand
cauuaaguacacaaugcaaga

SEQ ID NO: 12972 - RNA, 21 nt, Artificial Sequence
  Ebola virus siRNA sense strand
auuaaguacacaaugcaagau

SEQ ID NO: 12973 - RNA, 21 nt, Artificial Sequence
  Ebola virus siRNA sense strand
uuaaguacacaaugcaagaug

SEQ ID NO: 12974 - RNA, 21 nt, Artificial Sequence
  Ebola virus siRNA sense strand
uaaguacacaaugcaagaugc

SEQ ID NO: 12975 - RNA, 21 nt, Artificial Sequence
  Ebola virus siRNA sense strand
aaguacacaaugcaagaugcu

SEQ ID NO: 12976 - RNA, 21 nt, Artificial Sequence
  Ebola virus siRNA sense strand
aguacacaaugcaagaugcuc

SEQ ID NO: 12977 - RNA, 21 nt, Artificial Sequence
  Ebola virus siRNA sense strand
guacacaaugcaagaugcucu

SEQ ID NO: 12978 - RNA, 21 nt, Artificial Sequence
  Ebola virus siRNA sense strand
uacacaaugcaagaugcucuc

SEQ ID NO: 12979 - RNA, 21 nt, Artificial Sequence
  Ebola virus siRNA sense strand
acacaaugcaagaugcucucu

SEQ ID NO: 12980 - RNA, 21 nt, Artificial Sequence
  Ebola virus siRNA sense strand
cacaaugcaagaugcucucuu

SEQ ID NO: 12981 - RNA, 21 nt, Artificial Sequence
  Ebola virus siRNA sense strand
acaaugcaagaugcucucuuc

SEQ ID NO: 12982 - RNA, 21 nt, Artificial Sequence
  Ebola virus siRNA sense strand
caaugcaagaugcucucuucu

SEQ ID NO: 12983 - RNA, 21 nt, Artificial Sequence
  Ebola virus siRNA sense strand
aaugcaagaugcucucuucuu

SEQ ID NO: 12984 - RNA, 21 nt, Artificial Sequence
  Ebola virus siRNA sense strand
augcaagaugcucucuucuug

SEQ ID NO: 12985 - RNA, 21 nt, Artificial Sequence
  Ebola virus siRNA sense strand
ugcaagaugcucucuucuuga

SEQ ID NO: 12986 - RNA, 21 nt, Artificial Sequence
  Ebola virus siRNA sense strand
gcaagaugcucucuucuugaa

SEQ ID NO: 12987 - RNA, 21 nt, Artificial Sequence
  Ebola virus siRNA sense strand
caagaugcucucuucuugaaa

SEQ ID NO: 12988 - RNA, 21 nt, Artificial Sequence
  Ebola virus siRNA sense strand
aagaugcucucuucuugaaau

SEQ ID NO: 12989 - RNA, 21 nt, Artificial Sequence
  Ebola virus siRNA sense strand
agaugcucucuucuugaaaua

SEQ ID NO: 12990 - RNA, 21 nt, Artificial Sequence
  Ebola virus siRNA sense strand
gaugcucucuucuugaaauau

SEQ ID NO: 12991 - RNA, 21 nt, Artificial Sequence
  Ebola virus siRNA sense strand
augcucucuucuugaaauauu

SEQ ID NO: 12992 - RNA, 21 nt, Artificial Sequence
  Ebola virus siRNA sense strand
ugcucucuucuugaaauauua

SEQ ID NO: 12993 - RNA, 21 nt, Artificial Sequence
  Ebola virus siRNA sense strand
gcucucuucuugaaauauuau

SEQ ID NO: 12994 - RNA, 21 nt, Artificial Sequence
  Ebola virus siRNA sense strand
cucucuucuugaaauauuauc

SEQ ID NO: 12995 - RNA, 21 nt, Artificial Sequence
  Ebola virus siRNA sense strand
ucucuucuugaaauauuaucu

SEQ ID NO: 12996 - RNA, 21 nt, Artificial Sequence
  Ebola virus siRNA sense strand
cucuucuugaaauauuaucuc

SEQ ID NO: 12997 - RNA, 21 nt, Artificial Sequence
  Ebola virus siRNA sense strand
ucuucuugaaauauuaucuca

SEQ ID NO: 12998 - RNA, 21 nt, Artificial Sequence
  Ebola virus siRNA sense strand
cuucuugaaauauuaucucaa

SEQ ID NO: 12999 - RNA, 21 nt, Artificial Sequence
  Ebola virus siRNA sense strand
uucuugaaauauuaucucaaa

SEQ ID NO: 13000 - RNA, 21 nt, Artificial Sequence
  Ebola virus siRNA sense strand
ucuugaaauauuaucucaaaa

SEQ ID NO: 13001 - RNA, 21 nt, Artificial Sequence
  Ebola virus siRNA sense strand
cuugaaauauuaucucaaaaa

SEQ ID NO: 13002 - RNA, 21 nt, Artificial Sequence
  Ebola virus siRNA sense strand
uugaaauauuaucucaaaaau

SEQ ID NO: 13003 - RNA, 21 nt, Artificial Sequence
  Ebola virus siRNA sense strand
ugaaauauuaucucaaaaaug

SEQ ID NO: 13004 - RNA, 21 nt, Artificial Sequence
  Ebola virus siRNA sense strand
gaaauauuaucucaaaaaugu

SEQ ID NO: 13005 - RNA, 21 nt, Artificial Sequence
  Ebola virus siRNA sense strand
aaauauuaucucaaaaaugug

SEQ ID NO: 13006 - RNA, 21 nt, Artificial Sequence
  Ebola virus siRNA sense strand
aauauuaucucaaaaaugugg

SEQ ID NO: 13007 - RNA, 21 nt, Artificial Sequence
  Ebola virus siRNA sense strand
auauuaucucaaaaauguggg

SEQ ID NO: 13008 - RNA, 21 nt, Artificial Sequence
  Ebola virus siRNA sense strand
uauuaucucaaaaaugugggu

SEQ ID NO: 13009 - RNA, 21 nt, Artificial Sequence
  Ebola virus siRNA sense strand
auuaucucaaaaaugugggug

SEQ ID NO: 13010 - RNA, 21 nt, Artificial Sequence
  Ebola virus siRNA sense strand
uuaucucaaaaaugugggugc

SEQ ID NO: 13011 - RNA, 21 nt, Artificial Sequence
  Ebola virus siRNA sense strand
uaucucaaaaaugugggugcu

SEQ ID NO: 13012 - RNA, 21 nt, Artificial Sequence
  Ebola virus siRNA sense strand
aucucaaaaaugugggugcuc

SEQ ID NO: 13013 - RNA, 21 nt, Artificial Sequence
  Ebola virus siRNA sense strand
ucucaaaaaugugggugcuca

SEQ ID NO: 13014 - RNA, 21 nt, Artificial Sequence
  Ebola virus siRNA sense strand
cucaaaaaugugggugcucaa

SEQ ID NO: 13015 - RNA, 21 nt, Artificial Sequence
  Ebola virus siRNA sense strand
ucaaaaaugugggugcucaag

SEQ ID NO: 13016 - RNA, 21 nt, Artificial Sequence
  Ebola virus siRNA sense strand
caaaaaugugggugcucaaga

SEQ ID NO: 13017 - RNA, 21 nt, Artificial Sequence
  Ebola virus siRNA sense strand
aaaaaugugggugcucaagaa

SEQ ID NO: 13018 - RNA, 21 nt, Artificial Sequence
  Ebola virus siRNA sense strand
aaaaugugggugcucaagaag

SEQ ID NO: 13019 - RNA, 21 nt, Artificial Sequence
  Ebola virus siRNA sense strand
aaaugugggugcucaagaaga

SEQ ID NO: 13020 - RNA, 21 nt, Artificial Sequence
  Ebola virus siRNA sense strand
aaugugggugcucaagaagac

SEQ ID NO: 13021 - RNA, 21 nt, Artificial Sequence
  Ebola virus siRNA sense strand
augugggugcucaagaagacu

SEQ ID NO: 13022 - RNA, 21 nt, Artificial Sequence
  Ebola virus siRNA sense strand
ugugggugcucaagaagacug

SEQ ID NO: 13023 - RNA, 21 nt, Artificial Sequence
  Ebola virus siRNA sense strand
gugggugcucaagaagacugu

SEQ ID NO: 13024 - RNA, 21 nt, Artificial Sequence
  Ebola virus siRNA sense strand
ugggugcucaagaagacugug

SEQ ID NO: 13025 - RNA, 21 nt, Artificial Sequence
  Ebola virus siRNA sense strand
gggugcucaagaagacugugu

SEQ ID NO: 13026 - RNA, 21 nt, Artificial Sequence
  Ebola virus siRNA sense strand
ggugcucaagaagacuguguu

SEQ ID NO: 13027 - RNA, 21 nt, Artificial Sequence
  Ebola virus siRNA sense strand
gugcucaagaagacuguguug

SEQ ID NO: 13028 - RNA, 21 nt, Artificial Sequence
  Ebola virus siRNA sense strand
ugcucaagaagacuguguuga

SEQ ID NO: 13029 - RNA, 21 nt, Artificial Sequence
  Ebola virus siRNA sense strand
gcucaagaagacuguguugau

SEQ ID NO: 13030 - RNA, 21 nt, Artificial Sequence
  Ebola virus siRNA sense strand
cucaagaagacuguguugaug

SEQ ID NO: 13031 - RNA, 21 nt, Artificial Sequence
  Ebola virus siRNA sense strand
ucaagaagacuguguugauga

SEQ ID NO: 13032 - RNA, 21 nt, Artificial Sequence
  Ebola virus siRNA sense strand
caagaagacuguguugaugaa

SEQ ID NO: 13033 - RNA, 21 nt, Artificial Sequence
  Ebola virus siRNA sense strand
aagaagacuguguugaugaac

SEQ ID NO: 13034 - RNA, 21 nt, Artificial Sequence
  Ebola virus siRNA sense strand
agaagacuguguugaugaaca

SEQ ID NO: 13035 - RNA, 21 nt, Artificial Sequence
  Ebola virus siRNA sense strand
gaagacuguguugaugaacac

SEQ ID NO: 13036 - RNA, 21 nt, Artificial Sequence
  Ebola virus siRNA sense strand
aagacuguguugaugaacacu

SEQ ID NO: 13037 - RNA, 21 nt, Artificial Sequence
  Ebola virus siRNA sense strand
agacuguguugaugaacacuu

SEQ ID NO: 13038 - RNA, 21 nt, Artificial Sequence
  Ebola virus siRNA sense strand
gacuguguugaugaacacuuu

SEQ ID NO: 13039 - RNA, 21 nt, Artificial Sequence
  Ebola virus siRNA sense strand
acuguguugaugaacacuuuc

SEQ ID NO: 13040 - RNA, 21 nt, Artificial Sequence
  Ebola virus siRNA sense strand
cuguguugaugaacacuuuca

SEQ ID NO: 13041 - RNA, 21 nt, Artificial Sequence
  Ebola virus siRNA sense strand
uguguugaugaacacuuucaa

SEQ ID NO: 13042 - RNA, 21 nt, Artificial Sequence
  Ebola virus siRNA sense strand
guguugaugaacacuuucaag

SEQ ID NO: 13043 - RNA, 21 nt, Artificial Sequence
  Ebola virus siRNA sense strand
uguugaugaacacuuucaaga

SEQ ID NO: 13044 - RNA, 21 nt, Artificial Sequence
  Ebola virus siRNA sense strand
guugaugaacacuuucaagag

SEQ ID NO: 13045 - RNA, 21 nt, Artificial Sequence
  Ebola virus siRNA sense strand
uugaugaacacuuucaagaga

SEQ ID NO: 13046 - RNA, 21 nt, Artificial Sequence
  Ebola virus siRNA sense strand
ugaugaacacuuucaagagaa

SEQ ID NO: 13047 - RNA, 21 nt, Artificial Sequence
  Ebola virus siRNA sense strand
gaugaacacuuucaagagaaa

SEQ ID NO: 13048 - RNA, 21 nt, Artificial Sequence
  Ebola virus siRNA sense strand
augaacacuuucaagagaaaa

SEQ ID NO: 13049 - RNA, 21 nt, Artificial Sequence
  Ebola virus siRNA sense strand
ugaacacuuucaagagaaaau

SEQ ID NO: 13050 - RNA, 21 nt, Artificial Sequence
  Ebola virus siRNA sense strand
gaacacuuucaagagaaaauc

SEQ ID NO: 13051 - RNA, 21 nt, Artificial Sequence
  Ebola virus siRNA sense strand
aacacuuucaagagaaaaucu

SEQ ID NO: 13052 - RNA, 21 nt, Artificial Sequence
  Ebola virus siRNA sense strand
acacuuucaagagaaaaucuu

SEQ ID NO: 13053 - RNA, 21 nt, Artificial Sequence
  Ebola virus siRNA sense strand
cacuuucaagagaaaaucuua

SEQ ID NO: 13054 - RNA, 21 nt, Artificial Sequence
  Ebola virus siRNA sense strand
acuuucaagagaaaaucuuau

SEQ ID NO: 13055 - RNA, 21 nt, Artificial Sequence
  Ebola virus siRNA sense strand
cuuucaagagaaaaucuuauc

SEQ ID NO: 13056 - RNA, 21 nt, Artificial Sequence
  Ebola virus siRNA sense strand
uuucaagagaaaaucuuaucu

SEQ ID NO: 13057 - RNA, 21 nt, Artificial Sequence
  Ebola virus siRNA sense strand
uucaagagaaaaucuuaucuu

SEQ ID NO: 13058 - RNA, 21 nt, Artificial Sequence
  Ebola virus siRNA sense strand
ucaagagaaaaucuuaucuuc

SEQ ID NO: 13059 - RNA, 21 nt, Artificial Sequence
  Ebola virus siRNA sense strand
caagagaaaaucuuaucuuca

SEQ ID NO: 13060 - RNA, 21 nt, Artificial Sequence
  Ebola virus siRNA sense strand
aagagaaaaucuuaucuucaa

SEQ ID NO: 13061 - RNA, 21 nt, Artificial Sequence
  Ebola virus siRNA sense strand
agagaaaaucuuaucuucaau

SEQ ID NO: 13062 - RNA, 21 nt, Artificial Sequence
  Ebola virus siRNA sense strand
gagaaaaucuuaucuucaauu

SEQ ID NO: 13063 - RNA, 21 nt, Artificial Sequence
  Ebola virus siRNA sense strand
agaaaaucuuaucuucaauuc

SEQ ID NO: 13064 - RNA, 21 nt, Artificial Sequence
  Ebola virus siRNA sense strand
gaaaaucuuaucuucaauuca

SEQ ID NO: 13065 - RNA, 21 nt, Artificial Sequence
  Ebola virus siRNA sense strand
aaaaucuuaucuucaauucag

SEQ ID NO: 13066 - RNA, 21 nt, Artificial Sequence
  Ebola virus siRNA sense strand
aaaucuuaucuucaauucagg

SEQ ID NO: 13067 - RNA, 21 nt, Artificial Sequence
  Ebola virus siRNA sense strand
aaucuuaucuucaauucaggg

SEQ ID NO: 13068 - RNA, 21 nt, Artificial Sequence
  Ebola virus siRNA sense strand
aucuuaucuucaauucagggc

SEQ ID NO: 13069 - RNA, 21 nt, Artificial Sequence
  Ebola virus siRNA sense strand
ucuuaucuucaauucagggca

SEQ ID NO: 13070 - RNA, 21 nt, Artificial Sequence
  Ebola virus siRNA sense strand
cuuaucuucaauucagggcaa

SEQ ID NO: 13071 - RNA, 21 nt, Artificial Sequence
  Ebola virus siRNA sense strand
uuaucuucaauucagggcaau

SEQ ID NO: 13072 - RNA, 21 nt, Artificial Sequence
  Ebola virus siRNA sense strand
uaucuucaauucagggcaaug

SEQ ID NO: 13073 - RNA, 21 nt, Artificial Sequence
  Ebola virus siRNA sense strand
aucuucaauucagggcaauga

SEQ ID NO: 13074 - RNA, 21 nt, Artificial Sequence
  Ebola virus siRNA sense strand
ucuucaauucagggcaaugaa

SEQ ID NO: 13075 - RNA, 21 nt, Artificial Sequence
  Ebola virus siRNA sense strand
cuucaauucagggcaaugaau

SEQ ID NO: 13076 - RNA, 21 nt, Artificial Sequence
  Ebola virus siRNA sense strand
uucaauucagggcaaugaauu

SEQ ID NO: 13077 - RNA, 21 nt, Artificial Sequence
  Ebola virus siRNA sense strand
ucaauucagggcaaugaauuu

SEQ ID NO: 13078 - RNA, 21 nt, Artificial Sequence
  Ebola virus siRNA sense strand
caauucagggcaaugaauuuu

SEQ ID NO: 13079 - RNA, 21 nt, Artificial Sequence
  Ebola virus siRNA sense strand
aauucagggcaaugaauuuuu

SEQ ID NO: 13080 - RNA, 21 nt, Artificial Sequence
  Ebola virus siRNA sense strand
auucagggcaaugaauuuuua

SEQ ID NO: 13081 - RNA, 21 nt, Artificial Sequence
  Ebola virus siRNA sense strand
uucagggcaaugaauuuuuac

SEQ ID NO: 13082 - RNA, 21 nt, Artificial Sequence
  Ebola virus siRNA sense strand
ucagggcaaugaauuuuuaca

SEQ ID NO: 13083 - RNA, 21 nt, Artificial Sequence
  Ebola virus siRNA sense strand
cagggcaaugaauuuuuacau

SEQ ID NO: 13084 - RNA, 21 nt, Artificial Sequence
  Ebola virus siRNA sense strand
agggcaaugaauuuuuacauc

SEQ ID NO: 13085 - RNA, 21 nt, Artificial Sequence
  Ebola virus siRNA sense strand
gggcaaugaauuuuuacauca

SEQ ID NO: 13086 - RNA, 21 nt, Artificial Sequence
  Ebola virus siRNA sense strand
ggcaaugaauuuuuacaucaa

SEQ ID NO: 13087 - RNA, 21 nt, Artificial Sequence
  Ebola virus siRNA sense strand
gcaaugaauuuuuacaucaaa

SEQ ID NO: 13088 - RNA, 21 nt, Artificial Sequence
  Ebola virus siRNA sense strand
caaugaauuuuuacaucaaau

SEQ ID NO: 13089 - RNA, 21 nt, Artificial Sequence
  Ebola virus siRNA sense strand
aaugaauuuuuacaucaaaug

SEQ ID NO: 13090 - RNA, 21 nt, Artificial Sequence
  Ebola virus siRNA sense strand
augaauuuuuacaucaaaugu

SEQ ID NO: 13091 - RNA, 21 nt, Artificial Sequence
  Ebola virus siRNA sense strand
ugaauuuuuacaucaaauguu

SEQ ID NO: 13092 - RNA, 21 nt, Artificial Sequence
  Ebola virus siRNA sense strand
gaauuuuuacaucaaauguuu

SEQ ID NO: 13093 - RNA, 21 nt, Artificial Sequence
  Ebola virus siRNA sense strand
aauuuuuacaucaaauguuuu

SEQ ID NO: 13094 - RNA, 21 nt, Artificial Sequence
  Ebola virus siRNA sense strand
auuuuuacaucaaauguuuuu

SEQ ID NO: 13095 - RNA, 21 nt, Artificial Sequence
  Ebola virus siRNA sense strand
uuuuuacaucaaauguuuuuc

SEQ ID NO: 13096 - RNA, 21 nt, Artificial Sequence
  Ebola virus siRNA sense strand
uuuuacaucaaauguuuuucu

SEQ ID NO: 13097 - RNA, 21 nt, Artificial Sequence
  Ebola virus siRNA sense strand
uuuacaucaaauguuuuucug

SEQ ID NO: 13098 - RNA, 21 nt, Artificial Sequence
  Ebola virus siRNA sense strand
uuacaucaaauguuuuucugg

SEQ ID NO: 13099 - RNA, 21 nt, Artificial Sequence
  Ebola virus siRNA sense strand
uacaucaaauguuuuucuggu

SEQ ID NO: 13100 - RNA, 21 nt, Artificial Sequence
  Ebola virus siRNA sense strand
acaucaaauguuuuucuggua

SEQ ID NO: 13101 - RNA, 21 nt, Artificial Sequence
  Ebola virus siRNA sense strand
caucaaauguuuuucugguau

SEQ ID NO: 13102 - RNA, 21 nt, Artificial Sequence
  Ebola virus siRNA sense strand
aucaaauguuuuucugguaug

SEQ ID NO: 13103 - RNA, 21 nt, Artificial Sequence
  Ebola virus siRNA sense strand
ucaaauguuuuucugguauga

SEQ ID NO: 13104 - RNA, 21 nt, Artificial Sequence
  Ebola virus siRNA sense strand
caaauguuuuucugguaugau

SEQ ID NO: 13105 - RNA, 21 nt, Artificial Sequence
  Ebola virus siRNA sense strand
aaauguuuuucugguaugauc

SEQ ID NO: 13106 - RNA, 21 nt, Artificial Sequence
  Ebola virus siRNA sense strand
aauguuuuucugguaugaucu

SEQ ID NO: 13107 - RNA, 21 nt, Artificial Sequence
  Ebola virus siRNA sense strand
auguuuuucugguaugaucug

SEQ ID NO: 13108 - RNA, 21 nt, Artificial Sequence
  Ebola virus siRNA sense strand
uguuuuucugguaugaucugg

SEQ ID NO: 13109 - RNA, 21 nt, Artificial Sequence
  Ebola virus siRNA sense strand
guuuuucugguaugaucuggc

SEQ ID NO: 13110 - RNA, 21 nt, Artificial Sequence
  Ebola virus siRNA sense strand
uuuuucugguaugaucuggcu

SEQ ID NO: 13111 - RNA, 21 nt, Artificial Sequence
  Ebola virus siRNA sense strand
uuuucugguaugaucuggcua

SEQ ID NO: 13112 - RNA, 21 nt, Artificial Sequence
  Ebola virus siRNA sense strand
uuucugguaugaucuggcuau

SEQ ID NO: 13113 - RNA, 21 nt, Artificial Sequence
  Ebola virus siRNA sense strand
uucugguaugaucuggcuauu

SEQ ID NO: 13114 - RNA, 21 nt, Artificial Sequence
  Ebola virus siRNA sense strand
ucugguaugaucuggcuauuu

SEQ ID NO: 13115 - RNA, 21 nt, Artificial Sequence
  Ebola virus siRNA sense strand
cugguaugaucuggcuauuuu

SEQ ID NO: 13116 - RNA, 21 nt, Artificial Sequence
  Ebola virus siRNA sense strand
ugguaugaucuggcuauuuua

SEQ ID NO: 13117 - RNA, 21 nt, Artificial Sequence
  Ebola virus siRNA sense strand
gguaugaucuggcuauuuuaa

SEQ ID NO: 13118 - RNA, 21 nt, Artificial Sequence
  Ebola virus siRNA sense strand
guaugaucuggcuauuuuaac

SEQ ID NO: 13119 - RNA, 21 nt, Artificial Sequence
  Ebola virus siRNA sense strand
uaugaucuggcuauuuuaacu

SEQ ID NO: 13120 - RNA, 21 nt, Artificial Sequence
  Ebola virus siRNA sense strand
augaucuggcuauuuuaacuc

SEQ ID NO: 13121 - RNA, 21 nt, Artificial Sequence
  Ebola virus siRNA sense strand
ugaucuggcuauuuuaacucg

SEQ ID NO: 13122 - RNA, 21 nt, Artificial Sequence
  Ebola virus siRNA sense strand
gaucuggcuauuuuaacucga

SEQ ID NO: 13123 - RNA, 21 nt, Artificial Sequence
  Ebola virus siRNA sense strand
aucuggcuauuuuaacucgaa

SEQ ID NO: 13124 - RNA, 21 nt, Artificial Sequence
  Ebola virus siRNA sense strand
ucuggcuauuuuaacucgaag

SEQ ID NO: 13125 - RNA, 21 nt, Artificial Sequence
  Ebola virus siRNA sense strand
cuggcuauuuuaacucgaagg

SEQ ID NO: 13126 - RNA, 21 nt, Artificial Sequence
  Ebola virus siRNA sense strand
uggcuauuuuaacucgaaggg

SEQ ID NO: 13127 - RNA, 21 nt, Artificial Sequence
  Ebola virus siRNA sense strand
ggcuauuuuaacucgaagggg

SEQ ID NO: 13128 - RNA, 21 nt, Artificial Sequence
  Ebola virus siRNA sense strand
gcuauuuuaacucgaaggggu

SEQ ID NO: 13129 - RNA, 21 nt, Artificial Sequence
  Ebola virus siRNA sense strand
cuauuuuaacucgaaggggua

SEQ ID NO: 13130 - RNA, 21 nt, Artificial Sequence
  Ebola virus siRNA sense strand
uauuuuaacucgaagggguag

SEQ ID NO: 13131 - RNA, 21 nt, Artificial Sequence
  Ebola virus siRNA sense strand
auuuuaacucgaagggguaga

SEQ ID NO: 13132 - RNA, 21 nt, Artificial Sequence
  Ebola virus siRNA sense strand
uuuuaacucgaagggguagau

SEQ ID NO: 13133 - RNA, 21 nt, Artificial Sequence
  Ebola virus siRNA sense strand
uuuaacucgaagggguagauu

SEQ ID NO: 13134 - RNA, 21 nt, Artificial Sequence
  Ebola virus siRNA sense strand
uuaacucgaagggguagauua

SEQ ID NO: 13135 - RNA, 21 nt, Artificial Sequence
  Ebola virus siRNA sense strand
uaacucgaagggguagauuaa

SEQ ID NO: 13136 - RNA, 21 nt, Artificial Sequence
  Ebola virus siRNA sense strand
aacucgaagggguagauuaaa

SEQ ID NO: 13137 - RNA, 21 nt, Artificial Sequence
  Ebola virus siRNA sense strand
acucgaagggguagauuaaau

SEQ ID NO: 13138 - RNA, 21 nt, Artificial Sequence
  Ebola virus siRNA sense strand
cucgaagggguagauuaaauc

SEQ ID NO: 13139 - RNA, 21 nt, Artificial Sequence
  Ebola virus siRNA sense strand
ucgaagggguagauuaaaucg

SEQ ID NO: 13140 - RNA, 21 nt, Artificial Sequence
  Ebola virus siRNA sense strand
cgaagggguagauuaaaucga

SEQ ID NO: 13141 - RNA, 21 nt, Artificial Sequence
  Ebola virus siRNA sense strand
gaagggguagauuaaaucgag

SEQ ID NO: 13142 - RNA, 21 nt, Artificial Sequence
  Ebola virus siRNA sense strand
aagggguagauuaaaucgagg

SEQ ID NO: 13143 - RNA, 21 nt, Artificial Sequence
  Ebola virus siRNA sense strand
agggguagauuaaaucgagga

SEQ ID NO: 13144 - RNA, 21 nt, Artificial Sequence
  Ebola virus siRNA sense strand
gggguagauuaaaucgaggaa

SEQ ID NO: 13145 - RNA, 21 nt, Artificial Sequence
  Ebola virus siRNA sense strand
ggguagauuaaaucgaggaaa

SEQ ID NO: 13146 - RNA, 21 nt, Artificial Sequence
  Ebola virus siRNA sense strand
gguagauuaaaucgaggaaac

SEQ ID NO: 13147 - RNA, 21 nt, Artificial Sequence
  Ebola virus siRNA sense strand
guagauuaaaucgaggaaacu

SEQ ID NO: 13148 - RNA, 21 nt, Artificial Sequence
  Ebola virus siRNA sense strand
uagauuaaaucgaggaaacuc

SEQ ID NO: 13149 - RNA, 21 nt, Artificial Sequence
  Ebola virus siRNA sense strand
agauuaaaucgaggaaacucu

SEQ ID NO: 13150 - RNA, 21 nt, Artificial Sequence
  Ebola virus siRNA sense strand
gauuaaaucgaggaaacucua

SEQ ID NO: 13151 - RNA, 21 nt, Artificial Sequence
  Ebola virus siRNA sense strand
auuaaaucgaggaaacucuag

SEQ ID NO: 13152 - RNA, 21 nt, Artificial Sequence
  Ebola virus siRNA sense strand
uuaaaucgaggaaacucuaga

SEQ ID NO: 13153 - RNA, 21 nt, Artificial Sequence
  Ebola virus siRNA sense strand
uaaaucgaggaaacucuagau

SEQ ID NO: 13154 - RNA, 21 nt, Artificial Sequence
  Ebola virus siRNA sense strand
aaaucgaggaaacucuagauc

SEQ ID NO: 13155 - RNA, 21 nt, Artificial Sequence
  Ebola virus siRNA sense strand
aaucgaggaaacucuagauca

SEQ ID NO: 13156 - RNA, 21 nt, Artificial Sequence
  Ebola virus siRNA sense strand
aucgaggaaacucuagaucaa

SEQ ID NO: 13157 - RNA, 21 nt, Artificial Sequence
  Ebola virus siRNA sense strand
ucgaggaaacucuagaucaac

SEQ ID NO: 13158 - RNA, 21 nt, Artificial Sequence
  Ebola virus siRNA sense strand
cgaggaaacucuagaucaaca

SEQ ID NO: 13159 - RNA, 21 nt, Artificial Sequence
  Ebola virus siRNA sense strand
gaggaaacucuagaucaacau

SEQ ID NO: 13160 - RNA, 21 nt, Artificial Sequence
  Ebola virus siRNA sense strand
aggaaacucuagaucaacaug

SEQ ID NO: 13161 - RNA, 21 nt, Artificial Sequence
  Ebola virus siRNA sense strand
ggaaacucuagaucaacaugg

SEQ ID NO: 13162 - RNA, 21 nt, Artificial Sequence
  Ebola virus siRNA sense strand
gaaacucuagaucaacauggu

SEQ ID NO: 13163 - RNA, 21 nt, Artificial Sequence
  Ebola virus siRNA sense strand
aaacucuagaucaacaugguu

SEQ ID NO: 13164 - RNA, 21 nt, Artificial Sequence
  Ebola virus siRNA sense strand
aacucuagaucaacaugguuu

SEQ ID NO: 13165 - RNA, 21 nt, Artificial Sequence
  Ebola virus siRNA sense strand
acucuagaucaacaugguuug

SEQ ID NO: 13166 - RNA, 21 nt, Artificial Sequence
  Ebola virus siRNA sense strand
cucuagaucaacaugguuugu

SEQ ID NO: 13167 - RNA, 21 nt, Artificial Sequence
  Ebola virus siRNA sense strand
ucuagaucaacaugguuuguu

SEQ ID NO: 13168 - RNA, 21 nt, Artificial Sequence
  Ebola virus siRNA sense strand
cuagaucaacaugguuuguuc

SEQ ID NO: 13169 - RNA, 21 nt, Artificial Sequence
  Ebola virus siRNA sense strand
uagaucaacaugguuuguuca

SEQ ID NO: 13170 - RNA, 21 nt, Artificial Sequence
  Ebola virus siRNA sense strand
agaucaacaugguuuguucau

SEQ ID NO: 13171 - RNA, 21 nt, Artificial Sequence
  Ebola virus siRNA sense strand
gaucaacaugguuuguucaug

SEQ ID NO: 13172 - RNA, 21 nt, Artificial Sequence
  Ebola virus siRNA sense strand
aucaacaugguuuguucauga

SEQ ID NO: 13173 - RNA, 21 nt, Artificial Sequence
  Ebola virus siRNA sense strand
ucaacaugguuuguucaugau

SEQ ID NO: 13174 - RNA, 21 nt, Artificial Sequence
  Ebola virus siRNA sense strand
caacaugguuuguucaugaug

SEQ ID NO: 13175 - RNA, 21 nt, Artificial Sequence
  Ebola virus siRNA sense strand
aacaugguuuguucaugauga

SEQ ID NO: 13176 - RNA, 21 nt, Artificial Sequence
  Ebola virus siRNA sense strand
acaugguuuguucaugaugau

SEQ ID NO: 13177 - RNA, 21 nt, Artificial Sequence
  Ebola virus siRNA sense strand
caugguuuguucaugaugauu

SEQ ID NO: 13178 - RNA, 21 nt, Artificial Sequence
  Ebola virus siRNA sense strand
augguuuguucaugaugauuu

SEQ ID NO: 13179 - RNA, 21 nt, Artificial Sequence
  Ebola virus siRNA sense strand
ugguuuguucaugaugauuua

SEQ ID NO: 13180 - RNA, 21 nt, Artificial Sequence
  Ebola virus siRNA sense strand
gguuuguucaugaugauuuaa

SEQ ID NO: 13181 - RNA, 21 nt, Artificial Sequence
  Ebola virus siRNA sense strand
guuuguucaugaugauuuaau

SEQ ID NO: 13182 - RNA, 21 nt, Artificial Sequence
  Ebola virus siRNA sense strand
uuuguucaugaugauuuaaua

SEQ ID NO: 13183 - RNA, 21 nt, Artificial Sequence
  Ebola virus siRNA sense strand
uuguucaugaugauuuaauag

SEQ ID NO: 13184 - RNA, 21 nt, Artificial Sequence
  Ebola virus siRNA sense strand
uguucaugaugauuuaauaga

SEQ ID NO: 13185 - RNA, 21 nt, Artificial Sequence
  Ebola virus siRNA sense strand
guucaugaugauuuaauagac

SEQ ID NO: 13186 - RNA, 21 nt, Artificial Sequence
  Ebola virus siRNA sense strand
uucaugaugauuuaauagaca

SEQ ID NO: 13187 - RNA, 21 nt, Artificial Sequence
  Ebola virus siRNA sense strand
ucaugaugauuuaauagacau

SEQ ID NO: 13188 - RNA, 21 nt, Artificial Sequence
  Ebola virus siRNA sense strand
caugaugauuuaauagacauc

SEQ ID NO: 13189 - RNA, 21 nt, Artificial Sequence
  Ebola virus siRNA sense strand
augaugauuuaauagacaucu

SEQ ID NO: 13190 - RNA, 21 nt, Artificial Sequence
  Ebola virus siRNA sense strand
ugaugauuuaauagacaucuu

SEQ ID NO: 13191 - RNA, 21 nt, Artificial Sequence
  Ebola virus siRNA sense strand
gaugauuuaauagacaucuua

SEQ ID NO: 13192 - RNA, 21 nt, Artificial Sequence
  Ebola virus siRNA sense strand
augauuuaauagacaucuuag

SEQ ID NO: 13193 - RNA, 21 nt, Artificial Sequence
  Ebola virus siRNA sense strand
ugauuuaauagacaucuuagg

SEQ ID NO: 13194 - RNA, 21 nt, Artificial Sequence
  Ebola virus siRNA sense strand
gauuuaauagacaucuuaggc

SEQ ID NO: 13195 - RNA, 21 nt, Artificial Sequence
  Ebola virus siRNA sense strand
auuuaauagacaucuuaggcu

SEQ ID NO: 13196 - RNA, 21 nt, Artificial Sequence
  Ebola virus siRNA sense strand
uuuaauagacaucuuaggcua

SEQ ID NO: 13197 - RNA, 21 nt, Artificial Sequence
  Ebola virus siRNA sense strand
uuaauagacaucuuaggcuau

SEQ ID NO: 13198 - RNA, 21 nt, Artificial Sequence
  Ebola virus siRNA sense strand
uaauagacaucuuaggcuaug

SEQ ID NO: 13199 - RNA, 21 nt, Artificial Sequence
  Ebola virus siRNA sense strand
aauagacaucuuaggcuaugg

SEQ ID NO: 13200 - RNA, 21 nt, Artificial Sequence
  Ebola virus siRNA sense strand
auagacaucuuaggcuauggg

SEQ ID NO: 13201 - RNA, 21 nt, Artificial Sequence
  Ebola virus siRNA sense strand
uagacaucuuaggcuaugggg

SEQ ID NO: 13202 - RNA, 21 nt, Artificial Sequence
  Ebola virus siRNA sense strand
agacaucuuaggcuaugggga

SEQ ID NO: 13203 - RNA, 21 nt, Artificial Sequence
  Ebola virus siRNA sense strand
gacaucuuaggcuauggggac

SEQ ID NO: 13204 - RNA, 21 nt, Artificial Sequence
  Ebola virus siRNA sense strand
acaucuuaggcuauggggacu

SEQ ID NO: 13205 - RNA, 21 nt, Artificial Sequence
  Ebola virus siRNA sense strand
caucuuaggcuauggggacua

SEQ ID NO: 13206 - RNA, 21 nt, Artificial Sequence
  Ebola virus siRNA sense strand
aucuuaggcuauggggacuau

SEQ ID NO: 13207 - RNA, 21 nt, Artificial Sequence
  Ebola virus siRNA sense strand
ucuuaggcuauggggacuaug

SEQ ID NO: 13208 - RNA, 21 nt, Artificial Sequence
  Ebola virus siRNA sense strand
cuuaggcuauggggacuaugu

SEQ ID NO: 13209 - RNA, 21 nt, Artificial Sequence
  Ebola virus siRNA sense strand
uuaggcuauggggacuauguu

SEQ ID NO: 13210 - RNA, 21 nt, Artificial Sequence
  Ebola virus siRNA sense strand
uaggcuauggggacuauguuu

SEQ ID NO: 13211 - RNA, 21 nt, Artificial Sequence
  Ebola virus siRNA sense strand
aggcuauggggacuauguuuu

SEQ ID NO: 13212 - RNA, 21 nt, Artificial Sequence
  Ebola virus siRNA sense strand
ggcuauggggacuauguuuuu

SEQ ID NO: 13213 - RNA, 21 nt, Artificial Sequence
  Ebola virus siRNA sense strand
gcuauggggacuauguuuuuu

SEQ ID NO: 13214 - RNA, 21 nt, Artificial Sequence
  Ebola virus siRNA sense strand
cuauggggacuauguuuuuug

SEQ ID NO: 13215 - RNA, 21 nt, Artificial Sequence
  Ebola virus siRNA sense strand
uauggggacuauguuuuuugg

SEQ ID NO: 13216 - RNA, 21 nt, Artificial Sequence
  Ebola virus siRNA sense strand
auggggacuauguuuuuugga

SEQ ID NO: 13217 - RNA, 21 nt, Artificial Sequence
  Ebola virus siRNA sense strand
uggggacuauguuuuuuggaa

SEQ ID NO: 13218 - RNA, 21 nt, Artificial Sequence
  Ebola virus siRNA sense strand
ggggacuauguuuuuuggaag

SEQ ID NO: 13219 - RNA, 21 nt, Artificial Sequence
  Ebola virus siRNA sense strand
gggacuauguuuuuuggaaga

SEQ ID NO: 13220 - RNA, 21 nt, Artificial Sequence
  Ebola virus siRNA sense strand
ggacuauguuuuuuggaagau

SEQ ID NO: 13221 - RNA, 21 nt, Artificial Sequence
  Ebola virus siRNA sense strand
gacuauguuuuuuggaagauc

SEQ ID NO: 13222 - RNA, 21 nt, Artificial Sequence
  Ebola virus siRNA sense strand
acuauguuuuuuggaagaucc

SEQ ID NO: 13223 - RNA, 21 nt, Artificial Sequence
  Ebola virus siRNA sense strand
cuauguuuuuuggaagauccc

SEQ ID NO: 13224 - RNA, 21 nt, Artificial Sequence
  Ebola virus siRNA sense strand
uauguuuuuuggaagauccca

SEQ ID NO: 13225 - RNA, 21 nt, Artificial Sequence
  Ebola virus siRNA sense strand
auguuuuuuggaagaucccaa

SEQ ID NO: 13226 - RNA, 21 nt, Artificial Sequence
  Ebola virus siRNA sense strand
uguuuuuuggaagaucccaau

SEQ ID NO: 13227 - RNA, 21 nt, Artificial Sequence
  Ebola virus siRNA sense strand
guuuuuuggaagaucccaauu

SEQ ID NO: 13228 - RNA, 21 nt, Artificial Sequence
  Ebola virus siRNA sense strand
uuuuuuggaagaucccaauuu

SEQ ID NO: 13229 - RNA, 21 nt, Artificial Sequence
  Ebola virus siRNA sense strand
uuuuuggaagaucccaauuuc

SEQ ID NO: 13230 - RNA, 21 nt, Artificial Sequence
  Ebola virus siRNA sense strand
uuuuggaagaucccaauuuca

SEQ ID NO: 13231 - RNA, 21 nt, Artificial Sequence
  Ebola virus siRNA sense strand
uuuggaagaucccaauuucaa

SEQ ID NO: 13232 - RNA, 21 nt, Artificial Sequence
  Ebola virus siRNA sense strand
uuggaagaucccaauuucaau

SEQ ID NO: 13233 - RNA, 21 nt, Artificial Sequence
  Ebola virus siRNA sense strand
uggaagaucccaauuucaaug

SEQ ID NO: 13234 - RNA, 21 nt, Artificial Sequence
  Ebola virus siRNA sense strand
ggaagaucccaauuucaaugu

SEQ ID NO: 13235 - RNA, 21 nt, Artificial Sequence
  Ebola virus siRNA sense strand
gaagaucccaauuucaauguu

SEQ ID NO: 13236 - RNA, 21 nt, Artificial Sequence
  Ebola virus siRNA sense strand
aagaucccaauuucaauguua

SEQ ID NO: 13237 - RNA, 21 nt, Artificial Sequence
  Ebola virus siRNA sense strand
agaucccaauuucaauguuac

SEQ ID NO: 13238 - RNA, 21 nt, Artificial Sequence
  Ebola virus siRNA sense strand
gaucccaauuucaauguuacc

SEQ ID NO: 13239 - RNA, 21 nt, Artificial Sequence
  Ebola virus siRNA sense strand
aucccaauuucaauguuacca

SEQ ID NO: 13240 - RNA, 21 nt, Artificial Sequence
  Ebola virus siRNA sense strand
ucccaauuucaauguuaccac

SEQ ID NO: 13241 - RNA, 21 nt, Artificial Sequence
  Ebola virus siRNA sense strand
cccaauuucaauguuaccacu

SEQ ID NO: 13242 - RNA, 21 nt, Artificial Sequence
  Ebola virus siRNA sense strand
ccaauuucaauguuaccacug

SEQ ID NO: 13243 - RNA, 21 nt, Artificial Sequence
  Ebola virus siRNA sense strand
caauuucaauguuaccacuga

SEQ ID NO: 13244 - RNA, 21 nt, Artificial Sequence
  Ebola virus siRNA sense strand
aauuucaauguuaccacugaa

SEQ ID NO: 13245 - RNA, 21 nt, Artificial Sequence
  Ebola virus siRNA sense strand
auuucaauguuaccacugaac

SEQ ID NO: 13246 - RNA, 21 nt, Artificial Sequence
  Ebola virus siRNA sense strand
uuucaauguuaccacugaaca

SEQ ID NO: 13247 - RNA, 21 nt, Artificial Sequence
  Ebola virus siRNA sense strand
uucaauguuaccacugaacac

SEQ ID NO: 13248 - RNA, 21 nt, Artificial Sequence
  Ebola virus siRNA sense strand
ucaauguuaccacugaacaca

SEQ ID NO: 13249 - RNA, 21 nt, Artificial Sequence
  Ebola virus siRNA sense strand
caauguuaccacugaacacac

SEQ ID NO: 13250 - RNA, 21 nt, Artificial Sequence
  Ebola virus siRNA sense strand
aauguuaccacugaacacaca

SEQ ID NO: 13251 - RNA, 21 nt, Artificial Sequence
  Ebola virus siRNA sense strand
auguuaccacugaacacacaa

SEQ ID NO: 13252 - RNA, 21 nt, Artificial Sequence
  Ebola virus siRNA sense strand
uguuaccacugaacacacaag

SEQ ID NO: 13253 - RNA, 21 nt, Artificial Sequence
  Ebola virus siRNA sense strand
guuaccacugaacacacaagg

SEQ ID NO: 13254 - RNA, 21 nt, Artificial Sequence
  Ebola virus siRNA sense strand
uuaccacugaacacacaagga

SEQ ID NO: 13255 - RNA, 21 nt, Artificial Sequence
  Ebola virus siRNA sense strand
uaccacugaacacacaaggaa

SEQ ID NO: 13256 - RNA, 21 nt, Artificial Sequence
  Ebola virus siRNA sense strand
accacugaacacacaaggaau

SEQ ID NO: 13257 - RNA, 21 nt, Artificial Sequence
  Ebola virus siRNA sense strand
ccacugaacacacaaggaauc

SEQ ID NO: 13258 - RNA, 21 nt, Artificial Sequence
  Ebola virus siRNA sense strand
cacugaacacacaaggaaucc

SEQ ID NO: 13259 - RNA, 21 nt, Artificial Sequence
  Ebola virus siRNA sense strand
acugaacacacaaggaauccc

SEQ ID NO: 13260 - RNA, 21 nt, Artificial Sequence
  Ebola virus siRNA sense strand
cugaacacacaaggaaucccc

SEQ ID NO: 13261 - RNA, 21 nt, Artificial Sequence
  Ebola virus siRNA sense strand
ugaacacacaaggaauccccc

SEQ ID NO: 13262 - RNA, 21 nt, Artificial Sequence
  Ebola virus siRNA sense strand
gaacacacaaggaauccccca

SEQ ID NO: 13263 - RNA, 21 nt, Artificial Sequence
  Ebola virus siRNA sense strand
aacacacaaggaaucccccau

SEQ ID NO: 13264 - RNA, 21 nt, Artificial Sequence
  Ebola virus siRNA sense strand
acacacaaggaaucccccaug

SEQ ID NO: 13265 - RNA, 21 nt, Artificial Sequence
  Ebola virus siRNA sense strand
cacacaaggaaucccccaugc

SEQ ID NO: 13266 - RNA, 21 nt, Artificial Sequence
  Ebola virus siRNA sense strand
acacaaggaaucccccaugcu

SEQ ID NO: 13267 - RNA, 21 nt, Artificial Sequence
  Ebola virus siRNA sense strand
cacaaggaaucccccaugcug

SEQ ID NO: 13268 - RNA, 21 nt, Artificial Sequence
  Ebola virus siRNA sense strand
acaaggaaucccccaugcugc

SEQ ID NO: 13269 - RNA, 21 nt, Artificial Sequence
  Ebola virus siRNA sense strand
caaggaaucccccaugcugcu

SEQ ID NO: 13270 - RNA, 21 nt, Artificial Sequence
  Ebola virus siRNA sense strand
aaggaaucccccaugcugcua

SEQ ID NO: 13271 - RNA, 21 nt, Artificial Sequence
  Ebola virus siRNA sense strand
aggaaucccccaugcugcuau

SEQ ID NO: 13272 - RNA, 21 nt, Artificial Sequence
  Ebola virus siRNA sense strand
ggaaucccccaugcugcuaug

SEQ ID NO: 13273 - RNA, 21 nt, Artificial Sequence
  Ebola virus siRNA sense strand
gaaucccccaugcugcuaugg

SEQ ID NO: 13274 - RNA, 21 nt, Artificial Sequence
  Ebola virus siRNA sense strand
aaucccccaugcugcuaugga

SEQ ID NO: 13275 - RNA, 21 nt, Artificial Sequence
  Ebola virus siRNA sense strand
aucccccaugcugcuauggac

SEQ ID NO: 13276 - RNA, 21 nt, Artificial Sequence
  Ebola virus siRNA sense strand
ucccccaugcugcuauggacu

SEQ ID NO: 13277 - RNA, 21 nt, Artificial Sequence
  Ebola virus siRNA sense strand
cccccaugcugcuauggacug

SEQ ID NO: 13278 - RNA, 21 nt, Artificial Sequence
  Ebola virus siRNA sense strand
ccccaugcugcuauggacugg

SEQ ID NO: 13279 - RNA, 21 nt, Artificial Sequence
  Ebola virus siRNA sense strand
cccaugcugcuauggacuggu

SEQ ID NO: 13280 - RNA, 21 nt, Artificial Sequence
  Ebola virus siRNA sense strand
ccaugcugcuauggacuggua

SEQ ID NO: 13281 - RNA, 21 nt, Artificial Sequence
  Ebola virus siRNA sense strand
caugcugcuauggacugguau

SEQ ID NO: 13282 - RNA, 21 nt, Artificial Sequence
  Ebola virus siRNA sense strand
augcugcuauggacugguauc

SEQ ID NO: 13283 - RNA, 21 nt, Artificial Sequence
  Ebola virus siRNA sense strand
ugcugcuauggacugguauca

SEQ ID NO: 13284 - RNA, 21 nt, Artificial Sequence
  Ebola virus siRNA sense strand
gcugcuauggacugguaucag

SEQ ID NO: 13285 - RNA, 21 nt, Artificial Sequence
  Ebola virus siRNA sense strand
cugcuauggacugguaucagg

SEQ ID NO: 13286 - RNA, 21 nt, Artificial Sequence
  Ebola virus siRNA sense strand
ugcuauggacugguaucaggc

SEQ ID NO: 13287 - RNA, 21 nt, Artificial Sequence
  Ebola virus siRNA sense strand
gcuauggacugguaucaggca

SEQ ID NO: 13288 - RNA, 21 nt, Artificial Sequence
  Ebola virus siRNA sense strand
cuauggacugguaucaggcau

SEQ ID NO: 13289 - RNA, 21 nt, Artificial Sequence
  Ebola virus siRNA sense strand
uauggacugguaucaggcauc

SEQ ID NO: 13290 - RNA, 21 nt, Artificial Sequence
  Ebola virus siRNA sense strand
auggacugguaucaggcauca

SEQ ID NO: 13291 - RNA, 21 nt, Artificial Sequence
  Ebola virus siRNA sense strand
uggacugguaucaggcaucag

SEQ ID NO: 13292 - RNA, 21 nt, Artificial Sequence
  Ebola virus siRNA sense strand
ggacugguaucaggcaucagu

SEQ ID NO: 13293 - RNA, 21 nt, Artificial Sequence
  Ebola virus siRNA sense strand
gacugguaucaggcaucagua

SEQ ID NO: 13294 - RNA, 21 nt, Artificial Sequence
  Ebola virus siRNA sense strand
acugguaucaggcaucaguau

SEQ ID NO: 13295 - RNA, 21 nt, Artificial Sequence
  Ebola virus siRNA sense strand
cugguaucaggcaucaguauu

SEQ ID NO: 13296 - RNA, 21 nt, Artificial Sequence
  Ebola virus siRNA sense strand
ugguaucaggcaucaguauuc

SEQ ID NO: 13297 - RNA, 21 nt, Artificial Sequence
  Ebola virus siRNA sense strand
gguaucaggcaucaguauuca

SEQ ID NO: 13298 - RNA, 21 nt, Artificial Sequence
  Ebola virus siRNA sense strand
guaucaggcaucaguauucaa

SEQ ID NO: 13299 - RNA, 21 nt, Artificial Sequence
  Ebola virus siRNA sense strand
uaucaggcaucaguauucaaa

SEQ ID NO: 13300 - RNA, 21 nt, Artificial Sequence
  Ebola virus siRNA sense strand
aucaggcaucaguauucaaag

SEQ ID NO: 13301 - RNA, 21 nt, Artificial Sequence
  Ebola virus siRNA sense strand
ucaggcaucaguauucaaaga

SEQ ID NO: 13302 - RNA, 21 nt, Artificial Sequence
  Ebola virus siRNA sense strand
caggcaucaguauucaaagaa

SEQ ID NO: 13303 - RNA, 21 nt, Artificial Sequence
  Ebola virus siRNA sense strand
aggcaucaguauucaaagaag

SEQ ID NO: 13304 - RNA, 21 nt, Artificial Sequence
  Ebola virus siRNA sense strand
ggcaucaguauucaaagaagc

SEQ ID NO: 13305 - RNA, 21 nt, Artificial Sequence
  Ebola virus siRNA sense strand
gcaucaguauucaaagaagcg

SEQ ID NO: 13306 - RNA, 21 nt, Artificial Sequence
  Ebola virus siRNA sense strand
caucaguauucaaagaagcgg

SEQ ID NO: 13307 - RNA, 21 nt, Artificial Sequence
  Ebola virus siRNA sense strand
aucaguauucaaagaagcggu

SEQ ID NO: 13308 - RNA, 21 nt, Artificial Sequence
  Ebola virus siRNA sense strand
ucaguauucaaagaagcgguu

SEQ ID NO: 13309 - RNA, 21 nt, Artificial Sequence
  Ebola virus siRNA sense strand
caguauucaaagaagcgguuc

SEQ ID NO: 13310 - RNA, 21 nt, Artificial Sequence
  Ebola virus siRNA sense strand
aguauucaaagaagcgguuca

SEQ ID NO: 13311 - RNA, 21 nt, Artificial Sequence
  Ebola virus siRNA sense strand
guauucaaagaagcgguucaa

SEQ ID NO: 13312 - RNA, 21 nt, Artificial Sequence
  Ebola virus siRNA sense strand
uauucaaagaagcgguucaag

SEQ ID NO: 13313 - RNA, 21 nt, Artificial Sequence
  Ebola virus siRNA sense strand
auucaaagaagcgguucaagg

SEQ ID NO: 13314 - RNA, 21 nt, Artificial Sequence
  Ebola virus siRNA sense strand
uucaaagaagcgguucaaggg

SEQ ID NO: 13315 - RNA, 21 nt, Artificial Sequence
  Ebola virus siRNA sense strand
ucaaagaagcgguucaagggc

SEQ ID NO: 13316 - RNA, 21 nt, Artificial Sequence
  Ebola virus siRNA sense strand
caaagaagcgguucaagggca

SEQ ID NO: 13317 - RNA, 21 nt, Artificial Sequence
  Ebola virus siRNA sense strand
aaagaagcgguucaagggcau

SEQ ID NO: 13318 - RNA, 21 nt, Artificial Sequence
  Ebola virus siRNA sense strand
aagaagcgguucaagggcaua

SEQ ID NO: 13319 - RNA, 21 nt, Artificial Sequence
  Ebola virus siRNA sense strand
agaagcgguucaagggcauac

SEQ ID NO: 13320 - RNA, 21 nt, Artificial Sequence
  Ebola virus siRNA sense strand
gaagcgguucaagggcauaca

SEQ ID NO: 13321 - RNA, 21 nt, Artificial Sequence
  Ebola virus siRNA sense strand
aagcgguucaagggcauacac

SEQ ID NO: 13322 - RNA, 21 nt, Artificial Sequence
  Ebola virus siRNA sense strand
agcgguucaagggcauacaca

SEQ ID NO: 13323 - RNA, 21 nt, Artificial Sequence
  Ebola virus siRNA sense strand
gcgguucaagggcauacacac

SEQ ID NO: 13324 - RNA, 21 nt, Artificial Sequence
  Ebola virus siRNA sense strand
cgguucaagggcauacacaca

SEQ ID NO: 13325 - RNA, 21 nt, Artificial Sequence
  Ebola virus siRNA sense strand
gguucaagggcauacacacau

SEQ ID NO: 13326 - RNA, 21 nt, Artificial Sequence
  Ebola virus siRNA sense strand
guucaagggcauacacacauu

SEQ ID NO: 13327 - RNA, 21 nt, Artificial Sequence
  Ebola virus siRNA sense strand
uucaagggcauacacacauug

SEQ ID NO: 13328 - RNA, 21 nt, Artificial Sequence
  Ebola virus siRNA sense strand
ucaagggcauacacacauugu

SEQ ID NO: 13329 - RNA, 21 nt, Artificial Sequence
  Ebola virus siRNA sense strand
caagggcauacacacauuguu

SEQ ID NO: 13330 - RNA, 21 nt, Artificial Sequence
  Ebola virus siRNA sense strand
aagggcauacacacauuguuu

SEQ ID NO: 13331 - RNA, 21 nt, Artificial Sequence
  Ebola virus siRNA sense strand
agggcauacacacauuguuuc

SEQ ID NO: 13332 - RNA, 21 nt, Artificial Sequence
  Ebola virus siRNA sense strand
gggcauacacacauuguuucu

SEQ ID NO: 13333 - RNA, 21 nt, Artificial Sequence
  Ebola virus siRNA sense strand
ggcauacacacauuguuucug

SEQ ID NO: 13334 - RNA, 21 nt, Artificial Sequence
  Ebola virus siRNA sense strand
gcauacacacauuguuucugu

SEQ ID NO: 13335 - RNA, 21 nt, Artificial Sequence
  Ebola virus siRNA sense strand
cauacacacauuguuucuguu

SEQ ID NO: 13336 - RNA, 21 nt, Artificial Sequence
  Ebola virus siRNA sense strand
auacacacauuguuucuguuu

SEQ ID NO: 13337 - RNA, 21 nt, Artificial Sequence
  Ebola virus siRNA sense strand
uacacacauuguuucuguuuc

SEQ ID NO: 13338 - RNA, 21 nt, Artificial Sequence
  Ebola virus siRNA sense strand
acacacauuguuucuguuucu

SEQ ID NO: 13339 - RNA, 21 nt, Artificial Sequence
  Ebola virus siRNA sense strand
cacacauuguuucuguuucua

SEQ ID NO: 13340 - RNA, 21 nt, Artificial Sequence
  Ebola virus siRNA sense strand
acacauuguuucuguuucuac

SEQ ID NO: 13341 - RNA, 21 nt, Artificial Sequence
  Ebola virus siRNA sense strand
cacauuguuucuguuucuacu

SEQ ID NO: 13342 - RNA, 21 nt, Artificial Sequence
  Ebola virus siRNA sense strand
acauuguuucuguuucuacug

SEQ ID NO: 13343 - RNA, 21 nt, Artificial Sequence
  Ebola virus siRNA sense strand
cauuguuucuguuucuacugc

SEQ ID NO: 13344 - RNA, 21 nt, Artificial Sequence
  Ebola virus siRNA sense strand
auuguuucuguuucuacugcc

SEQ ID NO: 13345 - RNA, 21 nt, Artificial Sequence
  Ebola virus siRNA sense strand
uuguuucuguuucuacugccg

SEQ ID NO: 13346 - RNA, 21 nt, Artificial Sequence
  Ebola virus siRNA sense strand
uguuucuguuucuacugccga

SEQ ID NO: 13347 - RNA, 21 nt, Artificial Sequence
  Ebola virus siRNA sense strand
guuucuguuucuacugccgac

SEQ ID NO: 13348 - RNA, 21 nt, Artificial Sequence
  Ebola virus siRNA sense strand
uuucuguuucuacugccgacg

SEQ ID NO: 13349 - RNA, 21 nt, Artificial Sequence
  Ebola virus siRNA sense strand
uucuguuucuacugccgacgu

SEQ ID NO: 13350 - RNA, 21 nt, Artificial Sequence
  Ebola virus siRNA sense strand
ucuguuucuacugccgacguc

SEQ ID NO: 13351 - RNA, 21 nt, Artificial Sequence
  Ebola virus siRNA sense strand
cuguuucuacugccgacgucu

SEQ ID NO: 13352 - RNA, 21 nt, Artificial Sequence
  Ebola virus siRNA sense strand
uguuucuacugccgacgucuu

SEQ ID NO: 13353 - RNA, 21 nt, Artificial Sequence
  Ebola virus siRNA sense strand
guuucuacugccgacgucuug

SEQ ID NO: 13354 - RNA, 21 nt, Artificial Sequence
  Ebola virus siRNA sense strand
uuucuacugccgacgucuuga

SEQ ID NO: 13355 - RNA, 21 nt, Artificial Sequence
  Ebola virus siRNA sense strand
uucuacugccgacgucuugau

SEQ ID NO: 13356 - RNA, 21 nt, Artificial Sequence
  Ebola virus siRNA sense strand
ucuacugccgacgucuugaua

SEQ ID NO: 13357 - RNA, 21 nt, Artificial Sequence
  Ebola virus siRNA sense strand
cuacugccgacgucuugauaa

SEQ ID NO: 13358 - RNA, 21 nt, Artificial Sequence
  Ebola virus siRNA sense strand
uacugccgacgucuugauaau

SEQ ID NO: 13359 - RNA, 21 nt, Artificial Sequence
  Ebola virus siRNA sense strand
acugccgacgucuugauaaug

SEQ ID NO: 13360 - RNA, 21 nt, Artificial Sequence
  Ebola virus siRNA sense strand
cugccgacgucuugauaaugu

SEQ ID NO: 13361 - RNA, 21 nt, Artificial Sequence
  Ebola virus siRNA sense strand
ugccgacgucuugauaaugug

SEQ ID NO: 13362 - RNA, 21 nt, Artificial Sequence
  Ebola virus siRNA sense strand
gccgacgucuugauaaugugc

SEQ ID NO: 13363 - RNA, 21 nt, Artificial Sequence
  Ebola virus siRNA sense strand
ccgacgucuugauaaugugca

SEQ ID NO: 13364 - RNA, 21 nt, Artificial Sequence
  Ebola virus siRNA sense strand
cgacgucuugauaaugugcaa

SEQ ID NO: 13365 - RNA, 21 nt, Artificial Sequence
  Ebola virus siRNA sense strand
gacgucuugauaaugugcaaa

SEQ ID NO: 13366 - RNA, 21 nt, Artificial Sequence
  Ebola virus siRNA sense strand
acgucuugauaaugugcaaag

SEQ ID NO: 13367 - RNA, 21 nt, Artificial Sequence
  Ebola virus siRNA sense strand
cgucuugauaaugugcaaaga

SEQ ID NO: 13368 - RNA, 21 nt, Artificial Sequence
  Ebola virus siRNA sense strand
gucuugauaaugugcaaagau

SEQ ID NO: 13369 - RNA, 21 nt, Artificial Sequence
  Ebola virus siRNA sense strand
ucuugauaaugugcaaagauu

SEQ ID NO: 13370 - RNA, 21 nt, Artificial Sequence
  Ebola virus siRNA sense strand
cuugauaaugugcaaagauuu

SEQ ID NO: 13371 - RNA, 21 nt, Artificial Sequence
  Ebola virus siRNA sense strand
uugauaaugugcaaagauuua

SEQ ID NO: 13372 - RNA, 21 nt, Artificial Sequence
  Ebola virus siRNA sense strand
ugauaaugugcaaagauuuaa

SEQ ID NO: 13373 - RNA, 21 nt, Artificial Sequence
  Ebola virus siRNA sense strand
gauaaugugcaaagauuuaau

SEQ ID NO: 13374 - RNA, 21 nt, Artificial Sequence
  Ebola virus siRNA sense strand
auaaugugcaaagauuuaauu

SEQ ID NO: 13375 - RNA, 21 nt, Artificial Sequence
  Ebola virus siRNA sense strand
uaaugugcaaagauuuaauua

SEQ ID NO: 13376 - RNA, 21 nt, Artificial Sequence
  Ebola virus siRNA sense strand
aaugugcaaagauuuaauuac

SEQ ID NO: 13377 - RNA, 21 nt, Artificial Sequence
  Ebola virus siRNA sense strand
augugcaaagauuuaauuaca

SEQ ID NO: 13378 - RNA, 21 nt, Artificial Sequence
  Ebola virus siRNA sense strand
ugugcaaagauuuaauuacau

SEQ ID NO: 13379 - RNA, 21 nt, Artificial Sequence
  Ebola virus siRNA sense strand
gugcaaagauuuaauuacaug

SEQ ID NO: 13380 - RNA, 21 nt, Artificial Sequence
  Ebola virus siRNA sense strand
ugcaaagauuuaauuacaugu

SEQ ID NO: 13381 - RNA, 21 nt, Artificial Sequence
  Ebola virus siRNA sense strand
gcaaagauuuaauuacauguc

SEQ ID NO: 13382 - RNA, 21 nt, Artificial Sequence
  Ebola virus siRNA sense strand
caaagauuuaauuacaugucg

SEQ ID NO: 13383 - RNA, 21 nt, Artificial Sequence
  Ebola virus siRNA sense strand
aaagauuuaauuacaugucga

SEQ ID NO: 13384 - RNA, 21 nt, Artificial Sequence
  Ebola virus siRNA sense strand
aagauuuaauuacaugucgau

SEQ ID NO: 13385 - RNA, 21 nt, Artificial Sequence
  Ebola virus siRNA sense strand
agauuuaauuacaugucgauu

SEQ ID NO: 13386 - RNA, 21 nt, Artificial Sequence
  Ebola virus siRNA sense strand
gauuuaauuacaugucgauuc

SEQ ID NO: 13387 - RNA, 21 nt, Artificial Sequence
  Ebola virus siRNA sense strand
auuuaauuacaugucgauuca

SEQ ID NO: 13388 - RNA, 21 nt, Artificial Sequence
  Ebola virus siRNA sense strand
uuuaauuacaugucgauucaa

SEQ ID NO: 13389 - RNA, 21 nt, Artificial Sequence
  Ebola virus siRNA sense strand
uuaauuacaugucgauucaac

SEQ ID NO: 13390 - RNA, 21 nt, Artificial Sequence
  Ebola virus siRNA sense strand
uaauuacaugucgauucaaca

SEQ ID NO: 13391 - RNA, 21 nt, Artificial Sequence
  Ebola virus siRNA sense strand
aauuacaugucgauucaacac

SEQ ID NO: 13392 - RNA, 21 nt, Artificial Sequence
  Ebola virus siRNA sense strand
auuacaugucgauucaacaca

SEQ ID NO: 13393 - RNA, 21 nt, Artificial Sequence
  Ebola virus siRNA sense strand
uuacaugucgauucaacacaa

SEQ ID NO: 13394 - RNA, 21 nt, Artificial Sequence
  Ebola virus siRNA sense strand
uacaugucgauucaacacaac

SEQ ID NO: 13395 - RNA, 21 nt, Artificial Sequence
  Ebola virus siRNA sense strand
acaugucgauucaacacaacu

SEQ ID NO: 13396 - RNA, 21 nt, Artificial Sequence
  Ebola virus siRNA sense strand
caugucgauucaacacaacuc

SEQ ID NO: 13397 - RNA, 21 nt, Artificial Sequence
  Ebola virus siRNA sense strand
augucgauucaacacaacucu

SEQ ID NO: 13398 - RNA, 21 nt, Artificial Sequence
  Ebola virus siRNA sense strand
ugucgauucaacacaacucua

SEQ ID NO: 13399 - RNA, 21 nt, Artificial Sequence
  Ebola virus siRNA sense strand
gucgauucaacacaacucuaa

SEQ ID NO: 13400 - RNA, 21 nt, Artificial Sequence
  Ebola virus siRNA sense strand
ucgauucaacacaacucuaau

SEQ ID NO: 13401 - RNA, 21 nt, Artificial Sequence
  Ebola virus siRNA sense strand
cgauucaacacaacucuaauc

SEQ ID NO: 13402 - RNA, 21 nt, Artificial Sequence
  Ebola virus siRNA sense strand
gauucaacacaacucuaaucu

SEQ ID NO: 13403 - RNA, 21 nt, Artificial Sequence
  Ebola virus siRNA sense strand
auucaacacaacucuaaucuc

SEQ ID NO: 13404 - RNA, 21 nt, Artificial Sequence
  Ebola virus siRNA sense strand
uucaacacaacucuaaucuca

SEQ ID NO: 13405 - RNA, 21 nt, Artificial Sequence
  Ebola virus siRNA sense strand
ucaacacaacucuaaucucaa

SEQ ID NO: 13406 - RNA, 21 nt, Artificial Sequence
  Ebola virus siRNA sense strand
caacacaacucuaaucucaaa

SEQ ID NO: 13407 - RNA, 21 nt, Artificial Sequence
  Ebola virus siRNA sense strand
aacacaacucuaaucucaaaa

SEQ ID NO: 13408 - RNA, 21 nt, Artificial Sequence
  Ebola virus siRNA sense strand
acacaacucuaaucucaaaaa

SEQ ID NO: 13409 - RNA, 21 nt, Artificial Sequence
  Ebola virus siRNA sense strand
cacaacucuaaucucaaaaau

SEQ ID NO: 13410 - RNA, 21 nt, Artificial Sequence
  Ebola virus siRNA sense strand
acaacucuaaucucaaaaaua

SEQ ID NO: 13411 - RNA, 21 nt, Artificial Sequence
  Ebola virus siRNA sense strand
caacucuaaucucaaaaauag

SEQ ID NO: 13412 - RNA, 21 nt, Artificial Sequence
  Ebola virus siRNA sense strand
aacucuaaucucaaaaauagc

SEQ ID NO: 13413 - RNA, 21 nt, Artificial Sequence
  Ebola virus siRNA sense strand
acucuaaucucaaaaauagca

SEQ ID NO: 13414 - RNA, 21 nt, Artificial Sequence
  Ebola virus siRNA sense strand
cucuaaucucaaaaauagcag

SEQ ID NO: 13415 - RNA, 21 nt, Artificial Sequence
  Ebola virus siRNA sense strand
ucuaaucucaaaaauagcaga

SEQ ID NO: 13416 - RNA, 21 nt, Artificial Sequence
  Ebola virus siRNA sense strand
cuaaucucaaaaauagcagag

SEQ ID NO: 13417 - RNA, 21 nt, Artificial Sequence
  Ebola virus siRNA sense strand
uaaucucaaaaauagcagaga

SEQ ID NO: 13418 - RNA, 21 nt, Artificial Sequence
  Ebola virus siRNA sense strand
aaucucaaaaauagcagagau

SEQ ID NO: 13419 - RNA, 21 nt, Artificial Sequence
  Ebola virus siRNA sense strand
aucucaaaaauagcagagauu

SEQ ID NO: 13420 - RNA, 21 nt, Artificial Sequence
  Ebola virus siRNA sense strand
ucucaaaaauagcagagauug

SEQ ID NO: 13421 - RNA, 21 nt, Artificial Sequence
  Ebola virus siRNA sense strand
cucaaaaauagcagagauuga

SEQ ID NO: 13422 - RNA, 21 nt, Artificial Sequence
  Ebola virus siRNA sense strand
ucaaaaauagcagagauugag

SEQ ID NO: 13423 - RNA, 21 nt, Artificial Sequence
  Ebola virus siRNA sense strand
caaaaauagcagagauugagg

SEQ ID NO: 13424 - RNA, 21 nt, Artificial Sequence
  Ebola virus siRNA sense strand
aaaaauagcagagauugagga

SEQ ID NO: 13425 - RNA, 21 nt, Artificial Sequence
  Ebola virus siRNA sense strand
aaaauagcagagauugaggau

SEQ ID NO: 13426 - RNA, 21 nt, Artificial Sequence
  Ebola virus siRNA sense strand
aaauagcagagauugaggauc

SEQ ID NO: 13427 - RNA, 21 nt, Artificial Sequence
  Ebola virus siRNA sense strand
aauagcagagauugaggaucc

SEQ ID NO: 13428 - RNA, 21 nt, Artificial Sequence
  Ebola virus siRNA sense strand
auagcagagauugaggaucca

SEQ ID NO: 13429 - RNA, 21 nt, Artificial Sequence
  Ebola virus siRNA sense strand
uagcagagauugaggauccag

SEQ ID NO: 13430 - RNA, 21 nt, Artificial Sequence
  Ebola virus siRNA sense strand
agcagagauugaggauccagu

SEQ ID NO: 13431 - RNA, 21 nt, Artificial Sequence
  Ebola virus siRNA sense strand
gcagagauugaggauccaguu

SEQ ID NO: 13432 - RNA, 21 nt, Artificial Sequence
  Ebola virus siRNA sense strand
cagagauugaggauccaguuu

SEQ ID NO: 13433 - RNA, 21 nt, Artificial Sequence
  Ebola virus siRNA sense strand
agagauugaggauccaguuug

SEQ ID NO: 13434 - RNA, 21 nt, Artificial Sequence
  Ebola virus siRNA sense strand
gagauugaggauccaguuugu

SEQ ID NO: 13435 - RNA, 21 nt, Artificial Sequence
  Ebola virus siRNA sense strand
agauugaggauccaguuuguu

SEQ ID NO: 13436 - RNA, 21 nt, Artificial Sequence
  Ebola virus siRNA sense strand
gauugaggauccaguuuguuc

SEQ ID NO: 13437 - RNA, 21 nt, Artificial Sequence
  Ebola virus siRNA sense strand
auugaggauccaguuuguucu

SEQ ID NO: 13438 - RNA, 21 nt, Artificial Sequence
  Ebola virus siRNA sense strand
uugaggauccaguuuguucug

SEQ ID NO: 13439 - RNA, 21 nt, Artificial Sequence
  Ebola virus siRNA sense strand
ugaggauccaguuuguucuga

SEQ ID NO: 13440 - RNA, 21 nt, Artificial Sequence
  Ebola virus siRNA sense strand
gaggauccaguuuguucugau

SEQ ID NO: 13441 - RNA, 21 nt, Artificial Sequence
  Ebola virus siRNA sense strand
aggauccaguuuguucugauu

SEQ ID NO: 13442 - RNA, 21 nt, Artificial Sequence
  Ebola virus siRNA sense strand
ggauccaguuuguucugauua

SEQ ID NO: 13443 - RNA, 21 nt, Artificial Sequence
  Ebola virus siRNA sense strand
gauccaguuuguucugauuau

SEQ ID NO: 13444 - RNA, 21 nt, Artificial Sequence
  Ebola virus siRNA sense strand
auccaguuuguucugauuauc

SEQ ID NO: 13445 - RNA, 21 nt, Artificial Sequence
  Ebola virus siRNA sense strand
uccaguuuguucugauuaucc

SEQ ID NO: 13446 - RNA, 21 nt, Artificial Sequence
  Ebola virus siRNA sense strand
ccaguuuguucugauuauccc

SEQ ID NO: 13447 - RNA, 21 nt, Artificial Sequence
  Ebola virus siRNA sense strand
caguuuguucugauuauccca

SEQ ID NO: 13448 - RNA, 21 nt, Artificial Sequence
  Ebola virus siRNA sense strand
aguuuguucugauuaucccaa

SEQ ID NO: 13449 - RNA, 21 nt, Artificial Sequence
  Ebola virus siRNA sense strand
guuuguucugauuaucccaau

SEQ ID NO: 13450 - RNA, 21 nt, Artificial Sequence
  Ebola virus siRNA sense strand
uuuguucugauuaucccaauu

SEQ ID NO: 13451 - RNA, 21 nt, Artificial Sequence
  Ebola virus siRNA sense strand
uuguucugauuaucccaauuu

SEQ ID NO: 13452 - RNA, 21 nt, Artificial Sequence
  Ebola virus siRNA sense strand
uguucugauuaucccaauuuu

SEQ ID NO: 13453 - RNA, 21 nt, Artificial Sequence
  Ebola virus siRNA sense strand
guucugauuaucccaauuuua

SEQ ID NO: 13454 - RNA, 21 nt, Artificial Sequence
  Ebola virus siRNA sense strand
uucugauuaucccaauuuuaa

SEQ ID NO: 13455 - RNA, 21 nt, Artificial Sequence
  Ebola virus siRNA sense strand
ucugauuaucccaauuuuaag

SEQ ID NO: 13456 - RNA, 21 nt, Artificial Sequence
  Ebola virus siRNA sense strand
cugauuaucccaauuuuaaga

SEQ ID NO: 13457 - RNA, 21 nt, Artificial Sequence
  Ebola virus siRNA sense strand
ugauuaucccaauuuuaagau

SEQ ID NO: 13458 - RNA, 21 nt, Artificial Sequence
  Ebola virus siRNA sense strand
gauuaucccaauuuuaagauu

SEQ ID NO: 13459 - RNA, 21 nt, Artificial Sequence
  Ebola virus siRNA sense strand
auuaucccaauuuuaagauug

SEQ ID NO: 13460 - RNA, 21 nt, Artificial Sequence
  Ebola virus siRNA sense strand
uuaucccaauuuuaagauugu

SEQ ID NO: 13461 - RNA, 21 nt, Artificial Sequence
  Ebola virus siRNA sense strand
uaucccaauuuuaagauugug

SEQ ID NO: 13462 - RNA, 21 nt, Artificial Sequence
  Ebola virus siRNA sense strand
aucccaauuuuaagauugugu

SEQ ID NO: 13463 - RNA, 21 nt, Artificial Sequence
  Ebola virus siRNA sense strand
ucccaauuuuaagauuguguc

SEQ ID NO: 13464 - RNA, 21 nt, Artificial Sequence
  Ebola virus siRNA sense strand
cccaauuuuaagauugugucu

SEQ ID NO: 13465 - RNA, 21 nt, Artificial Sequence
  Ebola virus siRNA sense strand
ccaauuuuaagauugugucua

SEQ ID NO: 13466 - RNA, 21 nt, Artificial Sequence
  Ebola virus siRNA sense strand
caauuuuaagauugugucuau

SEQ ID NO: 13467 - RNA, 21 nt, Artificial Sequence
  Ebola virus siRNA sense strand
aauuuuaagauugugucuaug

SEQ ID NO: 13468 - RNA, 21 nt, Artificial Sequence
  Ebola virus siRNA sense strand
auuuuaagauugugucuaugc

SEQ ID NO: 13469 - RNA, 21 nt, Artificial Sequence
  Ebola virus siRNA sense strand
uuuuaagauugugucuaugcu

SEQ ID NO: 13470 - RNA, 21 nt, Artificial Sequence
  Ebola virus siRNA sense strand
uuuaagauugugucuaugcuu

SEQ ID NO: 13471 - RNA, 21 nt, Artificial Sequence
  Ebola virus siRNA sense strand
uuaagauugugucuaugcuuu

SEQ ID NO: 13472 - RNA, 21 nt, Artificial Sequence
  Ebola virus siRNA sense strand
uaagauugugucuaugcuuua

SEQ ID NO: 13473 - RNA, 21 nt, Artificial Sequence
  Ebola virus siRNA sense strand
aagauugugucuaugcuuuac

SEQ ID NO: 13474 - RNA, 21 nt, Artificial Sequence
  Ebola virus siRNA sense strand
agauugugucuaugcuuuacc

SEQ ID NO: 13475 - RNA, 21 nt, Artificial Sequence
  Ebola virus siRNA sense strand
gauugugucuaugcuuuacca

SEQ ID NO: 13476 - RNA, 21 nt, Artificial Sequence
  Ebola virus siRNA sense strand
auugugucuaugcuuuaccag

SEQ ID NO: 13477 - RNA, 21 nt, Artificial Sequence
  Ebola virus siRNA sense strand
uugugucuaugcuuuaccaga

SEQ ID NO: 13478 - RNA, 21 nt, Artificial Sequence
  Ebola virus siRNA sense strand
ugugucuaugcuuuaccagag

SEQ ID NO: 13479 - RNA, 21 nt, Artificial Sequence
  Ebola virus siRNA sense strand
gugucuaugcuuuaccagagc

SEQ ID NO: 13480 - RNA, 21 nt, Artificial Sequence
  Ebola virus siRNA sense strand
ugucuaugcuuuaccagagcg

SEQ ID NO: 13481 - RNA, 21 nt, Artificial Sequence
  Ebola virus siRNA sense strand
gucuaugcuuuaccagagcgg

SEQ ID NO: 13482 - RNA, 21 nt, Artificial Sequence
  Ebola virus siRNA sense strand
ucuaugcuuuaccagagcgga

SEQ ID NO: 13483 - RNA, 21 nt, Artificial Sequence
  Ebola virus siRNA sense strand
cuaugcuuuaccagagcggag

SEQ ID NO: 13484 - RNA, 21 nt, Artificial Sequence
  Ebola virus siRNA sense strand
uaugcuuuaccagagcggaga

SEQ ID NO: 13485 - RNA, 21 nt, Artificial Sequence
  Ebola virus siRNA sense strand
augcuuuaccagagcggagau

SEQ ID NO: 13486 - RNA, 21 nt, Artificial Sequence
  Ebola virus siRNA sense strand
ugcuuuaccagagcggagauu

SEQ ID NO: 13487 - RNA, 21 nt, Artificial Sequence
  Ebola virus siRNA sense strand
gcuuuaccagagcggagauua

SEQ ID NO: 13488 - RNA, 21 nt, Artificial Sequence
  Ebola virus siRNA sense strand
cuuuaccagagcggagauuac

SEQ ID NO: 13489 - RNA, 21 nt, Artificial Sequence
  Ebola virus siRNA sense strand
uuuaccagagcggagauuacu

SEQ ID NO: 13490 - RNA, 21 nt, Artificial Sequence
  Ebola virus siRNA sense strand
uuaccagagcggagauuacuu

SEQ ID NO: 13491 - RNA, 21 nt, Artificial Sequence
  Ebola virus siRNA sense strand
uaccagagcggagauuacuua

SEQ ID NO: 13492 - RNA, 21 nt, Artificial Sequence
  Ebola virus siRNA sense strand
accagagcggagauuacuuac

SEQ ID NO: 13493 - RNA, 21 nt, Artificial Sequence
  Ebola virus siRNA sense strand
ccagagcggagauuacuuacu

SEQ ID NO: 13494 - RNA, 21 nt, Artificial Sequence
  Ebola virus siRNA sense strand
cagagcggagauuacuuacuc

SEQ ID NO: 13495 - RNA, 21 nt, Artificial Sequence
  Ebola virus siRNA sense strand
agagcggagauuacuuacucu

SEQ ID NO: 13496 - RNA, 21 nt, Artificial Sequence
  Ebola virus siRNA sense strand
gagcggagauuacuuacucuc

SEQ ID NO: 13497 - RNA, 21 nt, Artificial Sequence
  Ebola virus siRNA sense strand
agcggagauuacuuacucucc

SEQ ID NO: 13498 - RNA, 21 nt, Artificial Sequence
  Ebola virus siRNA sense strand
gcggagauuacuuacucucca

SEQ ID NO: 13499 - RNA, 21 nt, Artificial Sequence
  Ebola virus siRNA sense strand
cggagauuacuuacucuccau

SEQ ID NO: 13500 - RNA, 21 nt, Artificial Sequence
  Ebola virus siRNA sense strand
ggagauuacuuacucuccaua

SEQ ID NO: 13501 - RNA, 21 nt, Artificial Sequence
  Ebola virus siRNA sense strand
gagauuacuuacucuccauau

SEQ ID NO: 13502 - RNA, 21 nt, Artificial Sequence
  Ebola virus siRNA sense strand
agauuacuuacucuccauauu

SEQ ID NO: 13503 - RNA, 21 nt, Artificial Sequence
  Ebola virus siRNA sense strand
gauuacuuacucuccauauua

SEQ ID NO: 13504 - RNA, 21 nt, Artificial Sequence
  Ebola virus siRNA sense strand
auuacuuacucuccauauuag

SEQ ID NO: 13505 - RNA, 21 nt, Artificial Sequence
  Ebola virus siRNA sense strand
uuacuuacucuccauauuagg

SEQ ID NO: 13506 - RNA, 21 nt, Artificial Sequence
  Ebola virus siRNA sense strand
uacuuacucuccauauuaggg

SEQ ID NO: 13507 - RNA, 21 nt, Artificial Sequence
  Ebola virus siRNA sense strand
acuuacucuccauauuagggu

SEQ ID NO: 13508 - RNA, 21 nt, Artificial Sequence
  Ebola virus siRNA sense strand
cuuacucuccauauuaggguc

SEQ ID NO: 13509 - RNA, 21 nt, Artificial Sequence
  Ebola virus siRNA sense strand
uuacucuccauauuagggucu

SEQ ID NO: 13510 - RNA, 21 nt, Artificial Sequence
  Ebola virus siRNA sense strand
uacucuccauauuagggucug

SEQ ID NO: 13511 - RNA, 21 nt, Artificial Sequence
  Ebola virus siRNA sense strand
acucuccauauuagggucuga

SEQ ID NO: 13512 - RNA, 21 nt, Artificial Sequence
  Ebola virus siRNA sense strand
cucuccauauuagggucugau

SEQ ID NO: 13513 - RNA, 21 nt, Artificial Sequence
  Ebola virus siRNA sense strand
ucuccauauuagggucugaug

SEQ ID NO: 13514 - RNA, 21 nt, Artificial Sequence
  Ebola virus siRNA sense strand
cuccauauuagggucugaugg

SEQ ID NO: 13515 - RNA, 21 nt, Artificial Sequence
  Ebola virus siRNA sense strand
uccauauuagggucugauggg

SEQ ID NO: 13516 - RNA, 21 nt, Artificial Sequence
  Ebola virus siRNA sense strand
ccauauuagggucugaugggu

SEQ ID NO: 13517 - RNA, 21 nt, Artificial Sequence
  Ebola virus siRNA sense strand
cauauuagggucugaugggua

SEQ ID NO: 13518 - RNA, 21 nt, Artificial Sequence
  Ebola virus siRNA sense strand
auauuagggucugauggguau

SEQ ID NO: 13519 - RNA, 21 nt, Artificial Sequence
  Ebola virus siRNA sense strand
uauuagggucugauggguaua

SEQ ID NO: 13520 - RNA, 21 nt, Artificial Sequence
  Ebola virus siRNA sense strand
auuagggucugauggguauaa

SEQ ID NO: 13521 - RNA, 21 nt, Artificial Sequence
  Ebola virus siRNA sense strand
uuagggucugauggguauaaa

SEQ ID NO: 13522 - RNA, 21 nt, Artificial Sequence
  Ebola virus siRNA sense strand
uagggucugauggguauaaaa

SEQ ID NO: 13523 - RNA, 21 nt, Artificial Sequence
  Ebola virus siRNA sense strand
agggucugauggguauaaaau

SEQ ID NO: 13524 - RNA, 21 nt, Artificial Sequence
  Ebola virus siRNA sense strand
gggucugauggguauaaaauu

SEQ ID NO: 13525 - RNA, 21 nt, Artificial Sequence
  Ebola virus siRNA sense strand
ggucugauggguauaaaauua

SEQ ID NO: 13526 - RNA, 21 nt, Artificial Sequence
  Ebola virus siRNA sense strand
gucugauggguauaaaauuau

SEQ ID NO: 13527 - RNA, 21 nt, Artificial Sequence
  Ebola virus siRNA sense strand
ucugauggguauaaaauuauu

SEQ ID NO: 13528 - RNA, 21 nt, Artificial Sequence
  Ebola virus siRNA sense strand
cugauggguauaaaauuauua

SEQ ID NO: 13529 - RNA, 21 nt, Artificial Sequence
  Ebola virus siRNA sense strand
ugauggguauaaaauuauuaa

SEQ ID NO: 13530 - RNA, 21 nt, Artificial Sequence
  Ebola virus siRNA sense strand
gauggguauaaaauuauuaag

SEQ ID NO: 13531 - RNA, 21 nt, Artificial Sequence
  Ebola virus siRNA sense strand
auggguauaaaauuauuaagu

SEQ ID NO: 13532 - RNA, 21 nt, Artificial Sequence
  Ebola virus siRNA sense strand
uggguauaaaauuauuaaguu

SEQ ID NO: 13533 - RNA, 21 nt, Artificial Sequence
  Ebola virus siRNA sense strand
ggguauaaaauuauuaaguuc

SEQ ID NO: 13534 - RNA, 21 nt, Artificial Sequence
  Ebola virus siRNA sense strand
gguauaaaauuauuaaguucc

SEQ ID NO: 13535 - RNA, 21 nt, Artificial Sequence
  Ebola virus siRNA sense strand
guauaaaauuauuaaguuccu

SEQ ID NO: 13536 - RNA, 21 nt, Artificial Sequence
  Ebola virus siRNA sense strand
uauaaaauuauuaaguuccuc

SEQ ID NO: 13537 - RNA, 21 nt, Artificial Sequence
  Ebola virus siRNA sense strand
auaaaauuauuaaguuccucg

SEQ ID NO: 13538 - RNA, 21 nt, Artificial Sequence
  Ebola virus siRNA sense strand
uaaaauuauuaaguuccucga

SEQ ID NO: 13539 - RNA, 21 nt, Artificial Sequence
  Ebola virus siRNA sense strand
aaaauuauuaaguuccucgaa

SEQ ID NO: 13540 - RNA, 21 nt, Artificial Sequence
  Ebola virus siRNA sense strand
aaauuauuaaguuccucgaac

SEQ ID NO: 13541 - RNA, 21 nt, Artificial Sequence
  Ebola virus siRNA sense strand
aauuauuaaguuccucgaacc

SEQ ID NO: 13542 - RNA, 21 nt, Artificial Sequence
  Ebola virus siRNA sense strand
auuauuaaguuccucgaacca

SEQ ID NO: 13543 - RNA, 21 nt, Artificial Sequence
  Ebola virus siRNA sense strand
uuauuaaguuccucgaaccau

SEQ ID NO: 13544 - RNA, 21 nt, Artificial Sequence
  Ebola virus siRNA sense strand
uauuaaguuccucgaaccauu

SEQ ID NO: 13545 - RNA, 21 nt, Artificial Sequence
  Ebola virus siRNA sense strand
auuaaguuccucgaaccauug

SEQ ID NO: 13546 - RNA, 21 nt, Artificial Sequence
  Ebola virus siRNA sense strand
uuaaguuccucgaaccauugu

SEQ ID NO: 13547 - RNA, 21 nt, Artificial Sequence
  Ebola virus siRNA sense strand
uaaguuccucgaaccauugug

SEQ ID NO: 13548 - RNA, 21 nt, Artificial Sequence
  Ebola virus siRNA sense strand
aaguuccucgaaccauugugc

SEQ ID NO: 13549 - RNA, 21 nt, Artificial Sequence
  Ebola virus siRNA sense strand
aguuccucgaaccauugugcu

SEQ ID NO: 13550 - RNA, 21 nt, Artificial Sequence
  Ebola virus siRNA sense strand
guuccucgaaccauugugcuu

SEQ ID NO: 13551 - RNA, 21 nt, Artificial Sequence
  Ebola virus siRNA sense strand
uuccucgaaccauugugcuug

SEQ ID NO: 13552 - RNA, 21 nt, Artificial Sequence
  Ebola virus siRNA sense strand
uccucgaaccauugugcuugg

SEQ ID NO: 13553 - RNA, 21 nt, Artificial Sequence
  Ebola virus siRNA sense strand
ccucgaaccauugugcuuggc

SEQ ID NO: 13554 - RNA, 21 nt, Artificial Sequence
  Ebola virus siRNA sense strand
cucgaaccauugugcuuggcc

SEQ ID NO: 13555 - RNA, 21 nt, Artificial Sequence
  Ebola virus siRNA sense strand
ucgaaccauugugcuuggcca

SEQ ID NO: 13556 - RNA, 21 nt, Artificial Sequence
  Ebola virus siRNA sense strand
cgaaccauugugcuuggccaa

SEQ ID NO: 13557 - RNA, 21 nt, Artificial Sequence
  Ebola virus siRNA sense strand
gaaccauugugcuuggccaaa

SEQ ID NO: 13558 - RNA, 21 nt, Artificial Sequence
  Ebola virus siRNA sense strand
aaccauugugcuuggccaaaa

SEQ ID NO: 13559 - RNA, 21 nt, Artificial Sequence
  Ebola virus siRNA sense strand
accauugugcuuggccaaaau

SEQ ID NO: 13560 - RNA, 21 nt, Artificial Sequence
  Ebola virus siRNA sense strand
ccauugugcuuggccaaaauu

SEQ ID NO: 13561 - RNA, 21 nt, Artificial Sequence
  Ebola virus siRNA sense strand
cauugugcuuggccaaaauuc

SEQ ID NO: 13562 - RNA, 21 nt, Artificial Sequence
  Ebola virus siRNA sense strand
auugugcuuggccaaaauuca

SEQ ID NO: 13563 - RNA, 21 nt, Artificial Sequence
  Ebola virus siRNA sense strand
uugugcuuggccaaaauucaa

SEQ ID NO: 13564 - RNA, 21 nt, Artificial Sequence
  Ebola virus siRNA sense strand
ugugcuuggccaaaauucaau

SEQ ID NO: 13565 - RNA, 21 nt, Artificial Sequence
  Ebola virus siRNA sense strand
gugcuuggccaaaauucaauu

SEQ ID NO: 13566 - RNA, 21 nt, Artificial Sequence
  Ebola virus siRNA sense strand
ugcuuggccaaaauucaauua

SEQ ID NO: 13567 - RNA, 21 nt, Artificial Sequence
  Ebola virus siRNA sense strand
gcuuggccaaaauucaauuau

SEQ ID NO: 13568 - RNA, 21 nt, Artificial Sequence
  Ebola virus siRNA sense strand
cuuggccaaaauucaauuaug

SEQ ID NO: 13569 - RNA, 21 nt, Artificial Sequence
  Ebola virus siRNA sense strand
uuggccaaaauucaauuaugc

SEQ ID NO: 13570 - RNA, 21 nt, Artificial Sequence
  Ebola virus siRNA sense strand
uggccaaaauucaauuaugcu

SEQ ID NO: 13571 - RNA, 21 nt, Artificial Sequence
  Ebola virus siRNA sense strand
ggccaaaauucaauuaugcuc

SEQ ID NO: 13572 - RNA, 21 nt, Artificial Sequence
  Ebola virus siRNA sense strand
gccaaaauucaauuaugcuca

SEQ ID NO: 13573 - RNA, 21 nt, Artificial Sequence
  Ebola virus siRNA sense strand
ccaaaauucaauuaugcucaa

SEQ ID NO: 13574 - RNA, 21 nt, Artificial Sequence
  Ebola virus siRNA sense strand
caaaauucaauuaugcucaaa

SEQ ID NO: 13575 - RNA, 21 nt, Artificial Sequence
  Ebola virus siRNA sense strand
aaaauucaauuaugcucaaag

SEQ ID NO: 13576 - RNA, 21 nt, Artificial Sequence
  Ebola virus siRNA sense strand
aaauucaauuaugcucaaagu

SEQ ID NO: 13577 - RNA, 21 nt, Artificial Sequence
  Ebola virus siRNA sense strand
aauucaauuaugcucaaagua

SEQ ID NO: 13578 - RNA, 21 nt, Artificial Sequence
  Ebola virus siRNA sense strand
auucaauuaugcucaaaguac

SEQ ID NO: 13579 - RNA, 21 nt, Artificial Sequence
  Ebola virus siRNA sense strand
uucaauuaugcucaaaguaca

SEQ ID NO: 13580 - RNA, 21 nt, Artificial Sequence
  Ebola virus siRNA sense strand
ucaauuaugcucaaaguacac

SEQ ID NO: 13581 - RNA, 21 nt, Artificial Sequence
  Ebola virus siRNA sense strand
caauuaugcucaaaguacacu

SEQ ID NO: 13582 - RNA, 21 nt, Artificial Sequence
  Ebola virus siRNA sense strand
aauuaugcucaaaguacacug

SEQ ID NO: 13583 - RNA, 21 nt, Artificial Sequence
  Ebola virus siRNA sense strand
auuaugcucaaaguacacuga

SEQ ID NO: 13584 - RNA, 21 nt, Artificial Sequence
  Ebola virus siRNA sense strand
uuaugcucaaaguacacugag

SEQ ID NO: 13585 - RNA, 21 nt, Artificial Sequence
  Ebola virus siRNA sense strand
uaugcucaaaguacacugaga

SEQ ID NO: 13586 - RNA, 21 nt, Artificial Sequence
  Ebola virus siRNA sense strand
augcucaaaguacacugagag

SEQ ID NO: 13587 - RNA, 21 nt, Artificial Sequence
  Ebola virus siRNA sense strand
ugcucaaaguacacugagagg

SEQ ID NO: 13588 - RNA, 21 nt, Artificial Sequence
  Ebola virus siRNA sense strand
gcucaaaguacacugagagga

SEQ ID NO: 13589 - RNA, 21 nt, Artificial Sequence
  Ebola virus siRNA sense strand
cucaaaguacacugagaggaa

SEQ ID NO: 13590 - RNA, 21 nt, Artificial Sequence
  Ebola virus siRNA sense strand
ucaaaguacacugagaggaag

SEQ ID NO: 13591 - RNA, 21 nt, Artificial Sequence
  Ebola virus siRNA sense strand
caaaguacacugagaggaagg

SEQ ID NO: 13592 - RNA, 21 nt, Artificial Sequence
  Ebola virus siRNA sense strand
aaaguacacugagaggaaggg

SEQ ID NO: 13593 - RNA, 21 nt, Artificial Sequence
  Ebola virus siRNA sense strand
aaguacacugagaggaagggc

SEQ ID NO: 13594 - RNA, 21 nt, Artificial Sequence
  Ebola virus siRNA sense strand
aguacacugagaggaagggcc

SEQ ID NO: 13595 - RNA, 21 nt, Artificial Sequence
  Ebola virus siRNA sense strand
guacacugagaggaagggccg

SEQ ID NO: 13596 - RNA, 21 nt, Artificial Sequence
  Ebola virus siRNA sense strand
uacacugagaggaagggccga

SEQ ID NO: 13597 - RNA, 21 nt, Artificial Sequence
  Ebola virus siRNA sense strand
acacugagaggaagggccgau

SEQ ID NO: 13598 - RNA, 21 nt, Artificial Sequence
  Ebola virus siRNA sense strand
cacugagaggaagggccgauu

SEQ ID NO: 13599 - RNA, 21 nt, Artificial Sequence
  Ebola virus siRNA sense strand
acugagaggaagggccgauuc

SEQ ID NO: 13600 - RNA, 21 nt, Artificial Sequence
  Ebola virus siRNA sense strand
cugagaggaagggccgauucu

SEQ ID NO: 13601 - RNA, 21 nt, Artificial Sequence
  Ebola virus siRNA sense strand
ugagaggaagggccgauucuu

SEQ ID NO: 13602 - RNA, 21 nt, Artificial Sequence
  Ebola virus siRNA sense strand
gagaggaagggccgauucuua

SEQ ID NO: 13603 - RNA, 21 nt, Artificial Sequence
  Ebola virus siRNA sense strand
agaggaagggccgauucuuaa

SEQ ID NO: 13604 - RNA, 21 nt, Artificial Sequence
  Ebola virus siRNA sense strand
gaggaagggccgauucuuaac

SEQ ID NO: 13605 - RNA, 21 nt, Artificial Sequence
  Ebola virus siRNA sense strand
aggaagggccgauucuuaaca

SEQ ID NO: 13606 - RNA, 21 nt, Artificial Sequence
  Ebola virus siRNA sense strand
ggaagggccgauucuuaacac

SEQ ID NO: 13607 - RNA, 21 nt, Artificial Sequence
  Ebola virus siRNA sense strand
gaagggccgauucuuaacaca

SEQ ID NO: 13608 - RNA, 21 nt, Artificial Sequence
  Ebola virus siRNA sense strand
aagggccgauucuuaacacaa

SEQ ID NO: 13609 - RNA, 21 nt, Artificial Sequence
  Ebola virus siRNA sense strand
agggccgauucuuaacacaaa

SEQ ID NO: 13610 - RNA, 21 nt, Artificial Sequence
  Ebola virus siRNA sense strand
gggccgauucuuaacacaaau

SEQ ID NO: 13611 - RNA, 21 nt, Artificial Sequence
  Ebola virus siRNA sense strand
ggccgauucuuaacacaaaug

SEQ ID NO: 13612 - RNA, 21 nt, Artificial Sequence
  Ebola virus siRNA sense strand
gccgauucuuaacacaaaugc

SEQ ID NO: 13613 - RNA, 21 nt, Artificial Sequence
  Ebola virus siRNA sense strand
ccgauucuuaacacaaaugca

SEQ ID NO: 13614 - RNA, 21 nt, Artificial Sequence
  Ebola virus siRNA sense strand
cgauucuuaacacaaaugcau

SEQ ID NO: 13615 - RNA, 21 nt, Artificial Sequence
  Ebola virus siRNA sense strand
gauucuuaacacaaaugcauu

SEQ ID NO: 13616 - RNA, 21 nt, Artificial Sequence
  Ebola virus siRNA sense strand
auucuuaacacaaaugcauuu

SEQ ID NO: 13617 - RNA, 21 nt, Artificial Sequence
  Ebola virus siRNA sense strand
uucuuaacacaaaugcauuua

SEQ ID NO: 13618 - RNA, 21 nt, Artificial Sequence
  Ebola virus siRNA sense strand
ucuuaacacaaaugcauuuag

SEQ ID NO: 13619 - RNA, 21 nt, Artificial Sequence
  Ebola virus siRNA sense strand
cuuaacacaaaugcauuuagc

SEQ ID NO: 13620 - RNA, 21 nt, Artificial Sequence
  Ebola virus siRNA sense strand
uuaacacaaaugcauuuagcu

SEQ ID NO: 13621 - RNA, 21 nt, Artificial Sequence
  Ebola virus siRNA sense strand
uaacacaaaugcauuuagcug

SEQ ID NO: 13622 - RNA, 21 nt, Artificial Sequence
  Ebola virus siRNA sense strand
aacacaaaugcauuuagcugu

SEQ ID NO: 13623 - RNA, 21 nt, Artificial Sequence
  Ebola virus siRNA sense strand
acacaaaugcauuuagcugua

SEQ ID NO: 13624 - RNA, 21 nt, Artificial Sequence
  Ebola virus siRNA sense strand
cacaaaugcauuuagcuguaa

SEQ ID NO: 13625 - RNA, 21 nt, Artificial Sequence
  Ebola virus siRNA sense strand
acaaaugcauuuagcuguaaa

SEQ ID NO: 13626 - RNA, 21 nt, Artificial Sequence
  Ebola virus siRNA sense strand
caaaugcauuuagcuguaaau

SEQ ID NO: 13627 - RNA, 21 nt, Artificial Sequence
  Ebola virus siRNA sense strand
aaaugcauuuagcuguaaauc

SEQ ID NO: 13628 - RNA, 21 nt, Artificial Sequence
  Ebola virus siRNA sense strand
aaugcauuuagcuguaaauca

SEQ ID NO: 13629 - RNA, 21 nt, Artificial Sequence
  Ebola virus siRNA sense strand
augcauuuagcuguaaaucac

SEQ ID NO: 13630 - RNA, 21 nt, Artificial Sequence
  Ebola virus siRNA sense strand
ugcauuuagcuguaaaucaca

SEQ ID NO: 13631 - RNA, 21 nt, Artificial Sequence
  Ebola virus siRNA sense strand
gcauuuagcuguaaaucacac

SEQ ID NO: 13632 - RNA, 21 nt, Artificial Sequence
  Ebola virus siRNA sense strand
cauuuagcuguaaaucacacc

SEQ ID NO: 13633 - RNA, 21 nt, Artificial Sequence
  Ebola virus siRNA sense strand
auuuagcuguaaaucacaccc

SEQ ID NO: 13634 - RNA, 21 nt, Artificial Sequence
  Ebola virus siRNA sense strand
uuuagcuguaaaucacacccu

SEQ ID NO: 13635 - RNA, 21 nt, Artificial Sequence
  Ebola virus siRNA sense strand
uuagcuguaaaucacacccua

SEQ ID NO: 13636 - RNA, 21 nt, Artificial Sequence
  Ebola virus siRNA sense strand
uagcuguaaaucacacccuag

SEQ ID NO: 13637 - RNA, 21 nt, Artificial Sequence
  Ebola virus siRNA sense strand
agcuguaaaucacacccuaga

SEQ ID NO: 13638 - RNA, 21 nt, Artificial Sequence
  Ebola virus siRNA sense strand
gcuguaaaucacacccuagaa

SEQ ID NO: 13639 - RNA, 21 nt, Artificial Sequence
  Ebola virus siRNA sense strand
cuguaaaucacacccuagaag

SEQ ID NO: 13640 - RNA, 21 nt, Artificial Sequence
  Ebola virus siRNA sense strand
uguaaaucacacccuagaaga

SEQ ID NO: 13641 - RNA, 21 nt, Artificial Sequence
  Ebola virus siRNA sense strand
guaaaucacacccuagaagaa

SEQ ID NO: 13642 - RNA, 21 nt, Artificial Sequence
  Ebola virus siRNA sense strand
uaaaucacacccuagaagaaa

SEQ ID NO: 13643 - RNA, 21 nt, Artificial Sequence
  Ebola virus siRNA sense strand
aaaucacacccuagaagaaau

SEQ ID NO: 13644 - RNA, 21 nt, Artificial Sequence
  Ebola virus siRNA sense strand
aaucacacccuagaagaaauu

SEQ ID NO: 13645 - RNA, 21 nt, Artificial Sequence
  Ebola virus siRNA sense strand
aucacacccuagaagaaauua

SEQ ID NO: 13646 - RNA, 21 nt, Artificial Sequence
  Ebola virus siRNA sense strand
ucacacccuagaagaaauuac

SEQ ID NO: 13647 - RNA, 21 nt, Artificial Sequence
  Ebola virus siRNA sense strand
cacacccuagaagaaauuaca

SEQ ID NO: 13648 - RNA, 21 nt, Artificial Sequence
  Ebola virus siRNA sense strand
acacccuagaagaaauuacag

SEQ ID NO: 13649 - RNA, 21 nt, Artificial Sequence
  Ebola virus siRNA sense strand
cacccuagaagaaauuacaga

SEQ ID NO: 13650 - RNA, 21 nt, Artificial Sequence
  Ebola virus siRNA sense strand
acccuagaagaaauuacagaa

SEQ ID NO: 13651 - RNA, 21 nt, Artificial Sequence
  Ebola virus siRNA sense strand
cccuagaagaaauuacagaaa

SEQ ID NO: 13652 - RNA, 21 nt, Artificial Sequence
  Ebola virus siRNA sense strand
ccuagaagaaauuacagaaau

SEQ ID NO: 13653 - RNA, 21 nt, Artificial Sequence
  Ebola virus siRNA sense strand
cuagaagaaauuacagaaaug

SEQ ID NO: 13654 - RNA, 21 nt, Artificial Sequence
  Ebola virus siRNA sense strand
uagaagaaauuacagaaaugc

SEQ ID NO: 13655 - RNA, 21 nt, Artificial Sequence
  Ebola virus siRNA sense strand
agaagaaauuacagaaaugcg

SEQ ID NO: 13656 - RNA, 21 nt, Artificial Sequence
  Ebola virus siRNA sense strand
gaagaaauuacagaaaugcgu

SEQ ID NO: 13657 - RNA, 21 nt, Artificial Sequence
  Ebola virus siRNA sense strand
aagaaauuacagaaaugcgug

SEQ ID NO: 13658 - RNA, 21 nt, Artificial Sequence
  Ebola virus siRNA sense strand
agaaauuacagaaaugcgugc

SEQ ID NO: 13659 - RNA, 21 nt, Artificial Sequence
  Ebola virus siRNA sense strand
gaaauuacagaaaugcgugca

SEQ ID NO: 13660 - RNA, 21 nt, Artificial Sequence
  Ebola virus siRNA sense strand
aaauuacagaaaugcgugcac

SEQ ID NO: 13661 - RNA, 21 nt, Artificial Sequence
  Ebola virus siRNA sense strand
aauuacagaaaugcgugcacu

SEQ ID NO: 13662 - RNA, 21 nt, Artificial Sequence
  Ebola virus siRNA sense strand
auuacagaaaugcgugcacua

SEQ ID NO: 13663 - RNA, 21 nt, Artificial Sequence
  Ebola virus siRNA sense strand
uuacagaaaugcgugcacuaa

SEQ ID NO: 13664 - RNA, 21 nt, Artificial Sequence
  Ebola virus siRNA sense strand
uacagaaaugcgugcacuaaa

SEQ ID NO: 13665 - RNA, 21 nt, Artificial Sequence
  Ebola virus siRNA sense strand
acagaaaugcgugcacuaaag

SEQ ID NO: 13666 - RNA, 21 nt, Artificial Sequence
  Ebola virus siRNA sense strand
cagaaaugcgugcacuaaagc

SEQ ID NO: 13667 - RNA, 21 nt, Artificial Sequence
  Ebola virus siRNA sense strand
agaaaugcgugcacuaaagcc

SEQ ID NO: 13668 - RNA, 21 nt, Artificial Sequence
  Ebola virus siRNA sense strand
gaaaugcgugcacuaaagccu

SEQ ID NO: 13669 - RNA, 21 nt, Artificial Sequence
  Ebola virus siRNA sense strand
aaaugcgugcacuaaagccuu

SEQ ID NO: 13670 - RNA, 21 nt, Artificial Sequence
  Ebola virus siRNA sense strand
aaugcgugcacuaaagccuuc

SEQ ID NO: 13671 - RNA, 21 nt, Artificial Sequence
  Ebola virus siRNA sense strand
augcgugcacuaaagccuuca

SEQ ID NO: 13672 - RNA, 21 nt, Artificial Sequence
  Ebola virus siRNA sense strand
ugcgugcacuaaagccuucac

SEQ ID NO: 13673 - RNA, 21 nt, Artificial Sequence
  Ebola virus siRNA sense strand
gcgugcacuaaagccuucaca

SEQ ID NO: 13674 - RNA, 21 nt, Artificial Sequence
  Ebola virus siRNA sense strand
cgugcacuaaagccuucacag

SEQ ID NO: 13675 - RNA, 21 nt, Artificial Sequence
  Ebola virus siRNA sense strand
gugcacuaaagccuucacagg

SEQ ID NO: 13676 - RNA, 21 nt, Artificial Sequence
  Ebola virus siRNA sense strand
ugcacuaaagccuucacaggc

SEQ ID NO: 13677 - RNA, 21 nt, Artificial Sequence
  Ebola virus siRNA sense strand
gcacuaaagccuucacaggcu

SEQ ID NO: 13678 - RNA, 21 nt, Artificial Sequence
  Ebola virus siRNA sense strand
cacuaaagccuucacaggcuc

SEQ ID NO: 13679 - RNA, 21 nt, Artificial Sequence
  Ebola virus siRNA sense strand
acuaaagccuucacaggcuca

SEQ ID NO: 13680 - RNA, 21 nt, Artificial Sequence
  Ebola virus siRNA sense strand
cuaaagccuucacaggcucaa

SEQ ID NO: 13681 - RNA, 21 nt, Artificial Sequence
  Ebola virus siRNA sense strand
uaaagccuucacaggcucaaa

SEQ ID NO: 13682 - RNA, 21 nt, Artificial Sequence
  Ebola virus siRNA sense strand
aaagccuucacaggcucaaaa

SEQ ID NO: 13683 - RNA, 21 nt, Artificial Sequence
  Ebola virus siRNA sense strand
aagccuucacaggcucaaaag

SEQ ID NO: 13684 - RNA, 21 nt, Artificial Sequence
  Ebola virus siRNA sense strand
agccuucacaggcucaaaaga

SEQ ID NO: 13685 - RNA, 21 nt, Artificial Sequence
  Ebola virus siRNA sense strand
gccuucacaggcucaaaagau

SEQ ID NO: 13686 - RNA, 21 nt, Artificial Sequence
  Ebola virus siRNA sense strand
ccuucacaggcucaaaagauc

SEQ ID NO: 13687 - RNA, 21 nt, Artificial Sequence
  Ebola virus siRNA sense strand
cuucacaggcucaaaagaucc

SEQ ID NO: 13688 - RNA, 21 nt, Artificial Sequence
  Ebola virus siRNA sense strand
uucacaggcucaaaagauccg

SEQ ID NO: 13689 - RNA, 21 nt, Artificial Sequence
  Ebola virus siRNA sense strand
ucacaggcucaaaagauccgu

SEQ ID NO: 13690 - RNA, 21 nt, Artificial Sequence
  Ebola virus siRNA sense strand
cacaggcucaaaagauccgug

SEQ ID NO: 13691 - RNA, 21 nt, Artificial Sequence
  Ebola virus siRNA sense strand
acaggcucaaaagauccguga

SEQ ID NO: 13692 - RNA, 21 nt, Artificial Sequence
  Ebola virus siRNA sense strand
caggcucaaaagauccgugaa

SEQ ID NO: 13693 - RNA, 21 nt, Artificial Sequence
  Ebola virus siRNA sense strand
aggcucaaaagauccgugaau

SEQ ID NO: 13694 - RNA, 21 nt, Artificial Sequence
  Ebola virus siRNA sense strand
ggcucaaaagauccgugaauu

SEQ ID NO: 13695 - RNA, 21 nt, Artificial Sequence
  Ebola virus siRNA sense strand
gcucaaaagauccgugaauuc

SEQ ID NO: 13696 - RNA, 21 nt, Artificial Sequence
  Ebola virus siRNA sense strand
cucaaaagauccgugaauucc

SEQ ID NO: 13697 - RNA, 21 nt, Artificial Sequence
  Ebola virus siRNA sense strand
ucaaaagauccgugaauucca

SEQ ID NO: 13698 - RNA, 21 nt, Artificial Sequence
  Ebola virus siRNA sense strand
caaaagauccgugaauuccau

SEQ ID NO: 13699 - RNA, 21 nt, Artificial Sequence
  Ebola virus siRNA sense strand
aaaagauccgugaauuccaua

SEQ ID NO: 13700 - RNA, 21 nt, Artificial Sequence
  Ebola virus siRNA sense strand
aaagauccgugaauuccauag

SEQ ID NO: 13701 - RNA, 21 nt, Artificial Sequence
  Ebola virus siRNA sense strand
aagauccgugaauuccauaga

SEQ ID NO: 13702 - RNA, 21 nt, Artificial Sequence
  Ebola virus siRNA sense strand
agauccgugaauuccauagaa

SEQ ID NO: 13703 - RNA, 21 nt, Artificial Sequence
  Ebola virus siRNA sense strand
gauccgugaauuccauagaac

SEQ ID NO: 13704 - RNA, 21 nt, Artificial Sequence
  Ebola virus siRNA sense strand
auccgugaauuccauagaaca

SEQ ID NO: 13705 - RNA, 21 nt, Artificial Sequence
  Ebola virus siRNA sense strand
uccgugaauuccauagaacau

SEQ ID NO: 13706 - RNA, 21 nt, Artificial Sequence
  Ebola virus siRNA sense strand
ccgugaauuccauagaacauu

SEQ ID NO: 13707 - RNA, 21 nt, Artificial Sequence
  Ebola virus siRNA sense strand
cgugaauuccauagaacauug

SEQ ID NO: 13708 - RNA, 21 nt, Artificial Sequence
  Ebola virus siRNA sense strand
gugaauuccauagaacauuga

SEQ ID NO: 13709 - RNA, 21 nt, Artificial Sequence
  Ebola virus siRNA sense strand
ugaauuccauagaacauugau

SEQ ID NO: 13710 - RNA, 21 nt, Artificial Sequence
  Ebola virus siRNA sense strand
gaauuccauagaacauugaua

SEQ ID NO: 13711 - RNA, 21 nt, Artificial Sequence
  Ebola virus siRNA sense strand
aauuccauagaacauugauaa

SEQ ID NO: 13712 - RNA, 21 nt, Artificial Sequence
  Ebola virus siRNA sense strand
auuccauagaacauugauaag

SEQ ID NO: 13713 - RNA, 21 nt, Artificial Sequence
  Ebola virus siRNA sense strand
uuccauagaacauugauaagg

SEQ ID NO: 13714 - RNA, 21 nt, Artificial Sequence
  Ebola virus siRNA sense strand
uccauagaacauugauaaggc

SEQ ID NO: 13715 - RNA, 21 nt, Artificial Sequence
  Ebola virus siRNA sense strand
ccauagaacauugauaaggcu

SEQ ID NO: 13716 - RNA, 21 nt, Artificial Sequence
  Ebola virus siRNA sense strand
cauagaacauugauaaggcug

SEQ ID NO: 13717 - RNA, 21 nt, Artificial Sequence
  Ebola virus siRNA sense strand
auagaacauugauaaggcugg

SEQ ID NO: 13718 - RNA, 21 nt, Artificial Sequence
  Ebola virus siRNA sense strand
uagaacauugauaaggcugga

SEQ ID NO: 13719 - RNA, 21 nt, Artificial Sequence
  Ebola virus siRNA sense strand
agaacauugauaaggcuggag

SEQ ID NO: 13720 - RNA, 21 nt, Artificial Sequence
  Ebola virus siRNA sense strand
gaacauugauaaggcuggaga

SEQ ID NO: 13721 - RNA, 21 nt, Artificial Sequence
  Ebola virus siRNA sense strand
aacauugauaaggcuggagau

SEQ ID NO: 13722 - RNA, 21 nt, Artificial Sequence
  Ebola virus siRNA sense strand
acauugauaaggcuggagaug

SEQ ID NO: 13723 - RNA, 21 nt, Artificial Sequence
  Ebola virus siRNA sense strand
cauugauaaggcuggagauga

SEQ ID NO: 13724 - RNA, 21 nt, Artificial Sequence
  Ebola virus siRNA sense strand
auugauaaggcuggagaugac

SEQ ID NO: 13725 - RNA, 21 nt, Artificial Sequence
  Ebola virus siRNA sense strand
uugauaaggcuggagaugacg

SEQ ID NO: 13726 - RNA, 21 nt, Artificial Sequence
  Ebola virus siRNA sense strand
ugauaaggcuggagaugacgc

SEQ ID NO: 13727 - RNA, 21 nt, Artificial Sequence
  Ebola virus siRNA sense strand
gauaaggcuggagaugacgcc

SEQ ID NO: 13728 - RNA, 21 nt, Artificial Sequence
  Ebola virus siRNA sense strand
auaaggcuggagaugacgcca

SEQ ID NO: 13729 - RNA, 21 nt, Artificial Sequence
  Ebola virus siRNA sense strand
uaaggcuggagaugacgccac

SEQ ID NO: 13730 - RNA, 21 nt, Artificial Sequence
  Ebola virus siRNA sense strand
aaggcuggagaugacgccaca

SEQ ID NO: 13731 - RNA, 21 nt, Artificial Sequence
  Ebola virus siRNA sense strand
aggcuggagaugacgccacaa

SEQ ID NO: 13732 - RNA, 21 nt, Artificial Sequence
  Ebola virus siRNA sense strand
ggcuggagaugacgccacaac

SEQ ID NO: 13733 - RNA, 21 nt, Artificial Sequence
  Ebola virus siRNA sense strand
gcuggagaugacgccacaaca

SEQ ID NO: 13734 - RNA, 21 nt, Artificial Sequence
  Ebola virus siRNA sense strand
cuggagaugacgccacaacaa

SEQ ID NO: 13735 - RNA, 21 nt, Artificial Sequence
  Ebola virus siRNA sense strand
uggagaugacgccacaacaac

SEQ ID NO: 13736 - RNA, 21 nt, Artificial Sequence
  Ebola virus siRNA sense strand
ggagaugacgccacaacaacu

SEQ ID NO: 13737 - RNA, 21 nt, Artificial Sequence
  Ebola virus siRNA sense strand
gagaugacgccacaacaacuu

SEQ ID NO: 13738 - RNA, 21 nt, Artificial Sequence
  Ebola virus siRNA sense strand
agaugacgccacaacaacuuu

SEQ ID NO: 13739 - RNA, 21 nt, Artificial Sequence
  Ebola virus siRNA sense strand
gaugacgccacaacaacuuug

SEQ ID NO: 13740 - RNA, 21 nt, Artificial Sequence
  Ebola virus siRNA sense strand
augacgccacaacaacuuugu

SEQ ID NO: 13741 - RNA, 21 nt, Artificial Sequence
  Ebola virus siRNA sense strand
ugacgccacaacaacuuugug

SEQ ID NO: 13742 - RNA, 21 nt, Artificial Sequence
  Ebola virus siRNA sense strand
gacgccacaacaacuuuguga

SEQ ID NO: 13743 - RNA, 21 nt, Artificial Sequence
  Ebola virus siRNA sense strand
acgccacaacaacuuugugag

SEQ ID NO: 13744 - RNA, 21 nt, Artificial Sequence
  Ebola virus siRNA sense strand
cgccacaacaacuuugugagc

SEQ ID NO: 13745 - RNA, 21 nt, Artificial Sequence
  Ebola virus siRNA sense strand
gccacaacaacuuugugagcu

SEQ ID NO: 13746 - RNA, 21 nt, Artificial Sequence
  Ebola virus siRNA sense strand
ccacaacaacuuugugagcua

SEQ ID NO: 13747 - RNA, 21 nt, Artificial Sequence
  Ebola virus siRNA sense strand
cacaacaacuuugugagcuau

SEQ ID NO: 13748 - RNA, 21 nt, Artificial Sequence
  Ebola virus siRNA sense strand
acaacaacuuugugagcuauu

SEQ ID NO: 13749 - RNA, 21 nt, Artificial Sequence
  Ebola virus siRNA sense strand
caacaacuuugugagcuauuu

SEQ ID NO: 13750 - RNA, 21 nt, Artificial Sequence
  Ebola virus siRNA sense strand
aacaacuuugugagcuauuuu

SEQ ID NO: 13751 - RNA, 21 nt, Artificial Sequence
  Ebola virus siRNA sense strand
acaacuuugugagcuauuuuc

SEQ ID NO: 13752 - RNA, 21 nt, Artificial Sequence
  Ebola virus siRNA sense strand
caacuuugugagcuauuuucc

SEQ ID NO: 13753 - RNA, 21 nt, Artificial Sequence
  Ebola virus siRNA sense strand
aacuuugugagcuauuuucca

SEQ ID NO: 13754 - RNA, 21 nt, Artificial Sequence
  Ebola virus siRNA sense strand
acuuugugagcuauuuuccau

SEQ ID NO: 13755 - RNA, 21 nt, Artificial Sequence
  Ebola virus siRNA sense strand
cuuugugagcuauuuuccauu

SEQ ID NO: 13756 - RNA, 21 nt, Artificial Sequence
  Ebola virus siRNA sense strand
uuugugagcuauuuuccauuc

SEQ ID NO: 13757 - RNA, 21 nt, Artificial Sequence
  Ebola virus siRNA sense strand
uugugagcuauuuuccauuca

SEQ ID NO: 13758 - RNA, 21 nt, Artificial Sequence
  Ebola virus siRNA sense strand
ugugagcuauuuuccauucaa

SEQ ID NO: 13759 - RNA, 21 nt, Artificial Sequence
  Ebola virus siRNA sense strand
gugagcuauuuuccauucaaa

SEQ ID NO: 13760 - RNA, 21 nt, Artificial Sequence
  Ebola virus siRNA sense strand
ugagcuauuuuccauucaaaa

SEQ ID NO: 13761 - RNA, 21 nt, Artificial Sequence
  Ebola virus siRNA sense strand
gagcuauuuuccauucaaaaa

SEQ ID NO: 13762 - RNA, 21 nt, Artificial Sequence
  Ebola virus siRNA sense strand
agcuauuuuccauucaaaaac

SEQ ID NO: 13763 - RNA, 21 nt, Artificial Sequence
  Ebola virus siRNA sense strand
gcuauuuuccauucaaaaaca

SEQ ID NO: 13764 - RNA, 21 nt, Artificial Sequence
  Ebola virus siRNA sense strand
cuauuuuccauucaaaaacac

SEQ ID NO: 13765 - RNA, 21 nt, Artificial Sequence
  Ebola virus siRNA sense strand
uauuuuccauucaaaaacacu

SEQ ID NO: 13766 - RNA, 21 nt, Artificial Sequence
  Ebola virus siRNA sense strand
auuuuccauucaaaaacacug

SEQ ID NO: 13767 - RNA, 21 nt, Artificial Sequence
  Ebola virus siRNA sense strand
uuuuccauucaaaaacacugg

SEQ ID NO: 13768 - RNA, 21 nt, Artificial Sequence
  Ebola virus siRNA sense strand
uuuccauucaaaaacacuggg

SEQ ID NO: 13769 - RNA, 21 nt, Artificial Sequence
  Ebola virus siRNA sense strand
uuccauucaaaaacacugggg

SEQ ID NO: 13770 - RNA, 21 nt, Artificial Sequence
  Ebola virus siRNA sense strand
uccauucaaaaacacuggggg

SEQ ID NO: 13771 - RNA, 21 nt, Artificial Sequence
  Ebola virus siRNA sense strand
ccauucaaaaacacugggggc

SEQ ID NO: 13772 - RNA, 21 nt, Artificial Sequence
  Ebola virus siRNA sense strand
cauucaaaaacacugggggca

SEQ ID NO: 13773 - RNA, 21 nt, Artificial Sequence
  Ebola virus siRNA sense strand
auucaaaaacacugggggcau

SEQ ID NO: 13774 - RNA, 21 nt, Artificial Sequence
  Ebola virus siRNA sense strand
uucaaaaacacugggggcauc

SEQ ID NO: 13775 - RNA, 21 nt, Artificial Sequence
  Ebola virus siRNA sense strand
ucaaaaacacugggggcaucc

SEQ ID NO: 13776 - RNA, 21 nt, Artificial Sequence
  Ebola virus siRNA sense strand
caaaaacacugggggcauccu

SEQ ID NO: 13777 - RNA, 21 nt, Artificial Sequence
  Ebola virus siRNA sense strand
aaaaacacugggggcauccug

SEQ ID NO: 13778 - RNA, 21 nt, Artificial Sequence
  Ebola virus siRNA sense strand
aaaacacugggggcauccugu

SEQ ID NO: 13779 - RNA, 21 nt, Artificial Sequence
  Ebola virus siRNA sense strand
aaacacugggggcauccugug

SEQ ID NO: 13780 - RNA, 21 nt, Artificial Sequence
  Ebola virus siRNA sense strand
aacacugggggcauccugugc

SEQ ID NO: 13781 - RNA, 21 nt, Artificial Sequence
  Ebola virus siRNA sense strand
acacugggggcauccugugcu

SEQ ID NO: 13782 - RNA, 21 nt, Artificial Sequence
  Ebola virus siRNA sense strand
cacugggggcauccugugcua

SEQ ID NO: 13783 - RNA, 21 nt, Artificial Sequence
  Ebola virus siRNA sense strand
acugggggcauccugugcuac

SEQ ID NO: 13784 - RNA, 21 nt, Artificial Sequence
  Ebola virus siRNA sense strand
cugggggcauccugugcuaca

SEQ ID NO: 13785 - RNA, 21 nt, Artificial Sequence
  Ebola virus siRNA sense strand
ugggggcauccugugcuacau

SEQ ID NO: 13786 - RNA, 21 nt, Artificial Sequence
  Ebola virus siRNA sense strand
gggggcauccugugcuacaua

SEQ ID NO: 13787 - RNA, 21 nt, Artificial Sequence
  Ebola virus siRNA sense strand
ggggcauccugugcuacauag

SEQ ID NO: 13788 - RNA, 21 nt, Artificial Sequence
  Ebola virus siRNA sense strand
gggcauccugugcuacauagu

SEQ ID NO: 13789 - RNA, 21 nt, Artificial Sequence
  Ebola virus siRNA sense strand
ggcauccugugcuacauagug

SEQ ID NO: 13790 - RNA, 21 nt, Artificial Sequence
  Ebola virus siRNA sense strand
gcauccugugcuacauaguga

SEQ ID NO: 13791 - RNA, 21 nt, Artificial Sequence
  Ebola virus siRNA sense strand
cauccugugcuacauagugaa

SEQ ID NO: 13792 - RNA, 21 nt, Artificial Sequence
  Ebola virus siRNA sense strand
auccugugcuacauagugaaa

SEQ ID NO: 13793 - RNA, 21 nt, Artificial Sequence
  Ebola virus siRNA sense strand
uccugugcuacauagugaaac

SEQ ID NO: 13794 - RNA, 21 nt, Artificial Sequence
  Ebola virus siRNA sense strand
ccugugcuacauagugaaaca

SEQ ID NO: 13795 - RNA, 21 nt, Artificial Sequence
  Ebola virus siRNA sense strand
cugugcuacauagugaaacag

SEQ ID NO: 13796 - RNA, 21 nt, Artificial Sequence
  Ebola virus siRNA sense strand
ugugcuacauagugaaacagc

SEQ ID NO: 13797 - RNA, 21 nt, Artificial Sequence
  Ebola virus siRNA sense strand
gugcuacauagugaaacagca

SEQ ID NO: 13798 - RNA, 21 nt, Artificial Sequence
  Ebola virus siRNA sense strand
ugcuacauagugaaacagcaa

SEQ ID NO: 13799 - RNA, 21 nt, Artificial Sequence
  Ebola virus siRNA sense strand
gcuacauagugaaacagcaau

SEQ ID NO: 13800 - RNA, 21 nt, Artificial Sequence
  Ebola virus siRNA sense strand
cuacauagugaaacagcaauc

SEQ ID NO: 13801 - RNA, 21 nt, Artificial Sequence
  Ebola virus siRNA sense strand
uacauagugaaacagcaaucc

SEQ ID NO: 13802 - RNA, 21 nt, Artificial Sequence
  Ebola virus siRNA sense strand
acauagugaaacagcaaucca

SEQ ID NO: 13803 - RNA, 21 nt, Artificial Sequence
  Ebola virus siRNA sense strand
cauagugaaacagcaauccaa

SEQ ID NO: 13804 - RNA, 21 nt, Artificial Sequence
  Ebola virus siRNA sense strand
auagugaaacagcaauccaaa

SEQ ID NO: 13805 - RNA, 21 nt, Artificial Sequence
  Ebola virus siRNA sense strand
uagugaaacagcaauccaaaa

SEQ ID NO: 13806 - RNA, 21 nt, Artificial Sequence
  Ebola virus siRNA sense strand
agugaaacagcaauccaaaaa

SEQ ID NO: 13807 - RNA, 21 nt, Artificial Sequence
  Ebola virus siRNA sense strand
gugaaacagcaauccaaaaag

SEQ ID NO: 13808 - RNA, 21 nt, Artificial Sequence
  Ebola virus siRNA sense strand
ugaaacagcaauccaaaaagu

SEQ ID NO: 13809 - RNA, 21 nt, Artificial Sequence
  Ebola virus siRNA sense strand
gaaacagcaauccaaaaaguu

SEQ ID NO: 13810 - RNA, 21 nt, Artificial Sequence
  Ebola virus siRNA sense strand
aaacagcaauccaaaaaguua

SEQ ID NO: 13811 - RNA, 21 nt, Artificial Sequence
  Ebola virus siRNA sense strand
aacagcaauccaaaaaguuaa

SEQ ID NO: 13812 - RNA, 21 nt, Artificial Sequence
  Ebola virus siRNA sense strand
acagcaauccaaaaaguuaaa

SEQ ID NO: 13813 - RNA, 21 nt, Artificial Sequence
  Ebola virus siRNA sense strand
cagcaauccaaaaaguuaaaa

SEQ ID NO: 13814 - RNA, 21 nt, Artificial Sequence
  Ebola virus siRNA sense strand
agcaauccaaaaaguuaaaaa

SEQ ID NO: 13815 - RNA, 21 nt, Artificial Sequence
  Ebola virus siRNA sense strand
gcaauccaaaaaguuaaaaaa

SEQ ID NO: 13816 - RNA, 21 nt, Artificial Sequence
  Ebola virus siRNA sense strand
caauccaaaaaguuaaaaaac

SEQ ID NO: 13817 - RNA, 21 nt, Artificial Sequence
  Ebola virus siRNA sense strand
aauccaaaaaguuaaaaaaca

SEQ ID NO: 13818 - RNA, 21 nt, Artificial Sequence
  Ebola virus siRNA sense strand
auccaaaaaguuaaaaaacau

SEQ ID NO: 13819 - RNA, 21 nt, Artificial Sequence
  Ebola virus siRNA sense strand
uccaaaaaguuaaaaaacaug

SEQ ID NO: 13820 - RNA, 21 nt, Artificial Sequence
  Ebola virus siRNA sense strand
ccaaaaaguuaaaaaacaugc

SEQ ID NO: 13821 - RNA, 21 nt, Artificial Sequence
  Ebola virus siRNA sense strand
caaaaaguuaaaaaacaugcu

SEQ ID NO: 13822 - RNA, 21 nt, Artificial Sequence
  Ebola virus siRNA sense strand
aaaaaguuaaaaaacaugcua

SEQ ID NO: 13823 - RNA, 21 nt, Artificial Sequence
  Ebola virus siRNA sense strand
aaaaguuaaaaaacaugcuac

SEQ ID NO: 13824 - RNA, 21 nt, Artificial Sequence
  Ebola virus siRNA sense strand
aaaguuaaaaaacaugcuacg

SEQ ID NO: 13825 - RNA, 21 nt, Artificial Sequence
  Ebola virus siRNA sense strand
aaguuaaaaaacaugcuacgg

SEQ ID NO: 13826 - RNA, 21 nt, Artificial Sequence
  Ebola virus siRNA sense strand
aguuaaaaaacaugcuacggu

SEQ ID NO: 13827 - RNA, 21 nt, Artificial Sequence
  Ebola virus siRNA sense strand
guuaaaaaacaugcuacggug

SEQ ID NO: 13828 - RNA, 21 nt, Artificial Sequence
  Ebola virus siRNA sense strand
uuaaaaaacaugcuacggugc

SEQ ID NO: 13829 - RNA, 21 nt, Artificial Sequence
  Ebola virus siRNA sense strand
uaaaaaacaugcuacggugcu

SEQ ID NO: 13830 - RNA, 21 nt, Artificial Sequence
  Ebola virus siRNA sense strand
aaaaaacaugcuacggugcua

SEQ ID NO: 13831 - RNA, 21 nt, Artificial Sequence
  Ebola virus siRNA sense strand
aaaaacaugcuacggugcuaa

SEQ ID NO: 13832 - RNA, 21 nt, Artificial Sequence
  Ebola virus siRNA sense strand
aaaacaugcuacggugcuaaa

SEQ ID NO: 13833 - RNA, 21 nt, Artificial Sequence
  Ebola virus siRNA sense strand
aaacaugcuacggugcuaaaa

SEQ ID NO: 13834 - RNA, 21 nt, Artificial Sequence
  Ebola virus siRNA sense strand
aacaugcuacggugcuaaaag

SEQ ID NO: 13835 - RNA, 21 nt, Artificial Sequence
  Ebola virus siRNA sense strand
acaugcuacggugcuaaaagc

SEQ ID NO: 13836 - RNA, 21 nt, Artificial Sequence
  Ebola virus siRNA sense strand
caugcuacggugcuaaaagca

SEQ ID NO: 13837 - RNA, 21 nt, Artificial Sequence
  Ebola virus siRNA sense strand
augcuacggugcuaaaagcau

SEQ ID NO: 13838 - RNA, 21 nt, Artificial Sequence
  Ebola virus siRNA sense strand
ugcuacggugcuaaaagcauu

SEQ ID NO: 13839 - RNA, 21 nt, Artificial Sequence
  Ebola virus siRNA sense strand
gcuacggugcuaaaagcauua

SEQ ID NO: 13840 - RNA, 21 nt, Artificial Sequence
  Ebola virus siRNA sense strand
cuacggugcuaaaagcauuac

SEQ ID NO: 13841 - RNA, 21 nt, Artificial Sequence
  Ebola virus siRNA sense strand
uacggugcuaaaagcauuacg

SEQ ID NO: 13842 - RNA, 21 nt, Artificial Sequence
  Ebola virus siRNA sense strand
acggugcuaaaagcauuacgc

SEQ ID NO: 13843 - RNA, 21 nt, Artificial Sequence
  Ebola virus siRNA sense strand
cggugcuaaaagcauuacgcc

SEQ ID NO: 13844 - RNA, 21 nt, Artificial Sequence
  Ebola virus siRNA sense strand
ggugcuaaaagcauuacgccc

SEQ ID NO: 13845 - RNA, 21 nt, Artificial Sequence
  Ebola virus siRNA sense strand
gugcuaaaagcauuacgcccu

SEQ ID NO: 13846 - RNA, 21 nt, Artificial Sequence
  Ebola virus siRNA sense strand
ugcuaaaagcauuacgcccua

SEQ ID NO: 13847 - RNA, 21 nt, Artificial Sequence
  Ebola virus siRNA sense strand
gcuaaaagcauuacgcccuau

SEQ ID NO: 13848 - RNA, 21 nt, Artificial Sequence
  Ebola virus siRNA sense strand
cuaaaagcauuacgcccuaua

SEQ ID NO: 13849 - RNA, 21 nt, Artificial Sequence
  Ebola virus siRNA sense strand
uaaaagcauuacgcccuauag

SEQ ID NO: 13850 - RNA, 21 nt, Artificial Sequence
  Ebola virus siRNA sense strand
aaaagcauuacgcccuauagu

SEQ ID NO: 13851 - RNA, 21 nt, Artificial Sequence
  Ebola virus siRNA sense strand
aaagcauuacgcccuauagug

SEQ ID NO: 13852 - RNA, 21 nt, Artificial Sequence
  Ebola virus siRNA sense strand
aagcauuacgcccuauaguga

SEQ ID NO: 13853 - RNA, 21 nt, Artificial Sequence
  Ebola virus siRNA sense strand
agcauuacgcccuauagugau

SEQ ID NO: 13854 - RNA, 21 nt, Artificial Sequence
  Ebola virus siRNA sense strand
gcauuacgcccuauagugauu

SEQ ID NO: 13855 - RNA, 21 nt, Artificial Sequence
  Ebola virus siRNA sense strand
cauuacgcccuauagugauuu

SEQ ID NO: 13856 - RNA, 21 nt, Artificial Sequence
  Ebola virus siRNA sense strand
auuacgcccuauagugauuuu

SEQ ID NO: 13857 - RNA, 21 nt, Artificial Sequence
  Ebola virus siRNA sense strand
uuacgcccuauagugauuuuc

SEQ ID NO: 13858 - RNA, 21 nt, Artificial Sequence
  Ebola virus siRNA sense strand
uacgcccuauagugauuuucg

SEQ ID NO: 13859 - RNA, 21 nt, Artificial Sequence
  Ebola virus siRNA sense strand
acgcccuauagugauuuucga

SEQ ID NO: 13860 - RNA, 21 nt, Artificial Sequence
  Ebola virus siRNA sense strand
cgcccuauagugauuuucgag

SEQ ID NO: 13861 - RNA, 21 nt, Artificial Sequence
  Ebola virus siRNA sense strand
gcccuauagugauuuucgaga

SEQ ID NO: 13862 - RNA, 21 nt, Artificial Sequence
  Ebola virus siRNA sense strand
cccuauagugauuuucgagac

SEQ ID NO: 13863 - RNA, 21 nt, Artificial Sequence
  Ebola virus siRNA sense strand
ccuauagugauuuucgagaca

SEQ ID NO: 13864 - RNA, 21 nt, Artificial Sequence
  Ebola virus siRNA sense strand
cuauagugauuuucgagacau

SEQ ID NO: 13865 - RNA, 21 nt, Artificial Sequence
  Ebola virus siRNA sense strand
uauagugauuuucgagacaua

SEQ ID NO: 13866 - RNA, 21 nt, Artificial Sequence
  Ebola virus siRNA sense strand
auagugauuuucgagacauac

SEQ ID NO: 13867 - RNA, 21 nt, Artificial Sequence
  Ebola virus siRNA sense strand
uagugauuuucgagacauacu

SEQ ID NO: 13868 - RNA, 21 nt, Artificial Sequence
  Ebola virus siRNA sense strand
agugauuuucgagacauacug

SEQ ID NO: 13869 - RNA, 21 nt, Artificial Sequence
  Ebola virus siRNA sense strand
gugauuuucgagacauacugu

SEQ ID NO: 13870 - RNA, 21 nt, Artificial Sequence
  Ebola virus siRNA sense strand
ugauuuucgagacauacugug

SEQ ID NO: 13871 - RNA, 21 nt, Artificial Sequence
  Ebola virus siRNA sense strand
gauuuucgagacauacugugu

SEQ ID NO: 13872 - RNA, 21 nt, Artificial Sequence
  Ebola virus siRNA sense strand
auuuucgagacauacuguguu

SEQ ID NO: 13873 - RNA, 21 nt, Artificial Sequence
  Ebola virus siRNA sense strand
uuuucgagacauacuguguuu

SEQ ID NO: 13874 - RNA, 21 nt, Artificial Sequence
  Ebola virus siRNA sense strand
uuucgagacauacuguguuuu

SEQ ID NO: 13875 - RNA, 21 nt, Artificial Sequence
  Ebola virus siRNA sense strand
uucgagacauacuguguuuuu

SEQ ID NO: 13876 - RNA, 21 nt, Artificial Sequence
  Ebola virus siRNA sense strand
ucgagacauacuguguuuuua

SEQ ID NO: 13877 - RNA, 21 nt, Artificial Sequence
  Ebola virus siRNA sense strand
cgagacauacuguguuuuuaa

SEQ ID NO: 13878 - RNA, 21 nt, Artificial Sequence
  Ebola virus siRNA sense strand
gagacauacuguguuuuuaaa

SEQ ID NO: 13879 - RNA, 21 nt, Artificial Sequence
  Ebola virus siRNA sense strand
agacauacuguguuuuuaaau

SEQ ID NO: 13880 - RNA, 21 nt, Artificial Sequence
  Ebola virus siRNA sense strand
gacauacuguguuuuuaaaua

SEQ ID NO: 13881 - RNA, 21 nt, Artificial Sequence
  Ebola virus siRNA sense strand
acauacuguguuuuuaaauau

SEQ ID NO: 13882 - RNA, 21 nt, Artificial Sequence
  Ebola virus siRNA sense strand
cauacuguguuuuuaaauaua

SEQ ID NO: 13883 - RNA, 21 nt, Artificial Sequence
  Ebola virus siRNA sense strand
auacuguguuuuuaaauauag

SEQ ID NO: 13884 - RNA, 21 nt, Artificial Sequence
  Ebola virus siRNA sense strand
uacuguguuuuuaaauauagu

SEQ ID NO: 13885 - RNA, 21 nt, Artificial Sequence
  Ebola virus siRNA sense strand
acuguguuuuuaaauauagua

SEQ ID NO: 13886 - RNA, 21 nt, Artificial Sequence
  Ebola virus siRNA sense strand
cuguguuuuuaaauauaguau

SEQ ID NO: 13887 - RNA, 21 nt, Artificial Sequence
  Ebola virus siRNA sense strand
uguguuuuuaaauauaguauu

SEQ ID NO: 13888 - RNA, 21 nt, Artificial Sequence
  Ebola virus siRNA sense strand
guguuuuuaaauauaguauug

SEQ ID NO: 13889 - RNA, 21 nt, Artificial Sequence
  Ebola virus siRNA sense strand
uguuuuuaaauauaguauugc

SEQ ID NO: 13890 - RNA, 21 nt, Artificial Sequence
  Ebola virus siRNA sense strand
guuuuuaaauauaguauugcc

SEQ ID NO: 13891 - RNA, 21 nt, Artificial Sequence
  Ebola virus siRNA sense strand
uuuuuaaauauaguauugcca

SEQ ID NO: 13892 - RNA, 21 nt, Artificial Sequence
  Ebola virus siRNA sense strand
uuuuaaauauaguauugccaa

SEQ ID NO: 13893 - RNA, 21 nt, Artificial Sequence
  Ebola virus siRNA sense strand
uuuaaauauaguauugccaaa

SEQ ID NO: 13894 - RNA, 21 nt, Artificial Sequence
  Ebola virus siRNA sense strand
uuaaauauaguauugccaaac

SEQ ID NO: 13895 - RNA, 21 nt, Artificial Sequence
  Ebola virus siRNA sense strand
uaaauauaguauugccaaaca

SEQ ID NO: 13896 - RNA, 21 nt, Artificial Sequence
  Ebola virus siRNA sense strand
aaauauaguauugccaaacau

SEQ ID NO: 13897 - RNA, 21 nt, Artificial Sequence
  Ebola virus siRNA sense strand
aauauaguauugccaaacauu

SEQ ID NO: 13898 - RNA, 21 nt, Artificial Sequence
  Ebola virus siRNA sense strand
auauaguauugccaaacauua

SEQ ID NO: 13899 - RNA, 21 nt, Artificial Sequence
  Ebola virus siRNA sense strand
uauaguauugccaaacauuau

SEQ ID NO: 13900 - RNA, 21 nt, Artificial Sequence
  Ebola virus siRNA sense strand
auaguauugccaaacauuauu

SEQ ID NO: 13901 - RNA, 21 nt, Artificial Sequence
  Ebola virus siRNA sense strand
uaguauugccaaacauuauuu

SEQ ID NO: 13902 - RNA, 21 nt, Artificial Sequence
  Ebola virus siRNA sense strand
aguauugccaaacauuauuuu

SEQ ID NO: 13903 - RNA, 21 nt, Artificial Sequence
  Ebola virus siRNA sense strand
guauugccaaacauuauuuug

SEQ ID NO: 13904 - RNA, 21 nt, Artificial Sequence
  Ebola virus siRNA sense strand
uauugccaaacauuauuuuga

SEQ ID NO: 13905 - RNA, 21 nt, Artificial Sequence
  Ebola virus siRNA sense strand
auugccaaacauuauuuugau

SEQ ID NO: 13906 - RNA, 21 nt, Artificial Sequence
  Ebola virus siRNA sense strand
uugccaaacauuauuuugaua

SEQ ID NO: 13907 - RNA, 21 nt, Artificial Sequence
  Ebola virus siRNA sense strand
ugccaaacauuauuuugauag

SEQ ID NO: 13908 - RNA, 21 nt, Artificial Sequence
  Ebola virus siRNA sense strand
gccaaacauuauuuugauagu

SEQ ID NO: 13909 - RNA, 21 nt, Artificial Sequence
  Ebola virus siRNA sense strand
ccaaacauuauuuugauaguc

SEQ ID NO: 13910 - RNA, 21 nt, Artificial Sequence
  Ebola virus siRNA sense strand
caaacauuauuuugauaguca

SEQ ID NO: 13911 - RNA, 21 nt, Artificial Sequence
  Ebola virus siRNA sense strand
aaacauuauuuugauagucaa

SEQ ID NO: 13912 - RNA, 21 nt, Artificial Sequence
  Ebola virus siRNA sense strand
aacauuauuuugauagucaag

SEQ ID NO: 13913 - RNA, 21 nt, Artificial Sequence
  Ebola virus siRNA sense strand
acauuauuuugauagucaagg

SEQ ID NO: 13914 - RNA, 21 nt, Artificial Sequence
  Ebola virus siRNA sense strand
cauuauuuugauagucaagga

SEQ ID NO: 13915 - RNA, 21 nt, Artificial Sequence
  Ebola virus siRNA sense strand
auuauuuugauagucaaggau

SEQ ID NO: 13916 - RNA, 21 nt, Artificial Sequence
  Ebola virus siRNA sense strand
uuauuuugauagucaaggauc

SEQ ID NO: 13917 - RNA, 21 nt, Artificial Sequence
  Ebola virus siRNA sense strand
uauuuugauagucaaggaucu

SEQ ID NO: 13918 - RNA, 21 nt, Artificial Sequence
  Ebola virus siRNA sense strand
auuuugauagucaaggaucuu

SEQ ID NO: 13919 - RNA, 21 nt, Artificial Sequence
  Ebola virus siRNA sense strand
uuuugauagucaaggaucuug

SEQ ID NO: 13920 - RNA, 21 nt, Artificial Sequence
  Ebola virus siRNA sense strand
uuugauagucaaggaucuugg

SEQ ID NO: 13921 - RNA, 21 nt, Artificial Sequence
  Ebola virus siRNA sense strand
uugauagucaaggaucuuggu

SEQ ID NO: 13922 - RNA, 21 nt, Artificial Sequence
  Ebola virus siRNA sense strand
ugauagucaaggaucuuggua

SEQ ID NO: 13923 - RNA, 21 nt, Artificial Sequence
  Ebola virus siRNA sense strand
gauagucaaggaucuugguac

SEQ ID NO: 13924 - RNA, 21 nt, Artificial Sequence
  Ebola virus siRNA sense strand
auagucaaggaucuugguaca

SEQ ID NO: 13925 - RNA, 21 nt, Artificial Sequence
  Ebola virus siRNA sense strand
uagucaaggaucuugguacag

SEQ ID NO: 13926 - RNA, 21 nt, Artificial Sequence
  Ebola virus siRNA sense strand
agucaaggaucuugguacagu

SEQ ID NO: 13927 - RNA, 21 nt, Artificial Sequence
  Ebola virus siRNA sense strand
gucaaggaucuugguacagug

SEQ ID NO: 13928 - RNA, 21 nt, Artificial Sequence
  Ebola virus siRNA sense strand
ucaaggaucuugguacagugu

SEQ ID NO: 13929 - RNA, 21 nt, Artificial Sequence
  Ebola virus siRNA sense strand
caaggaucuugguacaguguu

SEQ ID NO: 13930 - RNA, 21 nt, Artificial Sequence
  Ebola virus siRNA sense strand
aaggaucuugguacaguguua

SEQ ID NO: 13931 - RNA, 21 nt, Artificial Sequence
  Ebola virus siRNA sense strand
aggaucuugguacaguguuac

SEQ ID NO: 13932 - RNA, 21 nt, Artificial Sequence
  Ebola virus siRNA sense strand
ggaucuugguacaguguuacu

SEQ ID NO: 13933 - RNA, 21 nt, Artificial Sequence
  Ebola virus siRNA sense strand
gaucuugguacaguguuacuu

SEQ ID NO: 13934 - RNA, 21 nt, Artificial Sequence
  Ebola virus siRNA sense strand
aucuugguacaguguuacuuc

SEQ ID NO: 13935 - RNA, 21 nt, Artificial Sequence
  Ebola virus siRNA sense strand
ucuugguacaguguuacuuca

SEQ ID NO: 13936 - RNA, 21 nt, Artificial Sequence
  Ebola virus siRNA sense strand
cuugguacaguguuacuucag

SEQ ID NO: 13937 - RNA, 21 nt, Artificial Sequence
  Ebola virus siRNA sense strand
uugguacaguguuacuucaga

SEQ ID NO: 13938 - RNA, 21 nt, Artificial Sequence
  Ebola virus siRNA sense strand
ugguacaguguuacuucagau

SEQ ID NO: 13939 - RNA, 21 nt, Artificial Sequence
  Ebola virus siRNA sense strand
gguacaguguuacuucagaua

SEQ ID NO: 13940 - RNA, 21 nt, Artificial Sequence
  Ebola virus siRNA sense strand
guacaguguuacuucagauag

SEQ ID NO: 13941 - RNA, 21 nt, Artificial Sequence
  Ebola virus siRNA sense strand
uacaguguuacuucagauagg

SEQ ID NO: 13942 - RNA, 21 nt, Artificial Sequence
  Ebola virus siRNA sense strand
acaguguuacuucagauagga

SEQ ID NO: 13943 - RNA, 21 nt, Artificial Sequence
  Ebola virus siRNA sense strand
caguguuacuucagauaggaa

SEQ ID NO: 13944 - RNA, 21 nt, Artificial Sequence
  Ebola virus siRNA sense strand
aguguuacuucagauaggaau

SEQ ID NO: 13945 - RNA, 21 nt, Artificial Sequence
  Ebola virus siRNA sense strand
guguuacuucagauaggaauc

SEQ ID NO: 13946 - RNA, 21 nt, Artificial Sequence
  Ebola virus siRNA sense strand
uguuacuucagauaggaaucu

SEQ ID NO: 13947 - RNA, 21 nt, Artificial Sequence
  Ebola virus siRNA sense strand
guuacuucagauaggaaucua

SEQ ID NO: 13948 - RNA, 21 nt, Artificial Sequence
  Ebola virus siRNA sense strand
uuacuucagauaggaaucuaa

SEQ ID NO: 13949 - RNA, 21 nt, Artificial Sequence
  Ebola virus siRNA sense strand
uacuucagauaggaaucuaac

SEQ ID NO: 13950 - RNA, 21 nt, Artificial Sequence
  Ebola virus siRNA sense strand
acuucagauaggaaucuaaca

SEQ ID NO: 13951 - RNA, 21 nt, Artificial Sequence
  Ebola virus siRNA sense strand
cuucagauaggaaucuaacac

SEQ ID NO: 13952 - RNA, 21 nt, Artificial Sequence
  Ebola virus siRNA sense strand
uucagauaggaaucuaacacc

SEQ ID NO: 13953 - RNA, 21 nt, Artificial Sequence
  Ebola virus siRNA sense strand
ucagauaggaaucuaacaccg

SEQ ID NO: 13954 - RNA, 21 nt, Artificial Sequence
  Ebola virus siRNA sense strand
cagauaggaaucuaacaccgg

SEQ ID NO: 13955 - RNA, 21 nt, Artificial Sequence
  Ebola virus siRNA sense strand
agauaggaaucuaacaccggg

SEQ ID NO: 13956 - RNA, 21 nt, Artificial Sequence
  Ebola virus siRNA sense strand
gauaggaaucuaacaccgggu

SEQ ID NO: 13957 - RNA, 21 nt, Artificial Sequence
  Ebola virus siRNA sense strand
auaggaaucuaacaccggguc

SEQ ID NO: 13958 - RNA, 21 nt, Artificial Sequence
  Ebola virus siRNA sense strand
uaggaaucuaacaccgggucu

SEQ ID NO: 13959 - RNA, 21 nt, Artificial Sequence
  Ebola virus siRNA sense strand
aggaaucuaacaccgggucuu

SEQ ID NO: 13960 - RNA, 21 nt, Artificial Sequence
  Ebola virus siRNA sense strand
ggaaucuaacaccgggucuua

SEQ ID NO: 13961 - RNA, 21 nt, Artificial Sequence
  Ebola virus siRNA sense strand
gaaucuaacaccgggucuuaa

SEQ ID NO: 13962 - RNA, 21 nt, Artificial Sequence
  Ebola virus siRNA sense strand
aaucuaacaccgggucuuaau

SEQ ID NO: 13963 - RNA, 21 nt, Artificial Sequence
  Ebola virus siRNA sense strand
aucuaacaccgggucuuaauu

SEQ ID NO: 13964 - RNA, 21 nt, Artificial Sequence
  Ebola virus siRNA sense strand
ucuaacaccgggucuuaauuc

SEQ ID NO: 13965 - RNA, 21 nt, Artificial Sequence
  Ebola virus siRNA sense strand
cuaacaccgggucuuaauucu

SEQ ID NO: 13966 - RNA, 21 nt, Artificial Sequence
  Ebola virus siRNA sense strand
uaacaccgggucuuaauucuu

SEQ ID NO: 13967 - RNA, 21 nt, Artificial Sequence
  Ebola virus siRNA sense strand
aacaccgggucuuaauucuua

SEQ ID NO: 13968 - RNA, 21 nt, Artificial Sequence
  Ebola virus siRNA sense strand
acaccgggucuuaauucuuau

SEQ ID NO: 13969 - RNA, 21 nt, Artificial Sequence
  Ebola virus siRNA sense strand
caccgggucuuaauucuuaua

SEQ ID NO: 13970 - RNA, 21 nt, Artificial Sequence
  Ebola virus siRNA sense strand
accgggucuuaauucuuauau

SEQ ID NO: 13971 - RNA, 21 nt, Artificial Sequence
  Ebola virus siRNA sense strand
ccgggucuuaauucuuauauc

SEQ ID NO: 13972 - RNA, 21 nt, Artificial Sequence
  Ebola virus siRNA sense strand
cgggucuuaauucuuauauca

SEQ ID NO: 13973 - RNA, 21 nt, Artificial Sequence
  Ebola virus siRNA sense strand
gggucuuaauucuuauaucaa

SEQ ID NO: 13974 - RNA, 21 nt, Artificial Sequence
  Ebola virus siRNA sense strand
ggucuuaauucuuauaucaaa

SEQ ID NO: 13975 - RNA, 21 nt, Artificial Sequence
  Ebola virus siRNA sense strand
gucuuaauucuuauaucaaaa

SEQ ID NO: 13976 - RNA, 21 nt, Artificial Sequence
  Ebola virus siRNA sense strand
ucuuaauucuuauaucaaaag

SEQ ID NO: 13977 - RNA, 21 nt, Artificial Sequence
  Ebola virus siRNA sense strand
cuuaauucuuauaucaaaaga

SEQ ID NO: 13978 - RNA, 21 nt, Artificial Sequence
  Ebola virus siRNA sense strand
uuaauucuuauaucaaaagaa

SEQ ID NO: 13979 - RNA, 21 nt, Artificial Sequence
  Ebola virus siRNA sense strand
uaauucuuauaucaaaagaaa

SEQ ID NO: 13980 - RNA, 21 nt, Artificial Sequence
  Ebola virus siRNA sense strand
aauucuuauaucaaaagaaau

SEQ ID NO: 13981 - RNA, 21 nt, Artificial Sequence
  Ebola virus siRNA sense strand
auucuuauaucaaaagaaauc

SEQ ID NO: 13982 - RNA, 21 nt, Artificial Sequence
  Ebola virus siRNA sense strand
uucuuauaucaaaagaaauca

SEQ ID NO: 13983 - RNA, 21 nt, Artificial Sequence
  Ebola virus siRNA sense strand
ucuuauaucaaaagaaaucaa

SEQ ID NO: 13984 - RNA, 21 nt, Artificial Sequence
  Ebola virus siRNA sense strand
cuuauaucaaaagaaaucaau

SEQ ID NO: 13985 - RNA, 21 nt, Artificial Sequence
  Ebola virus siRNA sense strand
uuauaucaaaagaaaucaauu

SEQ ID NO: 13986 - RNA, 21 nt, Artificial Sequence
  Ebola virus siRNA sense strand
uauaucaaaagaaaucaauuc

SEQ ID NO: 13987 - RNA, 21 nt, Artificial Sequence
  Ebola virus siRNA sense strand
auaucaaaagaaaucaauucc

SEQ ID NO: 13988 - RNA, 21 nt, Artificial Sequence
  Ebola virus siRNA sense strand
uaucaaaagaaaucaauuccc

SEQ ID NO: 13989 - RNA, 21 nt, Artificial Sequence
  Ebola virus siRNA sense strand
aucaaaagaaaucaauucccu

SEQ ID NO: 13990 - RNA, 21 nt, Artificial Sequence
  Ebola virus siRNA sense strand
ucaaaagaaaucaauucccuc

SEQ ID NO: 13991 - RNA, 21 nt, Artificial Sequence
  Ebola virus siRNA sense strand
caaaagaaaucaauucccucc

SEQ ID NO: 13992 - RNA, 21 nt, Artificial Sequence
  Ebola virus siRNA sense strand
aaaagaaaucaauucccuccg

SEQ ID NO: 13993 - RNA, 21 nt, Artificial Sequence
  Ebola virus siRNA sense strand
aaagaaaucaauucccuccgu

SEQ ID NO: 13994 - RNA, 21 nt, Artificial Sequence
  Ebola virus siRNA sense strand
aagaaaucaauucccuccguu

SEQ ID NO: 13995 - RNA, 21 nt, Artificial Sequence
  Ebola virus siRNA sense strand
agaaaucaauucccuccguug

SEQ ID NO: 13996 - RNA, 21 nt, Artificial Sequence
  Ebola virus siRNA sense strand
gaaaucaauucccuccguugc

SEQ ID NO: 13997 - RNA, 21 nt, Artificial Sequence
  Ebola virus siRNA sense strand
aaaucaauucccuccguugcc

SEQ ID NO: 13998 - RNA, 21 nt, Artificial Sequence
  Ebola virus siRNA sense strand
aaucaauucccuccguugcca

SEQ ID NO: 13999 - RNA, 21 nt, Artificial Sequence
  Ebola virus siRNA sense strand
aucaauucccuccguugccaa

SEQ ID NO: 14000 - RNA, 21 nt, Artificial Sequence
  Ebola virus siRNA sense strand
ucaauucccuccguugccaau

SEQ ID NO: 14001 - RNA, 21 nt, Artificial Sequence
  Ebola virus siRNA sense strand
caauucccuccguugccaaug

SEQ ID NO: 14002 - RNA, 21 nt, Artificial Sequence
  Ebola virus siRNA sense strand
aauucccuccguugccaauga

SEQ ID NO: 14003 - RNA, 21 nt, Artificial Sequence
  Ebola virus siRNA sense strand
auucccuccguugccaaugau

SEQ ID NO: 14004 - RNA, 21 nt, Artificial Sequence
  Ebola virus siRNA sense strand
uucccuccguugccaaugauu

SEQ ID NO: 14005 - RNA, 21 nt, Artificial Sequence
  Ebola virus siRNA sense strand
ucccuccguugccaaugauua

SEQ ID NO: 14006 - RNA, 21 nt, Artificial Sequence
  Ebola virus siRNA sense strand
cccuccguugccaaugauuaa

SEQ ID NO: 14007 - RNA, 21 nt, Artificial Sequence
  Ebola virus siRNA sense strand
ccuccguugccaaugauuaaa

SEQ ID NO: 14008 - RNA, 21 nt, Artificial Sequence
  Ebola virus siRNA sense strand
cuccguugccaaugauuaaag

SEQ ID NO: 14009 - RNA, 21 nt, Artificial Sequence
  Ebola virus siRNA sense strand
uccguugccaaugauuaaaga

SEQ ID NO: 14010 - RNA, 21 nt, Artificial Sequence
  Ebola virus siRNA sense strand
ccguugccaaugauuaaagaa

SEQ ID NO: 14011 - RNA, 21 nt, Artificial Sequence
  Ebola virus siRNA sense strand
cguugccaaugauuaaagaac

SEQ ID NO: 14012 - RNA, 21 nt, Artificial Sequence
  Ebola virus siRNA sense strand
guugccaaugauuaaagaacu

SEQ ID NO: 14013 - RNA, 21 nt, Artificial Sequence
  Ebola virus siRNA sense strand
uugccaaugauuaaagaacua

SEQ ID NO: 14014 - RNA, 21 nt, Artificial Sequence
  Ebola virus siRNA sense strand
ugccaaugauuaaagaacuac

SEQ ID NO: 14015 - RNA, 21 nt, Artificial Sequence
  Ebola virus siRNA sense strand
gccaaugauuaaagaacuacu

SEQ ID NO: 14016 - RNA, 21 nt, Artificial Sequence
  Ebola virus siRNA sense strand
ccaaugauuaaagaacuacua

SEQ ID NO: 14017 - RNA, 21 nt, Artificial Sequence
  Ebola virus siRNA sense strand
caaugauuaaagaacuacuau

SEQ ID NO: 14018 - RNA, 21 nt, Artificial Sequence
  Ebola virus siRNA sense strand
aaugauuaaagaacuacuaug

SEQ ID NO: 14019 - RNA, 21 nt, Artificial Sequence
  Ebola virus siRNA sense strand
augauuaaagaacuacuaugg

SEQ ID NO: 14020 - RNA, 21 nt, Artificial Sequence
  Ebola virus siRNA sense strand
ugauuaaagaacuacuauggg

SEQ ID NO: 14021 - RNA, 21 nt, Artificial Sequence
  Ebola virus siRNA sense strand
gauuaaagaacuacuauggga

SEQ ID NO: 14022 - RNA, 21 nt, Artificial Sequence
  Ebola virus siRNA sense strand
auuaaagaacuacuaugggaa

SEQ ID NO: 14023 - RNA, 21 nt, Artificial Sequence
  Ebola virus siRNA sense strand
uuaaagaacuacuaugggaau

SEQ ID NO: 14024 - RNA, 21 nt, Artificial Sequence
  Ebola virus siRNA sense strand
uaaagaacuacuaugggaauu

SEQ ID NO: 14025 - RNA, 21 nt, Artificial Sequence
  Ebola virus siRNA sense strand
aaagaacuacuaugggaauuu

SEQ ID NO: 14026 - RNA, 21 nt, Artificial Sequence
  Ebola virus siRNA sense strand
aagaacuacuaugggaauuuu

SEQ ID NO: 14027 - RNA, 21 nt, Artificial Sequence
  Ebola virus siRNA sense strand
agaacuacuaugggaauuuua

SEQ ID NO: 14028 - RNA, 21 nt, Artificial Sequence
  Ebola virus siRNA sense strand
gaacuacuaugggaauuuuac

SEQ ID NO: 14029 - RNA, 21 nt, Artificial Sequence
  Ebola virus siRNA sense strand
aacuacuaugggaauuuuacc

SEQ ID NO: 14030 - RNA, 21 nt, Artificial Sequence
  Ebola virus siRNA sense strand
acuacuaugggaauuuuacca

SEQ ID NO: 14031 - RNA, 21 nt, Artificial Sequence
  Ebola virus siRNA sense strand
cuacuaugggaauuuuaccac

SEQ ID NO: 14032 - RNA, 21 nt, Artificial Sequence
  Ebola virus siRNA sense strand
uacuaugggaauuuuaccacc

SEQ ID NO: 14033 - RNA, 21 nt, Artificial Sequence
  Ebola virus siRNA sense strand
acuaugggaauuuuaccaccu

SEQ ID NO: 14034 - RNA, 21 nt, Artificial Sequence
  Ebola virus siRNA sense strand
cuaugggaauuuuaccaccuu

SEQ ID NO: 14035 - RNA, 21 nt, Artificial Sequence
  Ebola virus siRNA sense strand
uaugggaauuuuaccaccuug

SEQ ID NO: 14036 - RNA, 21 nt, Artificial Sequence
  Ebola virus siRNA sense strand
augggaauuuuaccaccuuga

SEQ ID NO: 14037 - RNA, 21 nt, Artificial Sequence
  Ebola virus siRNA sense strand
ugggaauuuuaccaccuugac

SEQ ID NO: 14038 - RNA, 21 nt, Artificial Sequence
  Ebola virus siRNA sense strand
gggaauuuuaccaccuugacc

SEQ ID NO: 14039 - RNA, 21 nt, Artificial Sequence
  Ebola virus siRNA sense strand
ggaauuuuaccaccuugacca

SEQ ID NO: 14040 - RNA, 21 nt, Artificial Sequence
  Ebola virus siRNA sense strand
gaauuuuaccaccuugaccac

SEQ ID NO: 14041 - RNA, 21 nt, Artificial Sequence
  Ebola virus siRNA sense strand
aauuuuaccaccuugaccacc

SEQ ID NO: 14042 - RNA, 21 nt, Artificial Sequence
  Ebola virus siRNA sense strand
auuuuaccaccuugaccaccc

SEQ ID NO: 14043 - RNA, 21 nt, Artificial Sequence
  Ebola virus siRNA sense strand
uuuuaccaccuugaccacccu

SEQ ID NO: 14044 - RNA, 21 nt, Artificial Sequence
  Ebola virus siRNA sense strand
uuuaccaccuugaccacccuc

SEQ ID NO: 14045 - RNA, 21 nt, Artificial Sequence
  Ebola virus siRNA sense strand
uuaccaccuugaccacccucc

SEQ ID NO: 14046 - RNA, 21 nt, Artificial Sequence
  Ebola virus siRNA sense strand
uaccaccuugaccacccucca

SEQ ID NO: 14047 - RNA, 21 nt, Artificial Sequence
  Ebola virus siRNA sense strand
accaccuugaccacccuccac

SEQ ID NO: 14048 - RNA, 21 nt, Artificial Sequence
  Ebola virus siRNA sense strand
ccaccuugaccacccuccacu

SEQ ID NO: 14049 - RNA, 21 nt, Artificial Sequence
  Ebola virus siRNA sense strand
caccuugaccacccuccacuu

SEQ ID NO: 14050 - RNA, 21 nt, Artificial Sequence
  Ebola virus siRNA sense strand
accuugaccacccuccacuuu

SEQ ID NO: 14051 - RNA, 21 nt, Artificial Sequence
  Ebola virus siRNA sense strand
ccuugaccacccuccacuuuu

SEQ ID NO: 14052 - RNA, 21 nt, Artificial Sequence
  Ebola virus siRNA sense strand
cuugaccacccuccacuuuuc

SEQ ID NO: 14053 - RNA, 21 nt, Artificial Sequence
  Ebola virus siRNA sense strand
uugaccacccuccacuuuucu

SEQ ID NO: 14054 - RNA, 21 nt, Artificial Sequence
  Ebola virus siRNA sense strand
ugaccacccuccacuuuucuc

SEQ ID NO: 14055 - RNA, 21 nt, Artificial Sequence
  Ebola virus siRNA sense strand
gaccacccuccacuuuucuca

SEQ ID NO: 14056 - RNA, 21 nt, Artificial Sequence
  Ebola virus siRNA sense strand
accacccuccacuuuucucaa

SEQ ID NO: 14057 - RNA, 21 nt, Artificial Sequence
  Ebola virus siRNA sense strand
ccacccuccacuuuucucaac

SEQ ID NO: 14058 - RNA, 21 nt, Artificial Sequence
  Ebola virus siRNA sense strand
cacccuccacuuuucucaacc

SEQ ID NO: 14059 - RNA, 21 nt, Artificial Sequence
  Ebola virus siRNA sense strand
acccuccacuuuucucaacca

SEQ ID NO: 14060 - RNA, 21 nt, Artificial Sequence
  Ebola virus siRNA sense strand
cccuccacuuuucucaaccaa

SEQ ID NO: 14061 - RNA, 21 nt, Artificial Sequence
  Ebola virus siRNA sense strand
ccuccacuuuucucaaccaaa

SEQ ID NO: 14062 - RNA, 21 nt, Artificial Sequence
  Ebola virus siRNA sense strand
cuccacuuuucucaaccaaaa

SEQ ID NO: 14063 - RNA, 21 nt, Artificial Sequence
  Ebola virus siRNA sense strand
uccacuuuucucaaccaaaau

SEQ ID NO: 14064 - RNA, 21 nt, Artificial Sequence
  Ebola virus siRNA sense strand
ccacuuuucucaaccaaaauu

SEQ ID NO: 14065 - RNA, 21 nt, Artificial Sequence
  Ebola virus siRNA sense strand
cacuuuucucaaccaaaauua

SEQ ID NO: 14066 - RNA, 21 nt, Artificial Sequence
  Ebola virus siRNA sense strand
acuuuucucaaccaaaauuau

SEQ ID NO: 14067 - RNA, 21 nt, Artificial Sequence
  Ebola virus siRNA sense strand
cuuuucucaaccaaaauuauu

SEQ ID NO: 14068 - RNA, 21 nt, Artificial Sequence
  Ebola virus siRNA sense strand
uuuucucaaccaaaauuauua

SEQ ID NO: 14069 - RNA, 21 nt, Artificial Sequence
  Ebola virus siRNA sense strand
uuucucaaccaaaauuauuag

SEQ ID NO: 14070 - RNA, 21 nt, Artificial Sequence
  Ebola virus siRNA sense strand
uucucaaccaaaauuauuagu

SEQ ID NO: 14071 - RNA, 21 nt, Artificial Sequence
  Ebola virus siRNA sense strand
ucucaaccaaaauuauuagug

SEQ ID NO: 14072 - RNA, 21 nt, Artificial Sequence
  Ebola virus siRNA sense strand
cucaaccaaaauuauuaguga

SEQ ID NO: 14073 - RNA, 21 nt, Artificial Sequence
  Ebola virus siRNA sense strand
ucaaccaaaauuauuagugac

SEQ ID NO: 14074 - RNA, 21 nt, Artificial Sequence
  Ebola virus siRNA sense strand
caaccaaaauuauuagugacu

SEQ ID NO: 14075 - RNA, 21 nt, Artificial Sequence
  Ebola virus siRNA sense strand
aaccaaaauuauuagugacuu

SEQ ID NO: 14076 - RNA, 21 nt, Artificial Sequence
  Ebola virus siRNA sense strand
accaaaauuauuagugacuua

SEQ ID NO: 14077 - RNA, 21 nt, Artificial Sequence
  Ebola virus siRNA sense strand
ccaaaauuauuagugacuuaa

SEQ ID NO: 14078 - RNA, 21 nt, Artificial Sequence
  Ebola virus siRNA sense strand
caaaauuauuagugacuuaag

SEQ ID NO: 14079 - RNA, 21 nt, Artificial Sequence
  Ebola virus siRNA sense strand
aaaauuauuagugacuuaagu

SEQ ID NO: 14080 - RNA, 21 nt, Artificial Sequence
  Ebola virus siRNA sense strand
aaauuauuagugacuuaagua

SEQ ID NO: 14081 - RNA, 21 nt, Artificial Sequence
  Ebola virus siRNA sense strand
aauuauuagugacuuaaguau

SEQ ID NO: 14082 - RNA, 21 nt, Artificial Sequence
  Ebola virus siRNA sense strand
auuauuagugacuuaaguauu

SEQ ID NO: 14083 - RNA, 21 nt, Artificial Sequence
  Ebola virus siRNA sense strand
uuauuagugacuuaaguauuu

SEQ ID NO: 14084 - RNA, 21 nt, Artificial Sequence
  Ebola virus siRNA sense strand
uauuagugacuuaaguauuuu

SEQ ID NO: 14085 - RNA, 21 nt, Artificial Sequence
  Ebola virus siRNA sense strand
auuagugacuuaaguauuuuu

SEQ ID NO: 14086 - RNA, 21 nt, Artificial Sequence
  Ebola virus siRNA sense strand
uuagugacuuaaguauuuuua

SEQ ID NO: 14087 - RNA, 21 nt, Artificial Sequence
  Ebola virus siRNA sense strand
uagugacuuaaguauuuuuau

SEQ ID NO: 14088 - RNA, 21 nt, Artificial Sequence
  Ebola virus siRNA sense strand
agugacuuaaguauuuuuaua

SEQ ID NO: 14089 - RNA, 21 nt, Artificial Sequence
  Ebola virus siRNA sense strand
gugacuuaaguauuuuuauaa

SEQ ID NO: 14090 - RNA, 21 nt, Artificial Sequence
  Ebola virus siRNA sense strand
ugacuuaaguauuuuuauaaa

SEQ ID NO: 14091 - RNA, 21 nt, Artificial Sequence
  Ebola virus siRNA sense strand
gacuuaaguauuuuuauaaaa

SEQ ID NO: 14092 - RNA, 21 nt, Artificial Sequence
  Ebola virus siRNA sense strand
acuuaaguauuuuuauaaaag

SEQ ID NO: 14093 - RNA, 21 nt, Artificial Sequence
  Ebola virus siRNA sense strand
cuuaaguauuuuuauaaaaga

SEQ ID NO: 14094 - RNA, 21 nt, Artificial Sequence
  Ebola virus siRNA sense strand
uuaaguauuuuuauaaaagac

SEQ ID NO: 14095 - RNA, 21 nt, Artificial Sequence
  Ebola virus siRNA sense strand
uaaguauuuuuauaaaagaca

SEQ ID NO: 14096 - RNA, 21 nt, Artificial Sequence
  Ebola virus siRNA sense strand
aaguauuuuuauaaaagacag

SEQ ID NO: 14097 - RNA, 21 nt, Artificial Sequence
  Ebola virus siRNA sense strand
aguauuuuuauaaaagacaga

SEQ ID NO: 14098 - RNA, 21 nt, Artificial Sequence
  Ebola virus siRNA sense strand
guauuuuuauaaaagacagag

SEQ ID NO: 14099 - RNA, 21 nt, Artificial Sequence
  Ebola virus siRNA sense strand
uauuuuuauaaaagacagagc

SEQ ID NO: 14100 - RNA, 21 nt, Artificial Sequence
  Ebola virus siRNA sense strand
auuuuuauaaaagacagagcu

SEQ ID NO: 14101 - RNA, 21 nt, Artificial Sequence
  Ebola virus siRNA sense strand
uuuuuauaaaagacagagcua

SEQ ID NO: 14102 - RNA, 21 nt, Artificial Sequence
  Ebola virus siRNA sense strand
uuuuauaaaagacagagcuac

SEQ ID NO: 14103 - RNA, 21 nt, Artificial Sequence
  Ebola virus siRNA sense strand
uuuauaaaagacagagcuacc

SEQ ID NO: 14104 - RNA, 21 nt, Artificial Sequence
  Ebola virus siRNA sense strand
uuauaaaagacagagcuaccg

SEQ ID NO: 14105 - RNA, 21 nt, Artificial Sequence
  Ebola virus siRNA sense strand
uauaaaagacagagcuaccgc

SEQ ID NO: 14106 - RNA, 21 nt, Artificial Sequence
  Ebola virus siRNA sense strand
auaaaagacagagcuaccgca

SEQ ID NO: 14107 - RNA, 21 nt, Artificial Sequence
  Ebola virus siRNA sense strand
uaaaagacagagcuaccgcag

SEQ ID NO: 14108 - RNA, 21 nt, Artificial Sequence
  Ebola virus siRNA sense strand
aaaagacagagcuaccgcagu

SEQ ID NO: 14109 - RNA, 21 nt, Artificial Sequence
  Ebola virus siRNA sense strand
aaagacagagcuaccgcagua

SEQ ID NO: 14110 - RNA, 21 nt, Artificial Sequence
  Ebola virus siRNA sense strand
aagacagagcuaccgcaguag

SEQ ID NO: 14111 - RNA, 21 nt, Artificial Sequence
  Ebola virus siRNA sense strand
agacagagcuaccgcaguaga

SEQ ID NO: 14112 - RNA, 21 nt, Artificial Sequence
  Ebola virus siRNA sense strand
gacagagcuaccgcaguagaa

SEQ ID NO: 14113 - RNA, 21 nt, Artificial Sequence
  Ebola virus siRNA sense strand
acagagcuaccgcaguagaaa

SEQ ID NO: 14114 - RNA, 21 nt, Artificial Sequence
  Ebola virus siRNA sense strand
cagagcuaccgcaguagaaag

SEQ ID NO: 14115 - RNA, 21 nt, Artificial Sequence
  Ebola virus siRNA sense strand
agagcuaccgcaguagaaagg

SEQ ID NO: 14116 - RNA, 21 nt, Artificial Sequence
  Ebola virus siRNA sense strand
gagcuaccgcaguagaaagga

SEQ ID NO: 14117 - RNA, 21 nt, Artificial Sequence
  Ebola virus siRNA sense strand
agcuaccgcaguagaaaggac

SEQ ID NO: 14118 - RNA, 21 nt, Artificial Sequence
  Ebola virus siRNA sense strand
gcuaccgcaguagaaaggaca

SEQ ID NO: 14119 - RNA, 21 nt, Artificial Sequence
  Ebola virus siRNA sense strand
cuaccgcaguagaaaggacau

SEQ ID NO: 14120 - RNA, 21 nt, Artificial Sequence
  Ebola virus siRNA sense strand
uaccgcaguagaaaggacaug

SEQ ID NO: 14121 - RNA, 21 nt, Artificial Sequence
  Ebola virus siRNA sense strand
accgcaguagaaaggacaugc

SEQ ID NO: 14122 - RNA, 21 nt, Artificial Sequence
  Ebola virus siRNA sense strand
ccgcaguagaaaggacaugcu

SEQ ID NO: 14123 - RNA, 21 nt, Artificial Sequence
  Ebola virus siRNA sense strand
cgcaguagaaaggacaugcug

SEQ ID NO: 14124 - RNA, 21 nt, Artificial Sequence
  Ebola virus siRNA sense strand
gcaguagaaaggacaugcugg

SEQ ID NO: 14125 - RNA, 21 nt, Artificial Sequence
  Ebola virus siRNA sense strand
caguagaaaggacaugcuggg

SEQ ID NO: 14126 - RNA, 21 nt, Artificial Sequence
  Ebola virus siRNA sense strand
aguagaaaggacaugcuggga

SEQ ID NO: 14127 - RNA, 21 nt, Artificial Sequence
  Ebola virus siRNA sense strand
guagaaaggacaugcugggau

SEQ ID NO: 14128 - RNA, 21 nt, Artificial Sequence
  Ebola virus siRNA sense strand
uagaaaggacaugcugggaug

SEQ ID NO: 14129 - RNA, 21 nt, Artificial Sequence
  Ebola virus siRNA sense strand
agaaaggacaugcugggaugc

SEQ ID NO: 14130 - RNA, 21 nt, Artificial Sequence
  Ebola virus siRNA sense strand
gaaaggacaugcugggaugca

SEQ ID NO: 14131 - RNA, 21 nt, Artificial Sequence
  Ebola virus siRNA sense strand
aaaggacaugcugggaugcag

SEQ ID NO: 14132 - RNA, 21 nt, Artificial Sequence
  Ebola virus siRNA sense strand
aaggacaugcugggaugcagu

SEQ ID NO: 14133 - RNA, 21 nt, Artificial Sequence
  Ebola virus siRNA sense strand
aggacaugcugggaugcagua

SEQ ID NO: 14134 - RNA, 21 nt, Artificial Sequence
  Ebola virus siRNA sense strand
ggacaugcugggaugcaguau

SEQ ID NO: 14135 - RNA, 21 nt, Artificial Sequence
  Ebola virus siRNA sense strand
gacaugcugggaugcaguauu

SEQ ID NO: 14136 - RNA, 21 nt, Artificial Sequence
  Ebola virus siRNA sense strand
acaugcugggaugcaguauuc

SEQ ID NO: 14137 - RNA, 21 nt, Artificial Sequence
  Ebola virus siRNA sense strand
caugcugggaugcaguauucg

SEQ ID NO: 14138 - RNA, 21 nt, Artificial Sequence
  Ebola virus siRNA sense strand
augcugggaugcaguauucga

SEQ ID NO: 14139 - RNA, 21 nt, Artificial Sequence
  Ebola virus siRNA sense strand
ugcugggaugcaguauucgag

SEQ ID NO: 14140 - RNA, 21 nt, Artificial Sequence
  Ebola virus siRNA sense strand
gcugggaugcaguauucgagc

SEQ ID NO: 14141 - RNA, 21 nt, Artificial Sequence
  Ebola virus siRNA sense strand
cugggaugcaguauucgagcc

SEQ ID NO: 14142 - RNA, 21 nt, Artificial Sequence
  Ebola virus siRNA sense strand
ugggaugcaguauucgagccu

SEQ ID NO: 14143 - RNA, 21 nt, Artificial Sequence
  Ebola virus siRNA sense strand
gggaugcaguauucgagccua

SEQ ID NO: 14144 - RNA, 21 nt, Artificial Sequence
  Ebola virus siRNA sense strand
ggaugcaguauucgagccuaa

SEQ ID NO: 14145 - RNA, 21 nt, Artificial Sequence
  Ebola virus siRNA sense strand
gaugcaguauucgagccuaau

SEQ ID NO: 14146 - RNA, 21 nt, Artificial Sequence
  Ebola virus siRNA sense strand
augcaguauucgagccuaaug

SEQ ID NO: 14147 - RNA, 21 nt, Artificial Sequence
  Ebola virus siRNA sense strand
ugcaguauucgagccuaaugu

SEQ ID NO: 14148 - RNA, 21 nt, Artificial Sequence
  Ebola virus siRNA sense strand
gcaguauucgagccuaauguu

SEQ ID NO: 14149 - RNA, 21 nt, Artificial Sequence
  Ebola virus siRNA sense strand
caguauucgagccuaauguuc

SEQ ID NO: 14150 - RNA, 21 nt, Artificial Sequence
  Ebola virus siRNA sense strand
aguauucgagccuaauguucu

SEQ ID NO: 14151 - RNA, 21 nt, Artificial Sequence
  Ebola virus siRNA sense strand
guauucgagccuaauguucua

SEQ ID NO: 14152 - RNA, 21 nt, Artificial Sequence
  Ebola virus siRNA sense strand
uauucgagccuaauguucuag

SEQ ID NO: 14153 - RNA, 21 nt, Artificial Sequence
  Ebola virus siRNA sense strand
auucgagccuaauguucuagg

SEQ ID NO: 14154 - RNA, 21 nt, Artificial Sequence
  Ebola virus siRNA sense strand
uucgagccuaauguucuagga

SEQ ID NO: 14155 - RNA, 21 nt, Artificial Sequence
  Ebola virus siRNA sense strand
ucgagccuaauguucuaggau

SEQ ID NO: 14156 - RNA, 21 nt, Artificial Sequence
  Ebola virus siRNA sense strand
cgagccuaauguucuaggaua

SEQ ID NO: 14157 - RNA, 21 nt, Artificial Sequence
  Ebola virus siRNA sense strand
gagccuaauguucuaggauau

SEQ ID NO: 14158 - RNA, 21 nt, Artificial Sequence
  Ebola virus siRNA sense strand
agccuaauguucuaggauaua

SEQ ID NO: 14159 - RNA, 21 nt, Artificial Sequence
  Ebola virus siRNA sense strand
gccuaauguucuaggauauaa

SEQ ID NO: 14160 - RNA, 21 nt, Artificial Sequence
  Ebola virus siRNA sense strand
ccuaauguucuaggauauaau

SEQ ID NO: 14161 - RNA, 21 nt, Artificial Sequence
  Ebola virus siRNA sense strand
cuaauguucuaggauauaauc

SEQ ID NO: 14162 - RNA, 21 nt, Artificial Sequence
  Ebola virus siRNA sense strand
uaauguucuaggauauaaucc

SEQ ID NO: 14163 - RNA, 21 nt, Artificial Sequence
  Ebola virus siRNA sense strand
aauguucuaggauauaaucca

SEQ ID NO: 14164 - RNA, 21 nt, Artificial Sequence
  Ebola virus siRNA sense strand
auguucuaggauauaauccac

SEQ ID NO: 14165 - RNA, 21 nt, Artificial Sequence
  Ebola virus siRNA sense strand
uguucuaggauauaauccacc

SEQ ID NO: 14166 - RNA, 21 nt, Artificial Sequence
  Ebola virus siRNA sense strand
guucuaggauauaauccaccu

SEQ ID NO: 14167 - RNA, 21 nt, Artificial Sequence
  Ebola virus siRNA sense strand
uucuaggauauaauccaccuc

SEQ ID NO: 14168 - RNA, 21 nt, Artificial Sequence
  Ebola virus siRNA sense strand
ucuaggauauaauccaccuca

SEQ ID NO: 14169 - RNA, 21 nt, Artificial Sequence
  Ebola virus siRNA sense strand
cuaggauauaauccaccucac

SEQ ID NO: 14170 - RNA, 21 nt, Artificial Sequence
  Ebola virus siRNA sense strand
uaggauauaauccaccucaca

SEQ ID NO: 14171 - RNA, 21 nt, Artificial Sequence
  Ebola virus siRNA sense strand
aggauauaauccaccucacaa

SEQ ID NO: 14172 - RNA, 21 nt, Artificial Sequence
  Ebola virus siRNA sense strand
ggauauaauccaccucacaaa

SEQ ID NO: 14173 - RNA, 21 nt, Artificial Sequence
  Ebola virus siRNA sense strand
gauauaauccaccucacaaau

SEQ ID NO: 14174 - RNA, 21 nt, Artificial Sequence
  Ebola virus siRNA sense strand
auauaauccaccucacaaauu

SEQ ID NO: 14175 - RNA, 21 nt, Artificial Sequence
  Ebola virus siRNA sense strand
uauaauccaccucacaaauuu

SEQ ID NO: 14176 - RNA, 21 nt, Artificial Sequence
  Ebola virus siRNA sense strand
auaauccaccucacaaauuua

SEQ ID NO: 14177 - RNA, 21 nt, Artificial Sequence
  Ebola virus siRNA sense strand
uaauccaccucacaaauuuag

SEQ ID NO: 14178 - RNA, 21 nt, Artificial Sequence
  Ebola virus siRNA sense strand
aauccaccucacaaauuuagu

SEQ ID NO: 14179 - RNA, 21 nt, Artificial Sequence
  Ebola virus siRNA sense strand
auccaccucacaaauuuagua

SEQ ID NO: 14180 - RNA, 21 nt, Artificial Sequence
  Ebola virus siRNA sense strand
uccaccucacaaauuuaguac

SEQ ID NO: 14181 - RNA, 21 nt, Artificial Sequence
  Ebola virus siRNA sense strand
ccaccucacaaauuuaguacu

SEQ ID NO: 14182 - RNA, 21 nt, Artificial Sequence
  Ebola virus siRNA sense strand
caccucacaaauuuaguacua

SEQ ID NO: 14183 - RNA, 21 nt, Artificial Sequence
  Ebola virus siRNA sense strand
accucacaaauuuaguacuaa

SEQ ID NO: 14184 - RNA, 21 nt, Artificial Sequence
  Ebola virus siRNA sense strand
ccucacaaauuuaguacuaaa

SEQ ID NO: 14185 - RNA, 21 nt, Artificial Sequence
  Ebola virus siRNA sense strand
cucacaaauuuaguacuaaac

SEQ ID NO: 14186 - RNA, 21 nt, Artificial Sequence
  Ebola virus siRNA sense strand
ucacaaauuuaguacuaaacg

SEQ ID NO: 14187 - RNA, 21 nt, Artificial Sequence
  Ebola virus siRNA sense strand
cacaaauuuaguacuaaacgu

SEQ ID NO: 14188 - RNA, 21 nt, Artificial Sequence
  Ebola virus siRNA sense strand
acaaauuuaguacuaaacgug

SEQ ID NO: 14189 - RNA, 21 nt, Artificial Sequence
  Ebola virus siRNA sense strand
caaauuuaguacuaaacgugu

SEQ ID NO: 14190 - RNA, 21 nt, Artificial Sequence
  Ebola virus siRNA sense strand
aaauuuaguacuaaacgugua

SEQ ID NO: 14191 - RNA, 21 nt, Artificial Sequence
  Ebola virus siRNA sense strand
aauuuaguacuaaacguguac

SEQ ID NO: 14192 - RNA, 21 nt, Artificial Sequence
  Ebola virus siRNA sense strand
auuuaguacuaaacguguacc

SEQ ID NO: 14193 - RNA, 21 nt, Artificial Sequence
  Ebola virus siRNA sense strand
uuuaguacuaaacguguaccg

SEQ ID NO: 14194 - RNA, 21 nt, Artificial Sequence
  Ebola virus siRNA sense strand
uuaguacuaaacguguaccgg

SEQ ID NO: 14195 - RNA, 21 nt, Artificial Sequence
  Ebola virus siRNA sense strand
uaguacuaaacguguaccgga

SEQ ID NO: 14196 - RNA, 21 nt, Artificial Sequence
  Ebola virus siRNA sense strand
aguacuaaacguguaccggaa

SEQ ID NO: 14197 - RNA, 21 nt, Artificial Sequence
  Ebola virus siRNA sense strand
guacuaaacguguaccggaac

SEQ ID NO: 14198 - RNA, 21 nt, Artificial Sequence
  Ebola virus siRNA sense strand
uacuaaacguguaccggaaca

SEQ ID NO: 14199 - RNA, 21 nt, Artificial Sequence
  Ebola virus siRNA sense strand
acuaaacguguaccggaacaa

SEQ ID NO: 14200 - RNA, 21 nt, Artificial Sequence
  Ebola virus siRNA sense strand
cuaaacguguaccggaacaau

SEQ ID NO: 14201 - RNA, 21 nt, Artificial Sequence
  Ebola virus siRNA sense strand
uaaacguguaccggaacaauu

SEQ ID NO: 14202 - RNA, 21 nt, Artificial Sequence
  Ebola virus siRNA sense strand
aaacguguaccggaacaauuu

SEQ ID NO: 14203 - RNA, 21 nt, Artificial Sequence
  Ebola virus siRNA sense strand
aacguguaccggaacaauuuu

SEQ ID NO: 14204 - RNA, 21 nt, Artificial Sequence
  Ebola virus siRNA sense strand
acguguaccggaacaauuuuu

SEQ ID NO: 14205 - RNA, 21 nt, Artificial Sequence
  Ebola virus siRNA sense strand
cguguaccggaacaauuuuua

SEQ ID NO: 14206 - RNA, 21 nt, Artificial Sequence
  Ebola virus siRNA sense strand
guguaccggaacaauuuuuag

SEQ ID NO: 14207 - RNA, 21 nt, Artificial Sequence
  Ebola virus siRNA sense strand
uguaccggaacaauuuuuaga

SEQ ID NO: 14208 - RNA, 21 nt, Artificial Sequence
  Ebola virus siRNA sense strand
guaccggaacaauuuuuagag

SEQ ID NO: 14209 - RNA, 21 nt, Artificial Sequence
  Ebola virus siRNA sense strand
uaccggaacaauuuuuagagc

SEQ ID NO: 14210 - RNA, 21 nt, Artificial Sequence
  Ebola virus siRNA sense strand
accggaacaauuuuuagagca

SEQ ID NO: 14211 - RNA, 21 nt, Artificial Sequence
  Ebola virus siRNA sense strand
ccggaacaauuuuuagagcaa

SEQ ID NO: 14212 - RNA, 21 nt, Artificial Sequence
  Ebola virus siRNA sense strand
cggaacaauuuuuagagcaag

SEQ ID NO: 14213 - RNA, 21 nt, Artificial Sequence
  Ebola virus siRNA sense strand
ggaacaauuuuuagagcaaga

SEQ ID NO: 14214 - RNA, 21 nt, Artificial Sequence
  Ebola virus siRNA sense strand
gaacaauuuuuagagcaagaa

SEQ ID NO: 14215 - RNA, 21 nt, Artificial Sequence
  Ebola virus siRNA sense strand
aacaauuuuuagagcaagaaa

SEQ ID NO: 14216 - RNA, 21 nt, Artificial Sequence
  Ebola virus siRNA sense strand
acaauuuuuagagcaagaaaa

SEQ ID NO: 14217 - RNA, 21 nt, Artificial Sequence
  Ebola virus siRNA sense strand
caauuuuuagagcaagaaaac

SEQ ID NO: 14218 - RNA, 21 nt, Artificial Sequence
  Ebola virus siRNA sense strand
aauuuuuagagcaagaaaacu

SEQ ID NO: 14219 - RNA, 21 nt, Artificial Sequence
  Ebola virus siRNA sense strand
auuuuuagagcaagaaaacuu

SEQ ID NO: 14220 - RNA, 21 nt, Artificial Sequence
  Ebola virus siRNA sense strand
uuuuuagagcaagaaaacuuu

SEQ ID NO: 14221 - RNA, 21 nt, Artificial Sequence
  Ebola virus siRNA sense strand
uuuuagagcaagaaaacuuuu

SEQ ID NO: 14222 - RNA, 21 nt, Artificial Sequence
  Ebola virus siRNA sense strand
uuuagagcaagaaaacuuuuc

SEQ ID NO: 14223 - RNA, 21 nt, Artificial Sequence
  Ebola virus siRNA sense strand
uuagagcaagaaaacuuuucu

SEQ ID NO: 14224 - RNA, 21 nt, Artificial Sequence
  Ebola virus siRNA sense strand
uagagcaagaaaacuuuucua

SEQ ID NO: 14225 - RNA, 21 nt, Artificial Sequence
  Ebola virus siRNA sense strand
agagcaagaaaacuuuucuau

SEQ ID NO: 14226 - RNA, 21 nt, Artificial Sequence
  Ebola virus siRNA sense strand
gagcaagaaaacuuuucuauu

SEQ ID NO: 14227 - RNA, 21 nt, Artificial Sequence
  Ebola virus siRNA sense strand
agcaagaaaacuuuucuauug

SEQ ID NO: 14228 - RNA, 21 nt, Artificial Sequence
  Ebola virus siRNA sense strand
gcaagaaaacuuuucuauuga

SEQ ID NO: 14229 - RNA, 21 nt, Artificial Sequence
  Ebola virus siRNA sense strand
caagaaaacuuuucuauugag

SEQ ID NO: 14230 - RNA, 21 nt, Artificial Sequence
  Ebola virus siRNA sense strand
aagaaaacuuuucuauugaga

SEQ ID NO: 14231 - RNA, 21 nt, Artificial Sequence
  Ebola virus siRNA sense strand
agaaaacuuuucuauugagaa

SEQ ID NO: 14232 - RNA, 21 nt, Artificial Sequence
  Ebola virus siRNA sense strand
gaaaacuuuucuauugagaau

SEQ ID NO: 14233 - RNA, 21 nt, Artificial Sequence
  Ebola virus siRNA sense strand
aaaacuuuucuauugagaaug

SEQ ID NO: 14234 - RNA, 21 nt, Artificial Sequence
  Ebola virus siRNA sense strand
aaacuuuucuauugagaaugu

SEQ ID NO: 14235 - RNA, 21 nt, Artificial Sequence
  Ebola virus siRNA sense strand
aacuuuucuauugagaauguu

SEQ ID NO: 14236 - RNA, 21 nt, Artificial Sequence
  Ebola virus siRNA sense strand
acuuuucuauugagaauguuc

SEQ ID NO: 14237 - RNA, 21 nt, Artificial Sequence
  Ebola virus siRNA sense strand
cuuuucuauugagaauguucu

SEQ ID NO: 14238 - RNA, 21 nt, Artificial Sequence
  Ebola virus siRNA sense strand
uuuucuauugagaauguucuu

SEQ ID NO: 14239 - RNA, 21 nt, Artificial Sequence
  Ebola virus siRNA sense strand
uuucuauugagaauguucuuu

SEQ ID NO: 14240 - RNA, 21 nt, Artificial Sequence
  Ebola virus siRNA sense strand
uucuauugagaauguucuuuc

SEQ ID NO: 14241 - RNA, 21 nt, Artificial Sequence
  Ebola virus siRNA sense strand
ucuauugagaauguucuuucc

SEQ ID NO: 14242 - RNA, 21 nt, Artificial Sequence
  Ebola virus siRNA sense strand
cuauugagaauguucuuuccu

SEQ ID NO: 14243 - RNA, 21 nt, Artificial Sequence
  Ebola virus siRNA sense strand
uauugagaauguucuuuccua

SEQ ID NO: 14244 - RNA, 21 nt, Artificial Sequence
  Ebola virus siRNA sense strand
auugagaauguucuuuccuac

SEQ ID NO: 14245 - RNA, 21 nt, Artificial Sequence
  Ebola virus siRNA sense strand
uugagaauguucuuuccuacg

SEQ ID NO: 14246 - RNA, 21 nt, Artificial Sequence
  Ebola virus siRNA sense strand
ugagaauguucuuuccuacgc

SEQ ID NO: 14247 - RNA, 21 nt, Artificial Sequence
  Ebola virus siRNA sense strand
gagaauguucuuuccuacgca

SEQ ID NO: 14248 - RNA, 21 nt, Artificial Sequence
  Ebola virus siRNA sense strand
agaauguucuuuccuacgcac

SEQ ID NO: 14249 - RNA, 21 nt, Artificial Sequence
  Ebola virus siRNA sense strand
gaauguucuuuccuacgcaca

SEQ ID NO: 14250 - RNA, 21 nt, Artificial Sequence
  Ebola virus siRNA sense strand
aauguucuuuccuacgcacaa

SEQ ID NO: 14251 - RNA, 21 nt, Artificial Sequence
  Ebola virus siRNA sense strand
auguucuuuccuacgcacaaa

SEQ ID NO: 14252 - RNA, 21 nt, Artificial Sequence
  Ebola virus siRNA sense strand
uguucuuuccuacgcacaaaa

SEQ ID NO: 14253 - RNA, 21 nt, Artificial Sequence
  Ebola virus siRNA sense strand
guucuuuccuacgcacaaaaa

SEQ ID NO: 14254 - RNA, 21 nt, Artificial Sequence
  Ebola virus siRNA sense strand
uucuuuccuacgcacaaaaac

SEQ ID NO: 14255 - RNA, 21 nt, Artificial Sequence
  Ebola virus siRNA sense strand
ucuuuccuacgcacaaaaacu

SEQ ID NO: 14256 - RNA, 21 nt, Artificial Sequence
  Ebola virus siRNA sense strand
cuuuccuacgcacaaaaacuc

SEQ ID NO: 14257 - RNA, 21 nt, Artificial Sequence
  Ebola virus siRNA sense strand
uuuccuacgcacaaaaacucg

SEQ ID NO: 14258 - RNA, 21 nt, Artificial Sequence
  Ebola virus siRNA sense strand
uuccuacgcacaaaaacucga

SEQ ID NO: 14259 - RNA, 21 nt, Artificial Sequence
  Ebola virus siRNA sense strand
uccuacgcacaaaaacucgag

SEQ ID NO: 14260 - RNA, 21 nt, Artificial Sequence
  Ebola virus siRNA sense strand
ccuacgcacaaaaacucgagu

SEQ ID NO: 14261 - RNA, 21 nt, Artificial Sequence
  Ebola virus siRNA sense strand
cuacgcacaaaaacucgagua

SEQ ID NO: 14262 - RNA, 21 nt, Artificial Sequence
  Ebola virus siRNA sense strand
uacgcacaaaaacucgaguau

SEQ ID NO: 14263 - RNA, 21 nt, Artificial Sequence
  Ebola virus siRNA sense strand
acgcacaaaaacucgaguauc

SEQ ID NO: 14264 - RNA, 21 nt, Artificial Sequence
  Ebola virus siRNA sense strand
cgcacaaaaacucgaguaucu

SEQ ID NO: 14265 - RNA, 21 nt, Artificial Sequence
  Ebola virus siRNA sense strand
gcacaaaaacucgaguaucua

SEQ ID NO: 14266 - RNA, 21 nt, Artificial Sequence
  Ebola virus siRNA sense strand
cacaaaaacucgaguaucuac

SEQ ID NO: 14267 - RNA, 21 nt, Artificial Sequence
  Ebola virus siRNA sense strand
acaaaaacucgaguaucuacu

SEQ ID NO: 14268 - RNA, 21 nt, Artificial Sequence
  Ebola virus siRNA sense strand
caaaaacucgaguaucuacua

SEQ ID NO: 14269 - RNA, 21 nt, Artificial Sequence
  Ebola virus siRNA sense strand
aaaaacucgaguaucuacuac

SEQ ID NO: 14270 - RNA, 21 nt, Artificial Sequence
  Ebola virus siRNA sense strand
aaaacucgaguaucuacuacc

SEQ ID NO: 14271 - RNA, 21 nt, Artificial Sequence
  Ebola virus siRNA sense strand
aaacucgaguaucuacuacca

SEQ ID NO: 14272 - RNA, 21 nt, Artificial Sequence
  Ebola virus siRNA sense strand
aacucgaguaucuacuaccac

SEQ ID NO: 14273 - RNA, 21 nt, Artificial Sequence
  Ebola virus siRNA sense strand
acucgaguaucuacuaccaca

SEQ ID NO: 14274 - RNA, 21 nt, Artificial Sequence
  Ebola virus siRNA sense strand
cucgaguaucuacuaccacaa

SEQ ID NO: 14275 - RNA, 21 nt, Artificial Sequence
  Ebola virus siRNA sense strand
ucgaguaucuacuaccacaau

SEQ ID NO: 14276 - RNA, 21 nt, Artificial Sequence
  Ebola virus siRNA sense strand
cgaguaucuacuaccacaaua

SEQ ID NO: 14277 - RNA, 21 nt, Artificial Sequence
  Ebola virus siRNA sense strand
gaguaucuacuaccacaauau

SEQ ID NO: 14278 - RNA, 21 nt, Artificial Sequence
  Ebola virus siRNA sense strand
aguaucuacuaccacaauauc

SEQ ID NO: 14279 - RNA, 21 nt, Artificial Sequence
  Ebola virus siRNA sense strand
guaucuacuaccacaauaucg

SEQ ID NO: 14280 - RNA, 21 nt, Artificial Sequence
  Ebola virus siRNA sense strand
uaucuacuaccacaauaucgg

SEQ ID NO: 14281 - RNA, 21 nt, Artificial Sequence
  Ebola virus siRNA sense strand
aucuacuaccacaauaucgga

SEQ ID NO: 14282 - RNA, 21 nt, Artificial Sequence
  Ebola virus siRNA sense strand
ucuacuaccacaauaucggaa

SEQ ID NO: 14283 - RNA, 21 nt, Artificial Sequence
  Ebola virus siRNA sense strand
cuacuaccacaauaucggaac

SEQ ID NO: 14284 - RNA, 21 nt, Artificial Sequence
  Ebola virus siRNA sense strand
uacuaccacaauaucggaacu

SEQ ID NO: 14285 - RNA, 21 nt, Artificial Sequence
  Ebola virus siRNA sense strand
acuaccacaauaucggaacuu

SEQ ID NO: 14286 - RNA, 21 nt, Artificial Sequence
  Ebola virus siRNA sense strand
cuaccacaauaucggaacuuu

SEQ ID NO: 14287 - RNA, 21 nt, Artificial Sequence
  Ebola virus siRNA sense strand
uaccacaauaucggaacuuuu

SEQ ID NO: 14288 - RNA, 21 nt, Artificial Sequence
  Ebola virus siRNA sense strand
accacaauaucggaacuuuuc

SEQ ID NO: 14289 - RNA, 21 nt, Artificial Sequence
  Ebola virus siRNA sense strand
ccacaauaucggaacuuuucu

SEQ ID NO: 14290 - RNA, 21 nt, Artificial Sequence
  Ebola virus siRNA sense strand
cacaauaucggaacuuuucuu

SEQ ID NO: 14291 - RNA, 21 nt, Artificial Sequence
  Ebola virus siRNA sense strand
acaauaucggaacuuuucuuu

SEQ ID NO: 14292 - RNA, 21 nt, Artificial Sequence
  Ebola virus siRNA sense strand
caauaucggaacuuuucuuuc

SEQ ID NO: 14293 - RNA, 21 nt, Artificial Sequence
  Ebola virus siRNA sense strand
aauaucggaacuuuucuuucu

SEQ ID NO: 14294 - RNA, 21 nt, Artificial Sequence
  Ebola virus siRNA sense strand
auaucggaacuuuucuuucuc

SEQ ID NO: 14295 - RNA, 21 nt, Artificial Sequence
  Ebola virus siRNA sense strand
uaucggaacuuuucuuucuca

SEQ ID NO: 14296 - RNA, 21 nt, Artificial Sequence
  Ebola virus siRNA sense strand
aucggaacuuuucuuucucau

SEQ ID NO: 14297 - RNA, 21 nt, Artificial Sequence
  Ebola virus siRNA sense strand
ucggaacuuuucuuucucauu

SEQ ID NO: 14298 - RNA, 21 nt, Artificial Sequence
  Ebola virus siRNA sense strand
cggaacuuuucuuucucauug

SEQ ID NO: 14299 - RNA, 21 nt, Artificial Sequence
  Ebola virus siRNA sense strand
ggaacuuuucuuucucauuga

SEQ ID NO: 14300 - RNA, 21 nt, Artificial Sequence
  Ebola virus siRNA sense strand
gaacuuuucuuucucauugaa

SEQ ID NO: 14301 - RNA, 21 nt, Artificial Sequence
  Ebola virus siRNA sense strand
aacuuuucuuucucauugaaa

SEQ ID NO: 14302 - RNA, 21 nt, Artificial Sequence
  Ebola virus siRNA sense strand
acuuuucuuucucauugaaag

SEQ ID NO: 14303 - RNA, 21 nt, Artificial Sequence
  Ebola virus siRNA sense strand
cuuuucuuucucauugaaaga

SEQ ID NO: 14304 - RNA, 21 nt, Artificial Sequence
  Ebola virus siRNA sense strand
uuuucuuucucauugaaagag

SEQ ID NO: 14305 - RNA, 21 nt, Artificial Sequence
  Ebola virus siRNA sense strand
uuucuuucucauugaaagaga

SEQ ID NO: 14306 - RNA, 21 nt, Artificial Sequence
  Ebola virus siRNA sense strand
uucuuucucauugaaagagaa

SEQ ID NO: 14307 - RNA, 21 nt, Artificial Sequence
  Ebola virus siRNA sense strand
ucuuucucauugaaagagaaa

SEQ ID NO: 14308 - RNA, 21 nt, Artificial Sequence
  Ebola virus siRNA sense strand
cuuucucauugaaagagaaag

SEQ ID NO: 14309 - RNA, 21 nt, Artificial Sequence
  Ebola virus siRNA sense strand
uuucucauugaaagagaaaga

SEQ ID NO: 14310 - RNA, 21 nt, Artificial Sequence
  Ebola virus siRNA sense strand
uucucauugaaagagaaagag

SEQ ID NO: 14311 - RNA, 21 nt, Artificial Sequence
  Ebola virus siRNA sense strand
ucucauugaaagagaaagagu

SEQ ID NO: 14312 - RNA, 21 nt, Artificial Sequence
  Ebola virus siRNA sense strand
cucauugaaagagaaagaguu

SEQ ID NO: 14313 - RNA, 21 nt, Artificial Sequence
  Ebola virus siRNA sense strand
ucauugaaagagaaagaguug

SEQ ID NO: 14314 - RNA, 21 nt, Artificial Sequence
  Ebola virus siRNA sense strand
cauugaaagagaaagaguuga

SEQ ID NO: 14315 - RNA, 21 nt, Artificial Sequence
  Ebola virus siRNA sense strand
auugaaagagaaagaguugaa

SEQ ID NO: 14316 - RNA, 21 nt, Artificial Sequence
  Ebola virus siRNA sense strand
uugaaagagaaagaguugaau

SEQ ID NO: 14317 - RNA, 21 nt, Artificial Sequence
  Ebola virus siRNA sense strand
ugaaagagaaagaguugaaug

SEQ ID NO: 14318 - RNA, 21 nt, Artificial Sequence
  Ebola virus siRNA sense strand
gaaagagaaagaguugaaugu

SEQ ID NO: 14319 - RNA, 21 nt, Artificial Sequence
  Ebola virus siRNA sense strand
aaagagaaagaguugaaugua

SEQ ID NO: 14320 - RNA, 21 nt, Artificial Sequence
  Ebola virus siRNA sense strand
aagagaaagaguugaauguag

SEQ ID NO: 14321 - RNA, 21 nt, Artificial Sequence
  Ebola virus siRNA sense strand
agagaaagaguugaauguagg

SEQ ID NO: 14322 - RNA, 21 nt, Artificial Sequence
  Ebola virus siRNA sense strand
gagaaagaguugaauguaggu

SEQ ID NO: 14323 - RNA, 21 nt, Artificial Sequence
  Ebola virus siRNA sense strand
agaaagaguugaauguaggua

SEQ ID NO: 14324 - RNA, 21 nt, Artificial Sequence
  Ebola virus siRNA sense strand
gaaagaguugaauguagguag

SEQ ID NO: 14325 - RNA, 21 nt, Artificial Sequence
  Ebola virus siRNA sense strand
aaagaguugaauguagguaga

SEQ ID NO: 14326 - RNA, 21 nt, Artificial Sequence
  Ebola virus siRNA sense strand
aagaguugaauguagguagaa

SEQ ID NO: 14327 - RNA, 21 nt, Artificial Sequence
  Ebola virus siRNA sense strand
agaguugaauguagguagaac

SEQ ID NO: 14328 - RNA, 21 nt, Artificial Sequence
  Ebola virus siRNA sense strand
gaguugaauguagguagaacc

SEQ ID NO: 14329 - RNA, 21 nt, Artificial Sequence
  Ebola virus siRNA sense strand
aguugaauguagguagaaccu

SEQ ID NO: 14330 - RNA, 21 nt, Artificial Sequence
  Ebola virus siRNA sense strand
guugaauguagguagaaccuu

SEQ ID NO: 14331 - RNA, 21 nt, Artificial Sequence
  Ebola virus siRNA sense strand
uugaauguagguagaaccuuc

SEQ ID NO: 14332 - RNA, 21 nt, Artificial Sequence
  Ebola virus siRNA sense strand
ugaauguagguagaaccuucg

SEQ ID NO: 14333 - RNA, 21 nt, Artificial Sequence
  Ebola virus siRNA sense strand
gaauguagguagaaccuucgg

SEQ ID NO: 14334 - RNA, 21 nt, Artificial Sequence
  Ebola virus siRNA sense strand
aauguagguagaaccuucgga

SEQ ID NO: 14335 - RNA, 21 nt, Artificial Sequence
  Ebola virus siRNA sense strand
auguagguagaaccuucggaa

SEQ ID NO: 14336 - RNA, 21 nt, Artificial Sequence
  Ebola virus siRNA sense strand
uguagguagaaccuucggaaa

SEQ ID NO: 14337 - RNA, 21 nt, Artificial Sequence
  Ebola virus siRNA sense strand
guagguagaaccuucggaaaa

SEQ ID NO: 14338 - RNA, 21 nt, Artificial Sequence
  Ebola virus siRNA sense strand
uagguagaaccuucggaaaau

SEQ ID NO: 14339 - RNA, 21 nt, Artificial Sequence
  Ebola virus siRNA sense strand
agguagaaccuucggaaaauu

SEQ ID NO: 14340 - RNA, 21 nt, Artificial Sequence
  Ebola virus siRNA sense strand
gguagaaccuucggaaaauug

SEQ ID NO: 14341 - RNA, 21 nt, Artificial Sequence
  Ebola virus siRNA sense strand
guagaaccuucggaaaauugc

SEQ ID NO: 14342 - RNA, 21 nt, Artificial Sequence
  Ebola virus siRNA sense strand
uagaaccuucggaaaauugcc

SEQ ID NO: 14343 - RNA, 21 nt, Artificial Sequence
  Ebola virus siRNA sense strand
agaaccuucggaaaauugccu

SEQ ID NO: 14344 - RNA, 21 nt, Artificial Sequence
  Ebola virus siRNA sense strand
gaaccuucggaaaauugccuu

SEQ ID NO: 14345 - RNA, 21 nt, Artificial Sequence
  Ebola virus siRNA sense strand
aaccuucggaaaauugccuua

SEQ ID NO: 14346 - RNA, 21 nt, Artificial Sequence
  Ebola virus siRNA sense strand
accuucggaaaauugccuuau

SEQ ID NO: 14347 - RNA, 21 nt, Artificial Sequence
  Ebola virus siRNA sense strand
ccuucggaaaauugccuuauc

SEQ ID NO: 14348 - RNA, 21 nt, Artificial Sequence
  Ebola virus siRNA sense strand
cuucggaaaauugccuuaucc

SEQ ID NO: 14349 - RNA, 21 nt, Artificial Sequence
  Ebola virus siRNA sense strand
uucggaaaauugccuuauccg

SEQ ID NO: 14350 - RNA, 21 nt, Artificial Sequence
  Ebola virus siRNA sense strand
ucggaaaauugccuuauccga

SEQ ID NO: 14351 - RNA, 21 nt, Artificial Sequence
  Ebola virus siRNA sense strand
cggaaaauugccuuauccgac

SEQ ID NO: 14352 - RNA, 21 nt, Artificial Sequence
  Ebola virus siRNA sense strand
ggaaaauugccuuauccgacu

SEQ ID NO: 14353 - RNA, 21 nt, Artificial Sequence
  Ebola virus siRNA sense strand
gaaaauugccuuauccgacuc

SEQ ID NO: 14354 - RNA, 21 nt, Artificial Sequence
  Ebola virus siRNA sense strand
aaaauugccuuauccgacucg

SEQ ID NO: 14355 - RNA, 21 nt, Artificial Sequence
  Ebola virus siRNA sense strand
aaauugccuuauccgacucgc

SEQ ID NO: 14356 - RNA, 21 nt, Artificial Sequence
  Ebola virus siRNA sense strand
aauugccuuauccgacucgca

SEQ ID NO: 14357 - RNA, 21 nt, Artificial Sequence
  Ebola virus siRNA sense strand
auugccuuauccgacucgcaa

SEQ ID NO: 14358 - RNA, 21 nt, Artificial Sequence
  Ebola virus siRNA sense strand
uugccuuauccgacucgcaau

SEQ ID NO: 14359 - RNA, 21 nt, Artificial Sequence
  Ebola virus siRNA sense strand
ugccuuauccgacucgcaaug

SEQ ID NO: 14360 - RNA, 21 nt, Artificial Sequence
  Ebola virus siRNA sense strand
gccuuauccgacucgcaaugu

SEQ ID NO: 14361 - RNA, 21 nt, Artificial Sequence
  Ebola virus siRNA sense strand
ccuuauccgacucgcaauguu

SEQ ID NO: 14362 - RNA, 21 nt, Artificial Sequence
  Ebola virus siRNA sense strand
cuuauccgacucgcaauguuc

SEQ ID NO: 14363 - RNA, 21 nt, Artificial Sequence
  Ebola virus siRNA sense strand
uuauccgacucgcaauguuca

SEQ ID NO: 14364 - RNA, 21 nt, Artificial Sequence
  Ebola virus siRNA sense strand
uauccgacucgcaauguucaa

SEQ ID NO: 14365 - RNA, 21 nt, Artificial Sequence
  Ebola virus siRNA sense strand
auccgacucgcaauguucaaa

SEQ ID NO: 14366 - RNA, 21 nt, Artificial Sequence
  Ebola virus siRNA sense strand
uccgacucgcaauguucaaac

SEQ ID NO: 14367 - RNA, 21 nt, Artificial Sequence
  Ebola virus siRNA sense strand
ccgacucgcaauguucaaaca

SEQ ID NO: 14368 - RNA, 21 nt, Artificial Sequence
  Ebola virus siRNA sense strand
cgacucgcaauguucaaacac

SEQ ID NO: 14369 - RNA, 21 nt, Artificial Sequence
  Ebola virus siRNA sense strand
gacucgcaauguucaaacacu

SEQ ID NO: 14370 - RNA, 21 nt, Artificial Sequence
  Ebola virus siRNA sense strand
acucgcaauguucaaacacuu

SEQ ID NO: 14371 - RNA, 21 nt, Artificial Sequence
  Ebola virus siRNA sense strand
cucgcaauguucaaacacuuu

SEQ ID NO: 14372 - RNA, 21 nt, Artificial Sequence
  Ebola virus siRNA sense strand
ucgcaauguucaaacacuuug

SEQ ID NO: 14373 - RNA, 21 nt, Artificial Sequence
  Ebola virus siRNA sense strand
cgcaauguucaaacacuuugu

SEQ ID NO: 14374 - RNA, 21 nt, Artificial Sequence
  Ebola virus siRNA sense strand
gcaauguucaaacacuuugug

SEQ ID NO: 14375 - RNA, 21 nt, Artificial Sequence
  Ebola virus siRNA sense strand
caauguucaaacacuuuguga

SEQ ID NO: 14376 - RNA, 21 nt, Artificial Sequence
  Ebola virus siRNA sense strand
aauguucaaacacuuugugaa

SEQ ID NO: 14377 - RNA, 21 nt, Artificial Sequence
  Ebola virus siRNA sense strand
auguucaaacacuuugugaag

SEQ ID NO: 14378 - RNA, 21 nt, Artificial Sequence
  Ebola virus siRNA sense strand
uguucaaacacuuugugaagc

SEQ ID NO: 14379 - RNA, 21 nt, Artificial Sequence
  Ebola virus siRNA sense strand
guucaaacacuuugugaagcu

SEQ ID NO: 14380 - RNA, 21 nt, Artificial Sequence
  Ebola virus siRNA sense strand
uucaaacacuuugugaagcuc

SEQ ID NO: 14381 - RNA, 21 nt, Artificial Sequence
  Ebola virus siRNA sense strand
ucaaacacuuugugaagcucu

SEQ ID NO: 14382 - RNA, 21 nt, Artificial Sequence
  Ebola virus siRNA sense strand
caaacacuuugugaagcucug

SEQ ID NO: 14383 - RNA, 21 nt, Artificial Sequence
  Ebola virus siRNA sense strand
aaacacuuugugaagcucugu

SEQ ID NO: 14384 - RNA, 21 nt, Artificial Sequence
  Ebola virus siRNA sense strand
aacacuuugugaagcucuguu

SEQ ID NO: 14385 - RNA, 21 nt, Artificial Sequence
  Ebola virus siRNA sense strand
acacuuugugaagcucuguua

SEQ ID NO: 14386 - RNA, 21 nt, Artificial Sequence
  Ebola virus siRNA sense strand
cacuuugugaagcucuguuag

SEQ ID NO: 14387 - RNA, 21 nt, Artificial Sequence
  Ebola virus siRNA sense strand
acuuugugaagcucuguuagc

SEQ ID NO: 14388 - RNA, 21 nt, Artificial Sequence
  Ebola virus siRNA sense strand
cuuugugaagcucuguuagcu

SEQ ID NO: 14389 - RNA, 21 nt, Artificial Sequence
  Ebola virus siRNA sense strand
uuugugaagcucuguuagcug

SEQ ID NO: 14390 - RNA, 21 nt, Artificial Sequence
  Ebola virus siRNA sense strand
uugugaagcucuguuagcuga

SEQ ID NO: 14391 - RNA, 21 nt, Artificial Sequence
  Ebola virus siRNA sense strand
ugugaagcucuguuagcugau

SEQ ID NO: 14392 - RNA, 21 nt, Artificial Sequence
  Ebola virus siRNA sense strand
gugaagcucuguuagcugaug

SEQ ID NO: 14393 - RNA, 21 nt, Artificial Sequence
  Ebola virus siRNA sense strand
ugaagcucuguuagcugaugg

SEQ ID NO: 14394 - RNA, 21 nt, Artificial Sequence
  Ebola virus siRNA sense strand
gaagcucuguuagcugauggu

SEQ ID NO: 14395 - RNA, 21 nt, Artificial Sequence
  Ebola virus siRNA sense strand
aagcucuguuagcugaugguc

SEQ ID NO: 14396 - RNA, 21 nt, Artificial Sequence
  Ebola virus siRNA sense strand
agcucuguuagcugauggucu

SEQ ID NO: 14397 - RNA, 21 nt, Artificial Sequence
  Ebola virus siRNA sense strand
gcucuguuagcugauggucuu

SEQ ID NO: 14398 - RNA, 21 nt, Artificial Sequence
  Ebola virus siRNA sense strand
cucuguuagcugauggucuug

SEQ ID NO: 14399 - RNA, 21 nt, Artificial Sequence
  Ebola virus siRNA sense strand
ucuguuagcugauggucuugc

SEQ ID NO: 14400 - RNA, 21 nt, Artificial Sequence
  Ebola virus siRNA sense strand
cuguuagcugauggucuugcu

SEQ ID NO: 14401 - RNA, 21 nt, Artificial Sequence
  Ebola virus siRNA sense strand
uguuagcugauggucuugcua

SEQ ID NO: 14402 - RNA, 21 nt, Artificial Sequence
  Ebola virus siRNA sense strand
guuagcugauggucuugcuaa

SEQ ID NO: 14403 - RNA, 21 nt, Artificial Sequence
  Ebola virus siRNA sense strand
uuagcugauggucuugcuaaa

SEQ ID NO: 14404 - RNA, 21 nt, Artificial Sequence
  Ebola virus siRNA sense strand
uagcugauggucuugcuaaag

SEQ ID NO: 14405 - RNA, 21 nt, Artificial Sequence
  Ebola virus siRNA sense strand
agcugauggucuugcuaaagc

SEQ ID NO: 14406 - RNA, 21 nt, Artificial Sequence
  Ebola virus siRNA sense strand
gcugauggucuugcuaaagca

SEQ ID NO: 14407 - RNA, 21 nt, Artificial Sequence
  Ebola virus siRNA sense strand
cugauggucuugcuaaagcau

SEQ ID NO: 14408 - RNA, 21 nt, Artificial Sequence
  Ebola virus siRNA sense strand
ugauggucuugcuaaagcauu

SEQ ID NO: 14409 - RNA, 21 nt, Artificial Sequence
  Ebola virus siRNA sense strand
gauggucuugcuaaagcauuu

SEQ ID NO: 14410 - RNA, 21 nt, Artificial Sequence
  Ebola virus siRNA sense strand
auggucuugcuaaagcauuuc

SEQ ID NO: 14411 - RNA, 21 nt, Artificial Sequence
  Ebola virus siRNA sense strand
uggucuugcuaaagcauuucc

SEQ ID NO: 14412 - RNA, 21 nt, Artificial Sequence
  Ebola virus siRNA sense strand
ggucuugcuaaagcauuuccu

SEQ ID NO: 14413 - RNA, 21 nt, Artificial Sequence
  Ebola virus siRNA sense strand
gucuugcuaaagcauuuccua

SEQ ID NO: 14414 - RNA, 21 nt, Artificial Sequence
  Ebola virus siRNA sense strand
ucuugcuaaagcauuuccuag

SEQ ID NO: 14415 - RNA, 21 nt, Artificial Sequence
  Ebola virus siRNA sense strand
cuugcuaaagcauuuccuagc

SEQ ID NO: 14416 - RNA, 21 nt, Artificial Sequence
  Ebola virus siRNA sense strand
uugcuaaagcauuuccuagca

SEQ ID NO: 14417 - RNA, 21 nt, Artificial Sequence
  Ebola virus siRNA sense strand
ugcuaaagcauuuccuagcaa

SEQ ID NO: 14418 - RNA, 21 nt, Artificial Sequence
  Ebola virus siRNA sense strand
gcuaaagcauuuccuagcaau

SEQ ID NO: 14419 - RNA, 21 nt, Artificial Sequence
  Ebola virus siRNA sense strand
cuaaagcauuuccuagcaaua

SEQ ID NO: 14420 - RNA, 21 nt, Artificial Sequence
  Ebola virus siRNA sense strand
uaaagcauuuccuagcaauau

SEQ ID NO: 14421 - RNA, 21 nt, Artificial Sequence
  Ebola virus siRNA sense strand
aaagcauuuccuagcaauaug

SEQ ID NO: 14422 - RNA, 21 nt, Artificial Sequence
  Ebola virus siRNA sense strand
aagcauuuccuagcaauauga

SEQ ID NO: 14423 - RNA, 21 nt, Artificial Sequence
  Ebola virus siRNA sense strand
agcauuuccuagcaauaugau

SEQ ID NO: 14424 - RNA, 21 nt, Artificial Sequence
  Ebola virus siRNA sense strand
gcauuuccuagcaauaugaug

SEQ ID NO: 14425 - RNA, 21 nt, Artificial Sequence
  Ebola virus siRNA sense strand
cauuuccuagcaauaugaugg

SEQ ID NO: 14426 - RNA, 21 nt, Artificial Sequence
  Ebola virus siRNA sense strand
auuuccuagcaauaugauggu

SEQ ID NO: 14427 - RNA, 21 nt, Artificial Sequence
  Ebola virus siRNA sense strand
uuuccuagcaauaugauggua

SEQ ID NO: 14428 - RNA, 21 nt, Artificial Sequence
  Ebola virus siRNA sense strand
uuccuagcaauaugaugguag

SEQ ID NO: 14429 - RNA, 21 nt, Artificial Sequence
  Ebola virus siRNA sense strand
uccuagcaauaugaugguagu

SEQ ID NO: 14430 - RNA, 21 nt, Artificial Sequence
  Ebola virus siRNA sense strand
ccuagcaauaugaugguaguu

SEQ ID NO: 14431 - RNA, 21 nt, Artificial Sequence
  Ebola virus siRNA sense strand
cuagcaauaugaugguaguua

SEQ ID NO: 14432 - RNA, 21 nt, Artificial Sequence
  Ebola virus siRNA sense strand
uagcaauaugaugguaguuac

SEQ ID NO: 14433 - RNA, 21 nt, Artificial Sequence
  Ebola virus siRNA sense strand
agcaauaugaugguaguuacg

SEQ ID NO: 14434 - RNA, 21 nt, Artificial Sequence
  Ebola virus siRNA sense strand
gcaauaugaugguaguuacgg

SEQ ID NO: 14435 - RNA, 21 nt, Artificial Sequence
  Ebola virus siRNA sense strand
caauaugaugguaguuacgga

SEQ ID NO: 14436 - RNA, 21 nt, Artificial Sequence
  Ebola virus siRNA sense strand
aauaugaugguaguuacggaa

SEQ ID NO: 14437 - RNA, 21 nt, Artificial Sequence
  Ebola virus siRNA sense strand
auaugaugguaguuacggaac

SEQ ID NO: 14438 - RNA, 21 nt, Artificial Sequence
  Ebola virus siRNA sense strand
uaugaugguaguuacggaacg

SEQ ID NO: 14439 - RNA, 21 nt, Artificial Sequence
  Ebola virus siRNA sense strand
augaugguaguuacggaacgu

SEQ ID NO: 14440 - RNA, 21 nt, Artificial Sequence
  Ebola virus siRNA sense strand
ugaugguaguuacggaacgug

SEQ ID NO: 14441 - RNA, 21 nt, Artificial Sequence
  Ebola virus siRNA sense strand
gaugguaguuacggaacguga

SEQ ID NO: 14442 - RNA, 21 nt, Artificial Sequence
  Ebola virus siRNA sense strand
augguaguuacggaacgugag

SEQ ID NO: 14443 - RNA, 21 nt, Artificial Sequence
  Ebola virus siRNA sense strand
ugguaguuacggaacgugagc

SEQ ID NO: 14444 - RNA, 21 nt, Artificial Sequence
  Ebola virus siRNA sense strand
gguaguuacggaacgugagca

SEQ ID NO: 14445 - RNA, 21 nt, Artificial Sequence
  Ebola virus siRNA sense strand
guaguuacggaacgugagcaa

SEQ ID NO: 14446 - RNA, 21 nt, Artificial Sequence
  Ebola virus siRNA sense strand
uaguuacggaacgugagcaaa

SEQ ID NO: 14447 - RNA, 21 nt, Artificial Sequence
  Ebola virus siRNA sense strand
aguuacggaacgugagcaaaa

SEQ ID NO: 14448 - RNA, 21 nt, Artificial Sequence
  Ebola virus siRNA sense strand
guuacggaacgugagcaaaaa

SEQ ID NO: 14449 - RNA, 21 nt, Artificial Sequence
  Ebola virus siRNA sense strand
uuacggaacgugagcaaaaag

SEQ ID NO: 14450 - RNA, 21 nt, Artificial Sequence
  Ebola virus siRNA sense strand
uacggaacgugagcaaaaaga

SEQ ID NO: 14451 - RNA, 21 nt, Artificial Sequence
  Ebola virus siRNA sense strand
acggaacgugagcaaaaagaa

SEQ ID NO: 14452 - RNA, 21 nt, Artificial Sequence
  Ebola virus siRNA sense strand
cggaacgugagcaaaaagaaa

SEQ ID NO: 14453 - RNA, 21 nt, Artificial Sequence
  Ebola virus siRNA sense strand
ggaacgugagcaaaaagaaag

SEQ ID NO: 14454 - RNA, 21 nt, Artificial Sequence
  Ebola virus siRNA sense strand
gaacgugagcaaaaagaaagc

SEQ ID NO: 14455 - RNA, 21 nt, Artificial Sequence
  Ebola virus siRNA sense strand
aacgugagcaaaaagaaagcu

SEQ ID NO: 14456 - RNA, 21 nt, Artificial Sequence
  Ebola virus siRNA sense strand
acgugagcaaaaagaaagcuu

SEQ ID NO: 14457 - RNA, 21 nt, Artificial Sequence
  Ebola virus siRNA sense strand
cgugagcaaaaagaaagcuua

SEQ ID NO: 14458 - RNA, 21 nt, Artificial Sequence
  Ebola virus siRNA sense strand
gugagcaaaaagaaagcuuau

SEQ ID NO: 14459 - RNA, 21 nt, Artificial Sequence
  Ebola virus siRNA sense strand
ugagcaaaaagaaagcuuauu

SEQ ID NO: 14460 - RNA, 21 nt, Artificial Sequence
  Ebola virus siRNA sense strand
gagcaaaaagaaagcuuauug

SEQ ID NO: 14461 - RNA, 21 nt, Artificial Sequence
  Ebola virus siRNA sense strand
agcaaaaagaaagcuuauugc

SEQ ID NO: 14462 - RNA, 21 nt, Artificial Sequence
  Ebola virus siRNA sense strand
gcaaaaagaaagcuuauugca

SEQ ID NO: 14463 - RNA, 21 nt, Artificial Sequence
  Ebola virus siRNA sense strand
caaaaagaaagcuuauugcau

SEQ ID NO: 14464 - RNA, 21 nt, Artificial Sequence
  Ebola virus siRNA sense strand
aaaaagaaagcuuauugcauc

SEQ ID NO: 14465 - RNA, 21 nt, Artificial Sequence
  Ebola virus siRNA sense strand
aaaagaaagcuuauugcauca

SEQ ID NO: 14466 - RNA, 21 nt, Artificial Sequence
  Ebola virus siRNA sense strand
aaagaaagcuuauugcaucaa

SEQ ID NO: 14467 - RNA, 21 nt, Artificial Sequence
  Ebola virus siRNA sense strand
aagaaagcuuauugcaucaag

SEQ ID NO: 14468 - RNA, 21 nt, Artificial Sequence
  Ebola virus siRNA sense strand
agaaagcuuauugcaucaagc

SEQ ID NO: 14469 - RNA, 21 nt, Artificial Sequence
  Ebola virus siRNA sense strand
gaaagcuuauugcaucaagca

SEQ ID NO: 14470 - RNA, 21 nt, Artificial Sequence
  Ebola virus siRNA sense strand
aaagcuuauugcaucaagcau

SEQ ID NO: 14471 - RNA, 21 nt, Artificial Sequence
  Ebola virus siRNA sense strand
aagcuuauugcaucaagcauc

SEQ ID NO: 14472 - RNA, 21 nt, Artificial Sequence
  Ebola virus siRNA sense strand
agcuuauugcaucaagcauca

SEQ ID NO: 14473 - RNA, 21 nt, Artificial Sequence
  Ebola virus siRNA sense strand
gcuuauugcaucaagcaucau

SEQ ID NO: 14474 - RNA, 21 nt, Artificial Sequence
  Ebola virus siRNA sense strand
cuuauugcaucaagcaucaug

SEQ ID NO: 14475 - RNA, 21 nt, Artificial Sequence
  Ebola virus siRNA sense strand
uuauugcaucaagcaucaugg

SEQ ID NO: 14476 - RNA, 21 nt, Artificial Sequence
  Ebola virus siRNA sense strand
uauugcaucaagcaucauggc

SEQ ID NO: 14477 - RNA, 21 nt, Artificial Sequence
  Ebola virus siRNA sense strand
auugcaucaagcaucauggca

SEQ ID NO: 14478 - RNA, 21 nt, Artificial Sequence
  Ebola virus siRNA sense strand
uugcaucaagcaucauggcac

SEQ ID NO: 14479 - RNA, 21 nt, Artificial Sequence
  Ebola virus siRNA sense strand
ugcaucaagcaucauggcacc

SEQ ID NO: 14480 - RNA, 21 nt, Artificial Sequence
  Ebola virus siRNA sense strand
gcaucaagcaucauggcacca

SEQ ID NO: 14481 - RNA, 21 nt, Artificial Sequence
  Ebola virus siRNA sense strand
caucaagcaucauggcaccac

SEQ ID NO: 14482 - RNA, 21 nt, Artificial Sequence
  Ebola virus siRNA sense strand
aucaagcaucauggcaccaca

SEQ ID NO: 14483 - RNA, 21 nt, Artificial Sequence
  Ebola virus siRNA sense strand
ucaagcaucauggcaccacac

SEQ ID NO: 14484 - RNA, 21 nt, Artificial Sequence
  Ebola virus siRNA sense strand
caagcaucauggcaccacaca

SEQ ID NO: 14485 - RNA, 21 nt, Artificial Sequence
  Ebola virus siRNA sense strand
aagcaucauggcaccacacaa

SEQ ID NO: 14486 - RNA, 21 nt, Artificial Sequence
  Ebola virus siRNA sense strand
agcaucauggcaccacacaag

SEQ ID NO: 14487 - RNA, 21 nt, Artificial Sequence
  Ebola virus siRNA sense strand
gcaucauggcaccacacaagu

SEQ ID NO: 14488 - RNA, 21 nt, Artificial Sequence
  Ebola virus siRNA sense strand
caucauggcaccacacaagug

SEQ ID NO: 14489 - RNA, 21 nt, Artificial Sequence
  Ebola virus siRNA sense strand
aucauggcaccacacaaguga

SEQ ID NO: 14490 - RNA, 21 nt, Artificial Sequence
  Ebola virus siRNA sense strand
ucauggcaccacacaagugau

SEQ ID NO: 14491 - RNA, 21 nt, Artificial Sequence
  Ebola virus siRNA sense strand
cauggcaccacacaagugaug

SEQ ID NO: 14492 - RNA, 21 nt, Artificial Sequence
  Ebola virus siRNA sense strand
auggcaccacacaagugauga

SEQ ID NO: 14493 - RNA, 21 nt, Artificial Sequence
  Ebola virus siRNA sense strand
uggcaccacacaagugaugau

SEQ ID NO: 14494 - RNA, 21 nt, Artificial Sequence
  Ebola virus siRNA sense strand
ggcaccacacaagugaugauu

SEQ ID NO: 14495 - RNA, 21 nt, Artificial Sequence
  Ebola virus siRNA sense strand
gcaccacacaagugaugauuu

SEQ ID NO: 14496 - RNA, 21 nt, Artificial Sequence
  Ebola virus siRNA sense strand
caccacacaagugaugauuuu

SEQ ID NO: 14497 - RNA, 21 nt, Artificial Sequence
  Ebola virus siRNA sense strand
accacacaagugaugauuuug

SEQ ID NO: 14498 - RNA, 21 nt, Artificial Sequence
  Ebola virus siRNA sense strand
ccacacaagugaugauuuugg

SEQ ID NO: 14499 - RNA, 21 nt, Artificial Sequence
  Ebola virus siRNA sense strand
cacacaagugaugauuuuggu

SEQ ID NO: 14500 - RNA, 21 nt, Artificial Sequence
  Ebola virus siRNA sense strand
acacaagugaugauuuuggug

SEQ ID NO: 14501 - RNA, 21 nt, Artificial Sequence
  Ebola virus siRNA sense strand
cacaagugaugauuuugguga

SEQ ID NO: 14502 - RNA, 21 nt, Artificial Sequence
  Ebola virus siRNA sense strand
acaagugaugauuuuggugaa

SEQ ID NO: 14503 - RNA, 21 nt, Artificial Sequence
  Ebola virus siRNA sense strand
caagugaugauuuuggugaac

SEQ ID NO: 14504 - RNA, 21 nt, Artificial Sequence
  Ebola virus siRNA sense strand
aagugaugauuuuggugaaca

SEQ ID NO: 14505 - RNA, 21 nt, Artificial Sequence
  Ebola virus siRNA sense strand
agugaugauuuuggugaacau

SEQ ID NO: 14506 - RNA, 21 nt, Artificial Sequence
  Ebola virus siRNA sense strand
gugaugauuuuggugaacaug

SEQ ID NO: 14507 - RNA, 21 nt, Artificial Sequence
  Ebola virus siRNA sense strand
ugaugauuuuggugaacaugc

SEQ ID NO: 14508 - RNA, 21 nt, Artificial Sequence
  Ebola virus siRNA sense strand
gaugauuuuggugaacaugcc

SEQ ID NO: 14509 - RNA, 21 nt, Artificial Sequence
  Ebola virus siRNA sense strand
augauuuuggugaacaugcca

SEQ ID NO: 14510 - RNA, 21 nt, Artificial Sequence
  Ebola virus siRNA sense strand
ugauuuuggugaacaugccac

SEQ ID NO: 14511 - RNA, 21 nt, Artificial Sequence
  Ebola virus siRNA sense strand
gauuuuggugaacaugccaca

SEQ ID NO: 14512 - RNA, 21 nt, Artificial Sequence
  Ebola virus siRNA sense strand
auuuuggugaacaugccacag

SEQ ID NO: 14513 - RNA, 21 nt, Artificial Sequence
  Ebola virus siRNA sense strand
uuuuggugaacaugccacagu

SEQ ID NO: 14514 - RNA, 21 nt, Artificial Sequence
  Ebola virus siRNA sense strand
uuuggugaacaugccacaguu

SEQ ID NO: 14515 - RNA, 21 nt, Artificial Sequence
  Ebola virus siRNA sense strand
uuggugaacaugccacaguua

SEQ ID NO: 14516 - RNA, 21 nt, Artificial Sequence
  Ebola virus siRNA sense strand
uggugaacaugccacaguuag

SEQ ID NO: 14517 - RNA, 21 nt, Artificial Sequence
  Ebola virus siRNA sense strand
ggugaacaugccacaguuaga

SEQ ID NO: 14518 - RNA, 21 nt, Artificial Sequence
  Ebola virus siRNA sense strand
gugaacaugccacaguuagag

SEQ ID NO: 14519 - RNA, 21 nt, Artificial Sequence
  Ebola virus siRNA sense strand
ugaacaugccacaguuagagg

SEQ ID NO: 14520 - RNA, 21 nt, Artificial Sequence
  Ebola virus siRNA sense strand
gaacaugccacaguuagaggg

SEQ ID NO: 14521 - RNA, 21 nt, Artificial Sequence
  Ebola virus siRNA sense strand
aacaugccacaguuagaggga

SEQ ID NO: 14522 - RNA, 21 nt, Artificial Sequence
  Ebola virus siRNA sense strand
acaugccacaguuagagggag

SEQ ID NO: 14523 - RNA, 21 nt, Artificial Sequence
  Ebola virus siRNA sense strand
caugccacaguuagagggagu

SEQ ID NO: 14524 - RNA, 21 nt, Artificial Sequence
  Ebola virus siRNA sense strand
augccacaguuagagggagua

SEQ ID NO: 14525 - RNA, 21 nt, Artificial Sequence
  Ebola virus siRNA sense strand
ugccacaguuagagggaguag

SEQ ID NO: 14526 - RNA, 21 nt, Artificial Sequence
  Ebola virus siRNA sense strand
gccacaguuagagggaguagc

SEQ ID NO: 14527 - RNA, 21 nt, Artificial Sequence
  Ebola virus siRNA sense strand
ccacaguuagagggaguagcu

SEQ ID NO: 14528 - RNA, 21 nt, Artificial Sequence
  Ebola virus siRNA sense strand
cacaguuagagggaguagcuu

SEQ ID NO: 14529 - RNA, 21 nt, Artificial Sequence
  Ebola virus siRNA sense strand
acaguuagagggaguagcuuu

SEQ ID NO: 14530 - RNA, 21 nt, Artificial Sequence
  Ebola virus siRNA sense strand
caguuagagggaguagcuuug

SEQ ID NO: 14531 - RNA, 21 nt, Artificial Sequence
  Ebola virus siRNA sense strand
aguuagagggaguagcuuugu

SEQ ID NO: 14532 - RNA, 21 nt, Artificial Sequence
  Ebola virus siRNA sense strand
guuagagggaguagcuuugua

SEQ ID NO: 14533 - RNA, 21 nt, Artificial Sequence
  Ebola virus siRNA sense strand
uuagagggaguagcuuuguaa

SEQ ID NO: 14534 - RNA, 21 nt, Artificial Sequence
  Ebola virus siRNA sense strand
uagagggaguagcuuuguaac

SEQ ID NO: 14535 - RNA, 21 nt, Artificial Sequence
  Ebola virus siRNA sense strand
agagggaguagcuuuguaacu

SEQ ID NO: 14536 - RNA, 21 nt, Artificial Sequence
  Ebola virus siRNA sense strand
gagggaguagcuuuguaacug

SEQ ID NO: 14537 - RNA, 21 nt, Artificial Sequence
  Ebola virus siRNA sense strand
agggaguagcuuuguaacuga

SEQ ID NO: 14538 - RNA, 21 nt, Artificial Sequence
  Ebola virus siRNA sense strand
gggaguagcuuuguaacugau

SEQ ID NO: 14539 - RNA, 21 nt, Artificial Sequence
  Ebola virus siRNA sense strand
ggaguagcuuuguaacugauu

SEQ ID NO: 14540 - RNA, 21 nt, Artificial Sequence
  Ebola virus siRNA sense strand
gaguagcuuuguaacugauuu

SEQ ID NO: 14541 - RNA, 21 nt, Artificial Sequence
  Ebola virus siRNA sense strand
aguagcuuuguaacugauuua

SEQ ID NO: 14542 - RNA, 21 nt, Artificial Sequence
  Ebola virus siRNA sense strand
guagcuuuguaacugauuuag

SEQ ID NO: 14543 - RNA, 21 nt, Artificial Sequence
  Ebola virus siRNA sense strand
uagcuuuguaacugauuuaga

SEQ ID NO: 14544 - RNA, 21 nt, Artificial Sequence
  Ebola virus siRNA sense strand
agcuuuguaacugauuuagag

SEQ ID NO: 14545 - RNA, 21 nt, Artificial Sequence
  Ebola virus siRNA sense strand
gcuuuguaacugauuuagaga

SEQ ID NO: 14546 - RNA, 21 nt, Artificial Sequence
  Ebola virus siRNA sense strand
cuuuguaacugauuuagagaa

SEQ ID NO: 14547 - RNA, 21 nt, Artificial Sequence
  Ebola virus siRNA sense strand
uuuguaacugauuuagagaaa

SEQ ID NO: 14548 - RNA, 21 nt, Artificial Sequence
  Ebola virus siRNA sense strand
uuguaacugauuuagagaaau

SEQ ID NO: 14549 - RNA, 21 nt, Artificial Sequence
  Ebola virus siRNA sense strand
uguaacugauuuagagaaaua

SEQ ID NO: 14550 - RNA, 21 nt, Artificial Sequence
  Ebola virus siRNA sense strand
guaacugauuuagagaaauac

SEQ ID NO: 14551 - RNA, 21 nt, Artificial Sequence
  Ebola virus siRNA sense strand
uaacugauuuagagaaauaca

SEQ ID NO: 14552 - RNA, 21 nt, Artificial Sequence
  Ebola virus siRNA sense strand
aacugauuuagagaaauacaa

SEQ ID NO: 14553 - RNA, 21 nt, Artificial Sequence
  Ebola virus siRNA sense strand
acugauuuagagaaauacaau

SEQ ID NO: 14554 - RNA, 21 nt, Artificial Sequence
  Ebola virus siRNA sense strand
cugauuuagagaaauacaauc

SEQ ID NO: 14555 - RNA, 21 nt, Artificial Sequence
  Ebola virus siRNA sense strand
ugauuuagagaaauacaaucu

SEQ ID NO: 14556 - RNA, 21 nt, Artificial Sequence
  Ebola virus siRNA sense strand
gauuuagagaaauacaaucuu

SEQ ID NO: 14557 - RNA, 21 nt, Artificial Sequence
  Ebola virus siRNA sense strand
auuuagagaaauacaaucuug

SEQ ID NO: 14558 - RNA, 21 nt, Artificial Sequence
  Ebola virus siRNA sense strand
uuuagagaaauacaaucuugc

SEQ ID NO: 14559 - RNA, 21 nt, Artificial Sequence
  Ebola virus siRNA sense strand
uuagagaaauacaaucuugca

SEQ ID NO: 14560 - RNA, 21 nt, Artificial Sequence
  Ebola virus siRNA sense strand
uagagaaauacaaucuugcau

SEQ ID NO: 14561 - RNA, 21 nt, Artificial Sequence
  Ebola virus siRNA sense strand
agagaaauacaaucuugcauu

SEQ ID NO: 14562 - RNA, 21 nt, Artificial Sequence
  Ebola virus siRNA sense strand
gagaaauacaaucuugcauuu

SEQ ID NO: 14563 - RNA, 21 nt, Artificial Sequence
  Ebola virus siRNA sense strand
agaaauacaaucuugcauuua

SEQ ID NO: 14564 - RNA, 21 nt, Artificial Sequence
  Ebola virus siRNA sense strand
gaaauacaaucuugcauuuag

SEQ ID NO: 14565 - RNA, 21 nt, Artificial Sequence
  Ebola virus siRNA sense strand
aaauacaaucuugcauuuaga

SEQ ID NO: 14566 - RNA, 21 nt, Artificial Sequence
  Ebola virus siRNA sense strand
aauacaaucuugcauuuagau

SEQ ID NO: 14567 - RNA, 21 nt, Artificial Sequence
  Ebola virus siRNA sense strand
auacaaucuugcauuuagaua

SEQ ID NO: 14568 - RNA, 21 nt, Artificial Sequence
  Ebola virus siRNA sense strand
uacaaucuugcauuuagauau

SEQ ID NO: 14569 - RNA, 21 nt, Artificial Sequence
  Ebola virus siRNA sense strand
acaaucuugcauuuagauaug

SEQ ID NO: 14570 - RNA, 21 nt, Artificial Sequence
  Ebola virus siRNA sense strand
caaucuugcauuuagauauga

SEQ ID NO: 14571 - RNA, 21 nt, Artificial Sequence
  Ebola virus siRNA sense strand
aaucuugcauuuagauaugag

SEQ ID NO: 14572 - RNA, 21 nt, Artificial Sequence
  Ebola virus siRNA sense strand
aucuugcauuuagauaugagu

SEQ ID NO: 14573 - RNA, 21 nt, Artificial Sequence
  Ebola virus siRNA sense strand
ucuugcauuuagauaugaguu

SEQ ID NO: 14574 - RNA, 21 nt, Artificial Sequence
  Ebola virus siRNA sense strand
cuugcauuuagauaugaguuu

SEQ ID NO: 14575 - RNA, 21 nt, Artificial Sequence
  Ebola virus siRNA sense strand
uugcauuuagauaugaguuua

SEQ ID NO: 14576 - RNA, 21 nt, Artificial Sequence
  Ebola virus siRNA sense strand
ugcauuuagauaugaguuuac

SEQ ID NO: 14577 - RNA, 21 nt, Artificial Sequence
  Ebola virus siRNA sense strand
gcauuuagauaugaguuuaca

SEQ ID NO: 14578 - RNA, 21 nt, Artificial Sequence
  Ebola virus siRNA sense strand
cauuuagauaugaguuuacag

SEQ ID NO: 14579 - RNA, 21 nt, Artificial Sequence
  Ebola virus siRNA sense strand
auuuagauaugaguuuacagc

SEQ ID NO: 14580 - RNA, 21 nt, Artificial Sequence
  Ebola virus siRNA sense strand
uuuagauaugaguuuacagca

SEQ ID NO: 14581 - RNA, 21 nt, Artificial Sequence
  Ebola virus siRNA sense strand
uuagauaugaguuuacagcac

SEQ ID NO: 14582 - RNA, 21 nt, Artificial Sequence
  Ebola virus siRNA sense strand
uagauaugaguuuacagcacc

SEQ ID NO: 14583 - RNA, 21 nt, Artificial Sequence
  Ebola virus siRNA sense strand
agauaugaguuuacagcaccu

SEQ ID NO: 14584 - RNA, 21 nt, Artificial Sequence
  Ebola virus siRNA sense strand
gauaugaguuuacagcaccuu

SEQ ID NO: 14585 - RNA, 21 nt, Artificial Sequence
  Ebola virus siRNA sense strand
auaugaguuuacagcaccuuu

SEQ ID NO: 14586 - RNA, 21 nt, Artificial Sequence
  Ebola virus siRNA sense strand
uaugaguuuacagcaccuuuu

SEQ ID NO: 14587 - RNA, 21 nt, Artificial Sequence
  Ebola virus siRNA sense strand
augaguuuacagcaccuuuua

SEQ ID NO: 14588 - RNA, 21 nt, Artificial Sequence
  Ebola virus siRNA sense strand
ugaguuuacagcaccuuuuau

SEQ ID NO: 14589 - RNA, 21 nt, Artificial Sequence
  Ebola virus siRNA sense strand
gaguuuacagcaccuuuuaua

SEQ ID NO: 14590 - RNA, 21 nt, Artificial Sequence
  Ebola virus siRNA sense strand
aguuuacagcaccuuuuauag

SEQ ID NO: 14591 - RNA, 21 nt, Artificial Sequence
  Ebola virus siRNA sense strand
guuuacagcaccuuuuauaga

SEQ ID NO: 14592 - RNA, 21 nt, Artificial Sequence
  Ebola virus siRNA sense strand
uuuacagcaccuuuuauagaa

SEQ ID NO: 14593 - RNA, 21 nt, Artificial Sequence
  Ebola virus siRNA sense strand
uuacagcaccuuuuauagaau

SEQ ID NO: 14594 - RNA, 21 nt, Artificial Sequence
  Ebola virus siRNA sense strand
uacagcaccuuuuauagaaua

SEQ ID NO: 14595 - RNA, 21 nt, Artificial Sequence
  Ebola virus siRNA sense strand
acagcaccuuuuauagaauau

SEQ ID NO: 14596 - RNA, 21 nt, Artificial Sequence
  Ebola virus siRNA sense strand
cagcaccuuuuauagaauauu

SEQ ID NO: 14597 - RNA, 21 nt, Artificial Sequence
  Ebola virus siRNA sense strand
agcaccuuuuauagaauauug

SEQ ID NO: 14598 - RNA, 21 nt, Artificial Sequence
  Ebola virus siRNA sense strand
gcaccuuuuauagaauauugc

SEQ ID NO: 14599 - RNA, 21 nt, Artificial Sequence
  Ebola virus siRNA sense strand
caccuuuuauagaauauugca

SEQ ID NO: 14600 - RNA, 21 nt, Artificial Sequence
  Ebola virus siRNA sense strand
accuuuuauagaauauugcaa

SEQ ID NO: 14601 - RNA, 21 nt, Artificial Sequence
  Ebola virus siRNA sense strand
ccuuuuauagaauauugcaac

SEQ ID NO: 14602 - RNA, 21 nt, Artificial Sequence
  Ebola virus siRNA sense strand
cuuuuauagaauauugcaacc

SEQ ID NO: 14603 - RNA, 21 nt, Artificial Sequence
  Ebola virus siRNA sense strand
uuuuauagaauauugcaaccg

SEQ ID NO: 14604 - RNA, 21 nt, Artificial Sequence
  Ebola virus siRNA sense strand
uuuauagaauauugcaaccgu

SEQ ID NO: 14605 - RNA, 21 nt, Artificial Sequence
  Ebola virus siRNA sense strand
uuauagaauauugcaaccguu

SEQ ID NO: 14606 - RNA, 21 nt, Artificial Sequence
  Ebola virus siRNA sense strand
uauagaauauugcaaccguug

SEQ ID NO: 14607 - RNA, 21 nt, Artificial Sequence
  Ebola virus siRNA sense strand
auagaauauugcaaccguugc

SEQ ID NO: 14608 - RNA, 21 nt, Artificial Sequence
  Ebola virus siRNA sense strand
uagaauauugcaaccguugcu

SEQ ID NO: 14609 - RNA, 21 nt, Artificial Sequence
  Ebola virus siRNA sense strand
agaauauugcaaccguugcua

SEQ ID NO: 14610 - RNA, 21 nt, Artificial Sequence
  Ebola virus siRNA sense strand
gaauauugcaaccguugcuau

SEQ ID NO: 14611 - RNA, 21 nt, Artificial Sequence
  Ebola virus siRNA sense strand
aauauugcaaccguugcuaug

SEQ ID NO: 14612 - RNA, 21 nt, Artificial Sequence
  Ebola virus siRNA sense strand
auauugcaaccguugcuaugg

SEQ ID NO: 14613 - RNA, 21 nt, Artificial Sequence
  Ebola virus siRNA sense strand
uauugcaaccguugcuauggu

SEQ ID NO: 14614 - RNA, 21 nt, Artificial Sequence
  Ebola virus siRNA sense strand
auugcaaccguugcuauggug

SEQ ID NO: 14615 - RNA, 21 nt, Artificial Sequence
  Ebola virus siRNA sense strand
uugcaaccguugcuauggugu

SEQ ID NO: 14616 - RNA, 21 nt, Artificial Sequence
  Ebola virus siRNA sense strand
ugcaaccguugcuaugguguu

SEQ ID NO: 14617 - RNA, 21 nt, Artificial Sequence
  Ebola virus siRNA sense strand
gcaaccguugcuaugguguua

SEQ ID NO: 14618 - RNA, 21 nt, Artificial Sequence
  Ebola virus siRNA sense strand
caaccguugcuaugguguuaa

SEQ ID NO: 14619 - RNA, 21 nt, Artificial Sequence
  Ebola virus siRNA sense strand
aaccguugcuaugguguuaag

SEQ ID NO: 14620 - RNA, 21 nt, Artificial Sequence
  Ebola virus siRNA sense strand
accguugcuaugguguuaaga

SEQ ID NO: 14621 - RNA, 21 nt, Artificial Sequence
  Ebola virus siRNA sense strand
ccguugcuaugguguuaagaa

SEQ ID NO: 14622 - RNA, 21 nt, Artificial Sequence
  Ebola virus siRNA sense strand
cguugcuaugguguuaagaau

SEQ ID NO: 14623 - RNA, 21 nt, Artificial Sequence
  Ebola virus siRNA sense strand
guugcuaugguguuaagaaug

SEQ ID NO: 14624 - RNA, 21 nt, Artificial Sequence
  Ebola virus siRNA sense strand
uugcuaugguguuaagaaugu

SEQ ID NO: 14625 - RNA, 21 nt, Artificial Sequence
  Ebola virus siRNA sense strand
ugcuaugguguuaagaauguu

SEQ ID NO: 14626 - RNA, 21 nt, Artificial Sequence
  Ebola virus siRNA sense strand
gcuaugguguuaagaauguuu

SEQ ID NO: 14627 - RNA, 21 nt, Artificial Sequence
  Ebola virus siRNA sense strand
cuaugguguuaagaauguuuu

SEQ ID NO: 14628 - RNA, 21 nt, Artificial Sequence
  Ebola virus siRNA sense strand
uaugguguuaagaauguuuuu

SEQ ID NO: 14629 - RNA, 21 nt, Artificial Sequence
  Ebola virus siRNA sense strand
augguguuaagaauguuuuua

SEQ ID NO: 14630 - RNA, 21 nt, Artificial Sequence
  Ebola virus siRNA sense strand
ugguguuaagaauguuuuuaa

SEQ ID NO: 14631 - RNA, 21 nt, Artificial Sequence
  Ebola virus siRNA sense strand
gguguuaagaauguuuuuaau

SEQ ID NO: 14632 - RNA, 21 nt, Artificial Sequence
  Ebola virus siRNA sense strand
guguuaagaauguuuuuaauu

SEQ ID NO: 14633 - RNA, 21 nt, Artificial Sequence
  Ebola virus siRNA sense strand
uguuaagaauguuuuuaauug

SEQ ID NO: 14634 - RNA, 21 nt, Artificial Sequence
  Ebola virus siRNA sense strand
guuaagaauguuuuuaauugg

SEQ ID NO: 14635 - RNA, 21 nt, Artificial Sequence
  Ebola virus siRNA sense strand
uuaagaauguuuuuaauugga

SEQ ID NO: 14636 - RNA, 21 nt, Artificial Sequence
  Ebola virus siRNA sense strand
uaagaauguuuuuaauuggau

SEQ ID NO: 14637 - RNA, 21 nt, Artificial Sequence
  Ebola virus siRNA sense strand
aagaauguuuuuaauuggaug

SEQ ID NO: 14638 - RNA, 21 nt, Artificial Sequence
  Ebola virus siRNA sense strand
agaauguuuuuaauuggaugc

SEQ ID NO: 14639 - RNA, 21 nt, Artificial Sequence
  Ebola virus siRNA sense strand
gaauguuuuuaauuggaugca

SEQ ID NO: 14640 - RNA, 21 nt, Artificial Sequence
  Ebola virus siRNA sense strand
aauguuuuuaauuggaugcau

SEQ ID NO: 14641 - RNA, 21 nt, Artificial Sequence
  Ebola virus siRNA sense strand
auguuuuuaauuggaugcauu

SEQ ID NO: 14642 - RNA, 21 nt, Artificial Sequence
  Ebola virus siRNA sense strand
uguuuuuaauuggaugcauua

SEQ ID NO: 14643 - RNA, 21 nt, Artificial Sequence
  Ebola virus siRNA sense strand
guuuuuaauuggaugcauuau

SEQ ID NO: 14644 - RNA, 21 nt, Artificial Sequence
  Ebola virus siRNA sense strand
uuuuuaauuggaugcauuaua

SEQ ID NO: 14645 - RNA, 21 nt, Artificial Sequence
  Ebola virus siRNA sense strand
uuuuaauuggaugcauuauac

SEQ ID NO: 14646 - RNA, 21 nt, Artificial Sequence
  Ebola virus siRNA sense strand
uuuaauuggaugcauuauaca

SEQ ID NO: 14647 - RNA, 21 nt, Artificial Sequence
  Ebola virus siRNA sense strand
uuaauuggaugcauuauacaa

SEQ ID NO: 14648 - RNA, 21 nt, Artificial Sequence
  Ebola virus siRNA sense strand
uaauuggaugcauuauacaau

SEQ ID NO: 14649 - RNA, 21 nt, Artificial Sequence
  Ebola virus siRNA sense strand
aauuggaugcauuauacaauc

SEQ ID NO: 14650 - RNA, 21 nt, Artificial Sequence
  Ebola virus siRNA sense strand
auuggaugcauuauacaaucc

SEQ ID NO: 14651 - RNA, 21 nt, Artificial Sequence
  Ebola virus siRNA sense strand
uuggaugcauuauacaauccc

SEQ ID NO: 14652 - RNA, 21 nt, Artificial Sequence
  Ebola virus siRNA sense strand
uggaugcauuauacaauccca

SEQ ID NO: 14653 - RNA, 21 nt, Artificial Sequence
  Ebola virus siRNA sense strand
ggaugcauuauacaaucccac

SEQ ID NO: 14654 - RNA, 21 nt, Artificial Sequence
  Ebola virus siRNA sense strand
gaugcauuauacaaucccaca

SEQ ID NO: 14655 - RNA, 21 nt, Artificial Sequence
  Ebola virus siRNA sense strand
augcauuauacaaucccacag

SEQ ID NO: 14656 - RNA, 21 nt, Artificial Sequence
  Ebola virus siRNA sense strand
ugcauuauacaaucccacagu

SEQ ID NO: 14657 - RNA, 21 nt, Artificial Sequence
  Ebola virus siRNA sense strand
gcauuauacaaucccacagug

SEQ ID NO: 14658 - RNA, 21 nt, Artificial Sequence
  Ebola virus siRNA sense strand
cauuauacaaucccacagugu

SEQ ID NO: 14659 - RNA, 21 nt, Artificial Sequence
  Ebola virus siRNA sense strand
auuauacaaucccacaguguu

SEQ ID NO: 14660 - RNA, 21 nt, Artificial Sequence
  Ebola virus siRNA sense strand
uuauacaaucccacaguguua

SEQ ID NO: 14661 - RNA, 21 nt, Artificial Sequence
  Ebola virus siRNA sense strand
uauacaaucccacaguguuau

SEQ ID NO: 14662 - RNA, 21 nt, Artificial Sequence
  Ebola virus siRNA sense strand
auacaaucccacaguguuaua

SEQ ID NO: 14663 - RNA, 21 nt, Artificial Sequence
  Ebola virus siRNA sense strand
uacaaucccacaguguuauau

SEQ ID NO: 14664 - RNA, 21 nt, Artificial Sequence
  Ebola virus siRNA sense strand
acaaucccacaguguuauaug

SEQ ID NO: 14665 - RNA, 21 nt, Artificial Sequence
  Ebola virus siRNA sense strand
caaucccacaguguuauaugc

SEQ ID NO: 14666 - RNA, 21 nt, Artificial Sequence
  Ebola virus siRNA sense strand
aaucccacaguguuauaugca

SEQ ID NO: 14667 - RNA, 21 nt, Artificial Sequence
  Ebola virus siRNA sense strand
aucccacaguguuauaugcau

SEQ ID NO: 14668 - RNA, 21 nt, Artificial Sequence
  Ebola virus siRNA sense strand
ucccacaguguuauaugcaug

SEQ ID NO: 14669 - RNA, 21 nt, Artificial Sequence
  Ebola virus siRNA sense strand
cccacaguguuauaugcaugu

SEQ ID NO: 14670 - RNA, 21 nt, Artificial Sequence
  Ebola virus siRNA sense strand
ccacaguguuauaugcauguc

SEQ ID NO: 14671 - RNA, 21 nt, Artificial Sequence
  Ebola virus siRNA sense strand
cacaguguuauaugcauguca

SEQ ID NO: 14672 - RNA, 21 nt, Artificial Sequence
  Ebola virus siRNA sense strand
acaguguuauaugcaugucag

SEQ ID NO: 14673 - RNA, 21 nt, Artificial Sequence
  Ebola virus siRNA sense strand
caguguuauaugcaugucagu

SEQ ID NO: 14674 - RNA, 21 nt, Artificial Sequence
  Ebola virus siRNA sense strand
aguguuauaugcaugucagug

SEQ ID NO: 14675 - RNA, 21 nt, Artificial Sequence
  Ebola virus siRNA sense strand
guguuauaugcaugucaguga

SEQ ID NO: 14676 - RNA, 21 nt, Artificial Sequence
  Ebola virus siRNA sense strand
uguuauaugcaugucagugau

SEQ ID NO: 14677 - RNA, 21 nt, Artificial Sequence
  Ebola virus siRNA sense strand
guuauaugcaugucagugauu

SEQ ID NO: 14678 - RNA, 21 nt, Artificial Sequence
  Ebola virus siRNA sense strand
uuauaugcaugucagugauua

SEQ ID NO: 14679 - RNA, 21 nt, Artificial Sequence
  Ebola virus siRNA sense strand
uauaugcaugucagugauuau

SEQ ID NO: 14680 - RNA, 21 nt, Artificial Sequence
  Ebola virus siRNA sense strand
auaugcaugucagugauuauu

SEQ ID NO: 14681 - RNA, 21 nt, Artificial Sequence
  Ebola virus siRNA sense strand
uaugcaugucagugauuauua

SEQ ID NO: 14682 - RNA, 21 nt, Artificial Sequence
  Ebola virus siRNA sense strand
augcaugucagugauuauuau

SEQ ID NO: 14683 - RNA, 21 nt, Artificial Sequence
  Ebola virus siRNA sense strand
ugcaugucagugauuauuaua

SEQ ID NO: 14684 - RNA, 21 nt, Artificial Sequence
  Ebola virus siRNA sense strand
gcaugucagugauuauuauaa

SEQ ID NO: 14685 - RNA, 21 nt, Artificial Sequence
  Ebola virus siRNA sense strand
caugucagugauuauuauaau

SEQ ID NO: 14686 - RNA, 21 nt, Artificial Sequence
  Ebola virus siRNA sense strand
augucagugauuauuauaauc

SEQ ID NO: 14687 - RNA, 21 nt, Artificial Sequence
  Ebola virus siRNA sense strand
ugucagugauuauuauaaucc

SEQ ID NO: 14688 - RNA, 21 nt, Artificial Sequence
  Ebola virus siRNA sense strand
gucagugauuauuauaaucca

SEQ ID NO: 14689 - RNA, 21 nt, Artificial Sequence
  Ebola virus siRNA sense strand
ucagugauuauuauaauccac

SEQ ID NO: 14690 - RNA, 21 nt, Artificial Sequence
  Ebola virus siRNA sense strand
cagugauuauuauaauccacc

SEQ ID NO: 14691 - RNA, 21 nt, Artificial Sequence
  Ebola virus siRNA sense strand
agugauuauuauaauccacca

SEQ ID NO: 14692 - RNA, 21 nt, Artificial Sequence
  Ebola virus siRNA sense strand
gugauuauuauaauccaccac

SEQ ID NO: 14693 - RNA, 21 nt, Artificial Sequence
  Ebola virus siRNA sense strand
ugauuauuauaauccaccaca

SEQ ID NO: 14694 - RNA, 21 nt, Artificial Sequence
  Ebola virus siRNA sense strand
gauuauuauaauccaccacau

SEQ ID NO: 14695 - RNA, 21 nt, Artificial Sequence
  Ebola virus siRNA sense strand
auuauuauaauccaccacaua

SEQ ID NO: 14696 - RNA, 21 nt, Artificial Sequence
  Ebola virus siRNA sense strand
uuauuauaauccaccacauaa

SEQ ID NO: 14697 - RNA, 21 nt, Artificial Sequence
  Ebola virus siRNA sense strand
uauuauaauccaccacauaac

SEQ ID NO: 14698 - RNA, 21 nt, Artificial Sequence
  Ebola virus siRNA sense strand
auuauaauccaccacauaacc

SEQ ID NO: 14699 - RNA, 21 nt, Artificial Sequence
  Ebola virus siRNA sense strand
uuauaauccaccacauaaccu

SEQ ID NO: 14700 - RNA, 21 nt, Artificial Sequence
  Ebola virus siRNA sense strand
uauaauccaccacauaaccuc

SEQ ID NO: 14701 - RNA, 21 nt, Artificial Sequence
  Ebola virus siRNA sense strand
auaauccaccacauaaccuca

SEQ ID NO: 14702 - RNA, 21 nt, Artificial Sequence
  Ebola virus siRNA sense strand
uaauccaccacauaaccucac

SEQ ID NO: 14703 - RNA, 21 nt, Artificial Sequence
  Ebola virus siRNA sense strand
aauccaccacauaaccucaca

SEQ ID NO: 14704 - RNA, 21 nt, Artificial Sequence
  Ebola virus siRNA sense strand
auccaccacauaaccucacac

SEQ ID NO: 14705 - RNA, 21 nt, Artificial Sequence
  Ebola virus siRNA sense strand
uccaccacauaaccucacacu

SEQ ID NO: 14706 - RNA, 21 nt, Artificial Sequence
  Ebola virus siRNA sense strand
ccaccacauaaccucacacug

SEQ ID NO: 14707 - RNA, 21 nt, Artificial Sequence
  Ebola virus siRNA sense strand
caccacauaaccucacacugg

SEQ ID NO: 14708 - RNA, 21 nt, Artificial Sequence
  Ebola virus siRNA sense strand
accacauaaccucacacugga

SEQ ID NO: 14709 - RNA, 21 nt, Artificial Sequence
  Ebola virus siRNA sense strand
ccacauaaccucacacuggag

SEQ ID NO: 14710 - RNA, 21 nt, Artificial Sequence
  Ebola virus siRNA sense strand
cacauaaccucacacuggaga

SEQ ID NO: 14711 - RNA, 21 nt, Artificial Sequence
  Ebola virus siRNA sense strand
acauaaccucacacuggagaa

SEQ ID NO: 14712 - RNA, 21 nt, Artificial Sequence
  Ebola virus siRNA sense strand
cauaaccucacacuggagaau

SEQ ID NO: 14713 - RNA, 21 nt, Artificial Sequence
  Ebola virus siRNA sense strand
auaaccucacacuggagaauc

SEQ ID NO: 14714 - RNA, 21 nt, Artificial Sequence
  Ebola virus siRNA sense strand
uaaccucacacuggagaaucg

SEQ ID NO: 14715 - RNA, 21 nt, Artificial Sequence
  Ebola virus siRNA sense strand
aaccucacacuggagaaucga

SEQ ID NO: 14716 - RNA, 21 nt, Artificial Sequence
  Ebola virus siRNA sense strand
accucacacuggagaaucgag

SEQ ID NO: 14717 - RNA, 21 nt, Artificial Sequence
  Ebola virus siRNA sense strand
ccucacacuggagaaucgaga

SEQ ID NO: 14718 - RNA, 21 nt, Artificial Sequence
  Ebola virus siRNA sense strand
cucacacuggagaaucgagac

SEQ ID NO: 14719 - RNA, 21 nt, Artificial Sequence
  Ebola virus siRNA sense strand
ucacacuggagaaucgagaca

SEQ ID NO: 14720 - RNA, 21 nt, Artificial Sequence
  Ebola virus siRNA sense strand
cacacuggagaaucgagacaa

SEQ ID NO: 14721 - RNA, 21 nt, Artificial Sequence
  Ebola virus siRNA sense strand
acacuggagaaucgagacaac

SEQ ID NO: 14722 - RNA, 21 nt, Artificial Sequence
  Ebola virus siRNA sense strand
cacuggagaaucgagacaacc

SEQ ID NO: 14723 - RNA, 21 nt, Artificial Sequence
  Ebola virus siRNA sense strand
acuggagaaucgagacaaccc

SEQ ID NO: 14724 - RNA, 21 nt, Artificial Sequence
  Ebola virus siRNA sense strand
cuggagaaucgagacaacccc

SEQ ID NO: 14725 - RNA, 21 nt, Artificial Sequence
  Ebola virus siRNA sense strand
uggagaaucgagacaaccccc

SEQ ID NO: 14726 - RNA, 21 nt, Artificial Sequence
  Ebola virus siRNA sense strand
ggagaaucgagacaacccccc

SEQ ID NO: 14727 - RNA, 21 nt, Artificial Sequence
  Ebola virus siRNA sense strand
gagaaucgagacaaccccccc

SEQ ID NO: 14728 - RNA, 21 nt, Artificial Sequence
  Ebola virus siRNA sense strand
agaaucgagacaacccccccg

SEQ ID NO: 14729 - RNA, 21 nt, Artificial Sequence
  Ebola virus siRNA sense strand
gaaucgagacaacccccccga

SEQ ID NO: 14730 - RNA, 21 nt, Artificial Sequence
  Ebola virus siRNA sense strand
aaucgagacaacccccccgaa

SEQ ID NO: 14731 - RNA, 21 nt, Artificial Sequence
  Ebola virus siRNA sense strand
aucgagacaacccccccgaag

SEQ ID NO: 14732 - RNA, 21 nt, Artificial Sequence
  Ebola virus siRNA sense strand
ucgagacaacccccccgaagg

SEQ ID NO: 14733 - RNA, 21 nt, Artificial Sequence
  Ebola virus siRNA sense strand
cgagacaacccccccgaaggg

SEQ ID NO: 14734 - RNA, 21 nt, Artificial Sequence
  Ebola virus siRNA sense strand
gagacaacccccccgaagggc

SEQ ID NO: 14735 - RNA, 21 nt, Artificial Sequence
  Ebola virus siRNA sense strand
agacaacccccccgaagggcc

SEQ ID NO: 14736 - RNA, 21 nt, Artificial Sequence
  Ebola virus siRNA sense strand
gacaacccccccgaagggccu

SEQ ID NO: 14737 - RNA, 21 nt, Artificial Sequence
  Ebola virus siRNA sense strand
acaacccccccgaagggccua

SEQ ID NO: 14738 - RNA, 21 nt, Artificial Sequence
  Ebola virus siRNA sense strand
caacccccccgaagggccuag

SEQ ID NO: 14739 - RNA, 21 nt, Artificial Sequence
  Ebola virus siRNA sense strand
aacccccccgaagggccuagu

SEQ ID NO: 14740 - RNA, 21 nt, Artificial Sequence
  Ebola virus siRNA sense strand
acccccccgaagggccuaguu

SEQ ID NO: 14741 - RNA, 21 nt, Artificial Sequence
  Ebola virus siRNA sense strand
cccccccgaagggccuaguuc

SEQ ID NO: 14742 - RNA, 21 nt, Artificial Sequence
  Ebola virus siRNA sense strand
ccccccgaagggccuaguuca

SEQ ID NO: 14743 - RNA, 21 nt, Artificial Sequence
  Ebola virus siRNA sense strand
cccccgaagggccuaguucau

SEQ ID NO: 14744 - RNA, 21 nt, Artificial Sequence
  Ebola virus siRNA sense strand
ccccgaagggccuaguucaua

SEQ ID NO: 14745 - RNA, 21 nt, Artificial Sequence
  Ebola virus siRNA sense strand
cccgaagggccuaguucauac

SEQ ID NO: 14746 - RNA, 21 nt, Artificial Sequence
  Ebola virus siRNA sense strand
ccgaagggccuaguucauaca

SEQ ID NO: 14747 - RNA, 21 nt, Artificial Sequence
  Ebola virus siRNA sense strand
cgaagggccuaguucauacag

SEQ ID NO: 14748 - RNA, 21 nt, Artificial Sequence
  Ebola virus siRNA sense strand
gaagggccuaguucauacagg

SEQ ID NO: 14749 - RNA, 21 nt, Artificial Sequence
  Ebola virus siRNA sense strand
aagggccuaguucauacaggg

SEQ ID NO: 14750 - RNA, 21 nt, Artificial Sequence
  Ebola virus siRNA sense strand
agggccuaguucauacagggg

SEQ ID NO: 14751 - RNA, 21 nt, Artificial Sequence
  Ebola virus siRNA sense strand
gggccuaguucauacaggggu

SEQ ID NO: 14752 - RNA, 21 nt, Artificial Sequence
  Ebola virus siRNA sense strand
ggccuaguucauacagggguc

SEQ ID NO: 14753 - RNA, 21 nt, Artificial Sequence
  Ebola virus siRNA sense strand
gccuaguucauacagggguca

SEQ ID NO: 14754 - RNA, 21 nt, Artificial Sequence
  Ebola virus siRNA sense strand
ccuaguucauacaggggucau

SEQ ID NO: 14755 - RNA, 21 nt, Artificial Sequence
  Ebola virus siRNA sense strand
cuaguucauacaggggucaua

SEQ ID NO: 14756 - RNA, 21 nt, Artificial Sequence
  Ebola virus siRNA sense strand
uaguucauacaggggucauau

SEQ ID NO: 14757 - RNA, 21 nt, Artificial Sequence
  Ebola virus siRNA sense strand
aguucauacaggggucauaug

SEQ ID NO: 14758 - RNA, 21 nt, Artificial Sequence
  Ebola virus siRNA sense strand
guucauacaggggucauaugg

SEQ ID NO: 14759 - RNA, 21 nt, Artificial Sequence
  Ebola virus siRNA sense strand
uucauacaggggucauauggg

SEQ ID NO: 14760 - RNA, 21 nt, Artificial Sequence
  Ebola virus siRNA sense strand
ucauacaggggucauauggga

SEQ ID NO: 14761 - RNA, 21 nt, Artificial Sequence
  Ebola virus siRNA sense strand
cauacaggggucauaugggag

SEQ ID NO: 14762 - RNA, 21 nt, Artificial Sequence
  Ebola virus siRNA sense strand
auacaggggucauaugggagg

SEQ ID NO: 14763 - RNA, 21 nt, Artificial Sequence
  Ebola virus siRNA sense strand
uacaggggucauaugggaggg

SEQ ID NO: 14764 - RNA, 21 nt, Artificial Sequence
  Ebola virus siRNA sense strand
acaggggucauaugggaggga

SEQ ID NO: 14765 - RNA, 21 nt, Artificial Sequence
  Ebola virus siRNA sense strand
caggggucauaugggagggau

SEQ ID NO: 14766 - RNA, 21 nt, Artificial Sequence
  Ebola virus siRNA sense strand
aggggucauaugggagggauu

SEQ ID NO: 14767 - RNA, 21 nt, Artificial Sequence
  Ebola virus siRNA sense strand
ggggucauaugggagggauug

SEQ ID NO: 14768 - RNA, 21 nt, Artificial Sequence
  Ebola virus siRNA sense strand
gggucauaugggagggauuga

SEQ ID NO: 14769 - RNA, 21 nt, Artificial Sequence
  Ebola virus siRNA sense strand
ggucauaugggagggauugaa

SEQ ID NO: 14770 - RNA, 21 nt, Artificial Sequence
  Ebola virus siRNA sense strand
gucauaugggagggauugaag

SEQ ID NO: 14771 - RNA, 21 nt, Artificial Sequence
  Ebola virus siRNA sense strand
ucauaugggagggauugaagg

SEQ ID NO: 14772 - RNA, 21 nt, Artificial Sequence
  Ebola virus siRNA sense strand
cauaugggagggauugaagga

SEQ ID NO: 14773 - RNA, 21 nt, Artificial Sequence
  Ebola virus siRNA sense strand
auaugggagggauugaaggac

SEQ ID NO: 14774 - RNA, 21 nt, Artificial Sequence
  Ebola virus siRNA sense strand
uaugggagggauugaaggacu

SEQ ID NO: 14775 - RNA, 21 nt, Artificial Sequence
  Ebola virus siRNA sense strand
augggagggauugaaggacug

SEQ ID NO: 14776 - RNA, 21 nt, Artificial Sequence
  Ebola virus siRNA sense strand
ugggagggauugaaggacugc

SEQ ID NO: 14777 - RNA, 21 nt, Artificial Sequence
  Ebola virus siRNA sense strand
gggagggauugaaggacugca

SEQ ID NO: 14778 - RNA, 21 nt, Artificial Sequence
  Ebola virus siRNA sense strand
ggagggauugaaggacugcaa

SEQ ID NO: 14779 - RNA, 21 nt, Artificial Sequence
  Ebola virus siRNA sense strand
gagggauugaaggacugcaac

SEQ ID NO: 14780 - RNA, 21 nt, Artificial Sequence
  Ebola virus siRNA sense strand
agggauugaaggacugcaaca

SEQ ID NO: 14781 - RNA, 21 nt, Artificial Sequence
  Ebola virus siRNA sense strand
gggauugaaggacugcaacaa

SEQ ID NO: 14782 - RNA, 21 nt, Artificial Sequence
  Ebola virus siRNA sense strand
ggauugaaggacugcaacaaa

SEQ ID NO: 14783 - RNA, 21 nt, Artificial Sequence
  Ebola virus siRNA sense strand
gauugaaggacugcaacaaaa

SEQ ID NO: 14784 - RNA, 21 nt, Artificial Sequence
  Ebola virus siRNA sense strand
auugaaggacugcaacaaaaa

SEQ ID NO: 14785 - RNA, 21 nt, Artificial Sequence
  Ebola virus siRNA sense strand
uugaaggacugcaacaaaaac

SEQ ID NO: 14786 - RNA, 21 nt, Artificial Sequence
  Ebola virus siRNA sense strand
ugaaggacugcaacaaaaacu

SEQ ID NO: 14787 - RNA, 21 nt, Artificial Sequence
  Ebola virus siRNA sense strand
gaaggacugcaacaaaaacuc

SEQ ID NO: 14788 - RNA, 21 nt, Artificial Sequence
  Ebola virus siRNA sense strand
aaggacugcaacaaaaacucu

SEQ ID NO: 14789 - RNA, 21 nt, Artificial Sequence
  Ebola virus siRNA sense strand
aggacugcaacaaaaacucug

SEQ ID NO: 14790 - RNA, 21 nt, Artificial Sequence
  Ebola virus siRNA sense strand
ggacugcaacaaaaacucugg

SEQ ID NO: 14791 - RNA, 21 nt, Artificial Sequence
  Ebola virus siRNA sense strand
gacugcaacaaaaacucugga

SEQ ID NO: 14792 - RNA, 21 nt, Artificial Sequence
  Ebola virus siRNA sense strand
acugcaacaaaaacucuggac

SEQ ID NO: 14793 - RNA, 21 nt, Artificial Sequence
  Ebola virus siRNA sense strand
cugcaacaaaaacucuggaca

SEQ ID NO: 14794 - RNA, 21 nt, Artificial Sequence
  Ebola virus siRNA sense strand
ugcaacaaaaacucuggacaa

SEQ ID NO: 14795 - RNA, 21 nt, Artificial Sequence
  Ebola virus siRNA sense strand
gcaacaaaaacucuggacaag

SEQ ID NO: 14796 - RNA, 21 nt, Artificial Sequence
  Ebola virus siRNA sense strand
caacaaaaacucuggacaagu

SEQ ID NO: 14797 - RNA, 21 nt, Artificial Sequence
  Ebola virus siRNA sense strand
aacaaaaacucuggacaagua

SEQ ID NO: 14798 - RNA, 21 nt, Artificial Sequence
  Ebola virus siRNA sense strand
acaaaaacucuggacaaguau

SEQ ID NO: 14799 - RNA, 21 nt, Artificial Sequence
  Ebola virus siRNA sense strand
caaaaacucuggacaaguauu

SEQ ID NO: 14800 - RNA, 21 nt, Artificial Sequence
  Ebola virus siRNA sense strand
aaaaacucuggacaaguauuu

SEQ ID NO: 14801 - RNA, 21 nt, Artificial Sequence
  Ebola virus siRNA sense strand
aaaacucuggacaaguauuuc

SEQ ID NO: 14802 - RNA, 21 nt, Artificial Sequence
  Ebola virus siRNA sense strand
aaacucuggacaaguauuuca

SEQ ID NO: 14803 - RNA, 21 nt, Artificial Sequence
  Ebola virus siRNA sense strand
aacucuggacaaguauuucau

SEQ ID NO: 14804 - RNA, 21 nt, Artificial Sequence
  Ebola virus siRNA sense strand
acucuggacaaguauuucaug

SEQ ID NO: 14805 - RNA, 21 nt, Artificial Sequence
  Ebola virus siRNA sense strand
cucuggacaaguauuucaugu

SEQ ID NO: 14806 - RNA, 21 nt, Artificial Sequence
  Ebola virus siRNA sense strand
ucuggacaaguauuucaugug

SEQ ID NO: 14807 - RNA, 21 nt, Artificial Sequence
  Ebola virus siRNA sense strand
cuggacaaguauuucaugugc

SEQ ID NO: 14808 - RNA, 21 nt, Artificial Sequence
  Ebola virus siRNA sense strand
uggacaaguauuucaugugcu

SEQ ID NO: 14809 - RNA, 21 nt, Artificial Sequence
  Ebola virus siRNA sense strand
ggacaaguauuucaugugcuc

SEQ ID NO: 14810 - RNA, 21 nt, Artificial Sequence
  Ebola virus siRNA sense strand
gacaaguauuucaugugcuca

SEQ ID NO: 14811 - RNA, 21 nt, Artificial Sequence
  Ebola virus siRNA sense strand
acaaguauuucaugugcucaa

SEQ ID NO: 14812 - RNA, 21 nt, Artificial Sequence
  Ebola virus siRNA sense strand
caaguauuucaugugcucaaa

SEQ ID NO: 14813 - RNA, 21 nt, Artificial Sequence
  Ebola virus siRNA sense strand
aaguauuucaugugcucaaau

SEQ ID NO: 14814 - RNA, 21 nt, Artificial Sequence
  Ebola virus siRNA sense strand
aguauuucaugugcucaaauu

SEQ ID NO: 14815 - RNA, 21 nt, Artificial Sequence
  Ebola virus siRNA sense strand
guauuucaugugcucaaauuu

SEQ ID NO: 14816 - RNA, 21 nt, Artificial Sequence
  Ebola virus siRNA sense strand
uauuucaugugcucaaauuuc

SEQ ID NO: 14817 - RNA, 21 nt, Artificial Sequence
  Ebola virus siRNA sense strand
auuucaugugcucaaauuucu

SEQ ID NO: 14818 - RNA, 21 nt, Artificial Sequence
  Ebola virus siRNA sense strand
uuucaugugcucaaauuucuu

SEQ ID NO: 14819 - RNA, 21 nt, Artificial Sequence
  Ebola virus siRNA sense strand
uucaugugcucaaauuucuuu

SEQ ID NO: 14820 - RNA, 21 nt, Artificial Sequence
  Ebola virus siRNA sense strand
ucaugugcucaaauuucuuua

SEQ ID NO: 14821 - RNA, 21 nt, Artificial Sequence
  Ebola virus siRNA sense strand
caugugcucaaauuucuuuag

SEQ ID NO: 14822 - RNA, 21 nt, Artificial Sequence
  Ebola virus siRNA sense strand
augugcucaaauuucuuuagu

SEQ ID NO: 14823 - RNA, 21 nt, Artificial Sequence
  Ebola virus siRNA sense strand
ugugcucaaauuucuuuaguu

SEQ ID NO: 14824 - RNA, 21 nt, Artificial Sequence
  Ebola virus siRNA sense strand
gugcucaaauuucuuuaguug

SEQ ID NO: 14825 - RNA, 21 nt, Artificial Sequence
  Ebola virus siRNA sense strand
ugcucaaauuucuuuaguuga

SEQ ID NO: 14826 - RNA, 21 nt, Artificial Sequence
  Ebola virus siRNA sense strand
gcucaaauuucuuuaguugaa

SEQ ID NO: 14827 - RNA, 21 nt, Artificial Sequence
  Ebola virus siRNA sense strand
cucaaauuucuuuaguugaaa

SEQ ID NO: 14828 - RNA, 21 nt, Artificial Sequence
  Ebola virus siRNA sense strand
ucaaauuucuuuaguugaaau

SEQ ID NO: 14829 - RNA, 21 nt, Artificial Sequence
  Ebola virus siRNA sense strand
caaauuucuuuaguugaaauu

SEQ ID NO: 14830 - RNA, 21 nt, Artificial Sequence
  Ebola virus siRNA sense strand
aaauuucuuuaguugaaauua

SEQ ID NO: 14831 - RNA, 21 nt, Artificial Sequence
  Ebola virus siRNA sense strand
aauuucuuuaguugaaauuaa

SEQ ID NO: 14832 - RNA, 21 nt, Artificial Sequence
  Ebola virus siRNA sense strand
auuucuuuaguugaaauuaag

SEQ ID NO: 14833 - RNA, 21 nt, Artificial Sequence
  Ebola virus siRNA sense strand
uuucuuuaguugaaauuaaga

SEQ ID NO: 14834 - RNA, 21 nt, Artificial Sequence
  Ebola virus siRNA sense strand
uucuuuaguugaaauuaagac

SEQ ID NO: 14835 - RNA, 21 nt, Artificial Sequence
  Ebola virus siRNA sense strand
ucuuuaguugaaauuaagacu

SEQ ID NO: 14836 - RNA, 21 nt, Artificial Sequence
  Ebola virus siRNA sense strand
cuuuaguugaaauuaagacug

SEQ ID NO: 14837 - RNA, 21 nt, Artificial Sequence
  Ebola virus siRNA sense strand
uuuaguugaaauuaagacugg

SEQ ID NO: 14838 - RNA, 21 nt, Artificial Sequence
  Ebola virus siRNA sense strand
uuaguugaaauuaagacuggu

SEQ ID NO: 14839 - RNA, 21 nt, Artificial Sequence
  Ebola virus siRNA sense strand
uaguugaaauuaagacugguu

SEQ ID NO: 14840 - RNA, 21 nt, Artificial Sequence
  Ebola virus siRNA sense strand
aguugaaauuaagacugguuu

SEQ ID NO: 14841 - RNA, 21 nt, Artificial Sequence
  Ebola virus siRNA sense strand
guugaaauuaagacugguuuu

SEQ ID NO: 14842 - RNA, 21 nt, Artificial Sequence
  Ebola virus siRNA sense strand
uugaaauuaagacugguuuua

SEQ ID NO: 14843 - RNA, 21 nt, Artificial Sequence
  Ebola virus siRNA sense strand
ugaaauuaagacugguuuuaa

SEQ ID NO: 14844 - RNA, 21 nt, Artificial Sequence
  Ebola virus siRNA sense strand
gaaauuaagacugguuuuaag

SEQ ID NO: 14845 - RNA, 21 nt, Artificial Sequence
  Ebola virus siRNA sense strand
aaauuaagacugguuuuaagu

SEQ ID NO: 14846 - RNA, 21 nt, Artificial Sequence
  Ebola virus siRNA sense strand
aauuaagacugguuuuaaguu

SEQ ID NO: 14847 - RNA, 21 nt, Artificial Sequence
  Ebola virus siRNA sense strand
auuaagacugguuuuaaguua

SEQ ID NO: 14848 - RNA, 21 nt, Artificial Sequence
  Ebola virus siRNA sense strand
uuaagacugguuuuaaguuac

SEQ ID NO: 14849 - RNA, 21 nt, Artificial Sequence
  Ebola virus siRNA sense strand
uaagacugguuuuaaguuacg

SEQ ID NO: 14850 - RNA, 21 nt, Artificial Sequence
  Ebola virus siRNA sense strand
aagacugguuuuaaguuacgc

SEQ ID NO: 14851 - RNA, 21 nt, Artificial Sequence
  Ebola virus siRNA sense strand
agacugguuuuaaguuacgcu

SEQ ID NO: 14852 - RNA, 21 nt, Artificial Sequence
  Ebola virus siRNA sense strand
gacugguuuuaaguuacgcuc

SEQ ID NO: 14853 - RNA, 21 nt, Artificial Sequence
  Ebola virus siRNA sense strand
acugguuuuaaguuacgcuca

SEQ ID NO: 14854 - RNA, 21 nt, Artificial Sequence
  Ebola virus siRNA sense strand
cugguuuuaaguuacgcucag

SEQ ID NO: 14855 - RNA, 21 nt, Artificial Sequence
  Ebola virus siRNA sense strand
ugguuuuaaguuacgcucagc

SEQ ID NO: 14856 - RNA, 21 nt, Artificial Sequence
  Ebola virus siRNA sense strand
gguuuuaaguuacgcucagcu

SEQ ID NO: 14857 - RNA, 21 nt, Artificial Sequence
  Ebola virus siRNA sense strand
guuuuaaguuacgcucagcug

SEQ ID NO: 14858 - RNA, 21 nt, Artificial Sequence
  Ebola virus siRNA sense strand
uuuuaaguuacgcucagcugu

SEQ ID NO: 14859 - RNA, 21 nt, Artificial Sequence
  Ebola virus siRNA sense strand
uuuaaguuacgcucagcugug

SEQ ID NO: 14860 - RNA, 21 nt, Artificial Sequence
  Ebola virus siRNA sense strand
uuaaguuacgcucagcuguga

SEQ ID NO: 14861 - RNA, 21 nt, Artificial Sequence
  Ebola virus siRNA sense strand
uaaguuacgcucagcugugau

SEQ ID NO: 14862 - RNA, 21 nt, Artificial Sequence
  Ebola virus siRNA sense strand
aaguuacgcucagcugugaug

SEQ ID NO: 14863 - RNA, 21 nt, Artificial Sequence
  Ebola virus siRNA sense strand
aguuacgcucagcugugaugg

SEQ ID NO: 14864 - RNA, 21 nt, Artificial Sequence
  Ebola virus siRNA sense strand
guuacgcucagcugugauggg

SEQ ID NO: 14865 - RNA, 21 nt, Artificial Sequence
  Ebola virus siRNA sense strand
uuacgcucagcugugaugggu

SEQ ID NO: 14866 - RNA, 21 nt, Artificial Sequence
  Ebola virus siRNA sense strand
uacgcucagcugugaugggug

SEQ ID NO: 14867 - RNA, 21 nt, Artificial Sequence
  Ebola virus siRNA sense strand
acgcucagcugugauggguga

SEQ ID NO: 14868 - RNA, 21 nt, Artificial Sequence
  Ebola virus siRNA sense strand
cgcucagcugugaugggugac

SEQ ID NO: 14869 - RNA, 21 nt, Artificial Sequence
  Ebola virus siRNA sense strand
gcucagcugugaugggugaca

SEQ ID NO: 14870 - RNA, 21 nt, Artificial Sequence
  Ebola virus siRNA sense strand
cucagcugugaugggugacaa

SEQ ID NO: 14871 - RNA, 21 nt, Artificial Sequence
  Ebola virus siRNA sense strand
ucagcugugaugggugacaau

SEQ ID NO: 14872 - RNA, 21 nt, Artificial Sequence
  Ebola virus siRNA sense strand
cagcugugaugggugacaauc

SEQ ID NO: 14873 - RNA, 21 nt, Artificial Sequence
  Ebola virus siRNA sense strand
agcugugaugggugacaauca

SEQ ID NO: 14874 - RNA, 21 nt, Artificial Sequence
  Ebola virus siRNA sense strand
gcugugaugggugacaaucag

SEQ ID NO: 14875 - RNA, 21 nt, Artificial Sequence
  Ebola virus siRNA sense strand
cugugaugggugacaaucagu

SEQ ID NO: 14876 - RNA, 21 nt, Artificial Sequence
  Ebola virus siRNA sense strand
ugugaugggugacaaucagug

SEQ ID NO: 14877 - RNA, 21 nt, Artificial Sequence
  Ebola virus siRNA sense strand
gugaugggugacaaucagugc

SEQ ID NO: 14878 - RNA, 21 nt, Artificial Sequence
  Ebola virus siRNA sense strand
ugaugggugacaaucagugca

SEQ ID NO: 14879 - RNA, 21 nt, Artificial Sequence
  Ebola virus siRNA sense strand
gaugggugacaaucagugcau

SEQ ID NO: 14880 - RNA, 21 nt, Artificial Sequence
  Ebola virus siRNA sense strand
augggugacaaucagugcauu

SEQ ID NO: 14881 - RNA, 21 nt, Artificial Sequence
  Ebola virus siRNA sense strand
ugggugacaaucagugcauua

SEQ ID NO: 14882 - RNA, 21 nt, Artificial Sequence
  Ebola virus siRNA sense strand
gggugacaaucagugcauuac

SEQ ID NO: 14883 - RNA, 21 nt, Artificial Sequence
  Ebola virus siRNA sense strand
ggugacaaucagugcauuacu

SEQ ID NO: 14884 - RNA, 21 nt, Artificial Sequence
  Ebola virus siRNA sense strand
gugacaaucagugcauuacug

SEQ ID NO: 14885 - RNA, 21 nt, Artificial Sequence
  Ebola virus siRNA sense strand
ugacaaucagugcauuacugu

SEQ ID NO: 14886 - RNA, 21 nt, Artificial Sequence
  Ebola virus siRNA sense strand
gacaaucagugcauuacuguu

SEQ ID NO: 14887 - RNA, 21 nt, Artificial Sequence
  Ebola virus siRNA sense strand
acaaucagugcauuacuguuu

SEQ ID NO: 14888 - RNA, 21 nt, Artificial Sequence
  Ebola virus siRNA sense strand
caaucagugcauuacuguuuu

SEQ ID NO: 14889 - RNA, 21 nt, Artificial Sequence
  Ebola virus siRNA sense strand
aaucagugcauuacuguuuua

SEQ ID NO: 14890 - RNA, 21 nt, Artificial Sequence
  Ebola virus siRNA sense strand
aucagugcauuacuguuuuau

SEQ ID NO: 14891 - RNA, 21 nt, Artificial Sequence
  Ebola virus siRNA sense strand
ucagugcauuacuguuuuauc

SEQ ID NO: 14892 - RNA, 21 nt, Artificial Sequence
  Ebola virus siRNA sense strand
cagugcauuacuguuuuauca

SEQ ID NO: 14893 - RNA, 21 nt, Artificial Sequence
  Ebola virus siRNA sense strand
agugcauuacuguuuuaucag

SEQ ID NO: 14894 - RNA, 21 nt, Artificial Sequence
  Ebola virus siRNA sense strand
gugcauuacuguuuuaucagu

SEQ ID NO: 14895 - RNA, 21 nt, Artificial Sequence
  Ebola virus siRNA sense strand
ugcauuacuguuuuaucaguc

SEQ ID NO: 14896 - RNA, 21 nt, Artificial Sequence
  Ebola virus siRNA sense strand
gcauuacuguuuuaucagucu

SEQ ID NO: 14897 - RNA, 21 nt, Artificial Sequence
  Ebola virus siRNA sense strand
cauuacuguuuuaucagucuu

SEQ ID NO: 14898 - RNA, 21 nt, Artificial Sequence
  Ebola virus siRNA sense strand
auuacuguuuuaucagucuuc

SEQ ID NO: 14899 - RNA, 21 nt, Artificial Sequence
  Ebola virus siRNA sense strand
uuacuguuuuaucagucuucc

SEQ ID NO: 14900 - RNA, 21 nt, Artificial Sequence
  Ebola virus siRNA sense strand
uacuguuuuaucagucuuccc

SEQ ID NO: 14901 - RNA, 21 nt, Artificial Sequence
  Ebola virus siRNA sense strand
acuguuuuaucagucuucccc

SEQ ID NO: 14902 - RNA, 21 nt, Artificial Sequence
  Ebola virus siRNA sense strand
cuguuuuaucagucuuccccu

SEQ ID NO: 14903 - RNA, 21 nt, Artificial Sequence
  Ebola virus siRNA sense strand
uguuuuaucagucuuccccuu

SEQ ID NO: 14904 - RNA, 21 nt, Artificial Sequence
  Ebola virus siRNA sense strand
guuuuaucagucuuccccuua

SEQ ID NO: 14905 - RNA, 21 nt, Artificial Sequence
  Ebola virus siRNA sense strand
uuuuaucagucuuccccuuag

SEQ ID NO: 14906 - RNA, 21 nt, Artificial Sequence
  Ebola virus siRNA sense strand
uuuaucagucuuccccuuaga

SEQ ID NO: 14907 - RNA, 21 nt, Artificial Sequence
  Ebola virus siRNA sense strand
uuaucagucuuccccuuagag

SEQ ID NO: 14908 - RNA, 21 nt, Artificial Sequence
  Ebola virus siRNA sense strand
uaucagucuuccccuuagaga

SEQ ID NO: 14909 - RNA, 21 nt, Artificial Sequence
  Ebola virus siRNA sense strand
aucagucuuccccuuagagac

SEQ ID NO: 14910 - RNA, 21 nt, Artificial Sequence
  Ebola virus siRNA sense strand
ucagucuuccccuuagagacu

SEQ ID NO: 14911 - RNA, 21 nt, Artificial Sequence
  Ebola virus siRNA sense strand
cagucuuccccuuagagacug

SEQ ID NO: 14912 - RNA, 21 nt, Artificial Sequence
  Ebola virus siRNA sense strand
agucuuccccuuagagacuga

SEQ ID NO: 14913 - RNA, 21 nt, Artificial Sequence
  Ebola virus siRNA sense strand
gucuuccccuuagagacugac

SEQ ID NO: 14914 - RNA, 21 nt, Artificial Sequence
  Ebola virus siRNA sense strand
ucuuccccuuagagacugacg

SEQ ID NO: 14915 - RNA, 21 nt, Artificial Sequence
  Ebola virus siRNA sense strand
cuuccccuuagagacugacgc

SEQ ID NO: 14916 - RNA, 21 nt, Artificial Sequence
  Ebola virus siRNA sense strand
uuccccuuagagacugacgca

SEQ ID NO: 14917 - RNA, 21 nt, Artificial Sequence
  Ebola virus siRNA sense strand
uccccuuagagacugacgcag

SEQ ID NO: 14918 - RNA, 21 nt, Artificial Sequence
  Ebola virus siRNA sense strand
ccccuuagagacugacgcaga

SEQ ID NO: 14919 - RNA, 21 nt, Artificial Sequence
  Ebola virus siRNA sense strand
cccuuagagacugacgcagac

SEQ ID NO: 14920 - RNA, 21 nt, Artificial Sequence
  Ebola virus siRNA sense strand
ccuuagagacugacgcagacg

SEQ ID NO: 14921 - RNA, 21 nt, Artificial Sequence
  Ebola virus siRNA sense strand
cuuagagacugacgcagacga

SEQ ID NO: 14922 - RNA, 21 nt, Artificial Sequence
  Ebola virus siRNA sense strand
uuagagacugacgcagacgag

SEQ ID NO: 14923 - RNA, 21 nt, Artificial Sequence
  Ebola virus siRNA sense strand
uagagacugacgcagacgagc

SEQ ID NO: 14924 - RNA, 21 nt, Artificial Sequence
  Ebola virus siRNA sense strand
agagacugacgcagacgagca

SEQ ID NO: 14925 - RNA, 21 nt, Artificial Sequence
  Ebola virus siRNA sense strand
gagacugacgcagacgagcag

SEQ ID NO: 14926 - RNA, 21 nt, Artificial Sequence
  Ebola virus siRNA sense strand
agacugacgcagacgagcagg

SEQ ID NO: 14927 - RNA, 21 nt, Artificial Sequence
  Ebola virus siRNA sense strand
gacugacgcagacgagcagga

SEQ ID NO: 14928 - RNA, 21 nt, Artificial Sequence
  Ebola virus siRNA sense strand
acugacgcagacgagcaggaa

SEQ ID NO: 14929 - RNA, 21 nt, Artificial Sequence
  Ebola virus siRNA sense strand
cugacgcagacgagcaggaac

SEQ ID NO: 14930 - RNA, 21 nt, Artificial Sequence
  Ebola virus siRNA sense strand
ugacgcagacgagcaggaaca

SEQ ID NO: 14931 - RNA, 21 nt, Artificial Sequence
  Ebola virus siRNA sense strand
gacgcagacgagcaggaacag

SEQ ID NO: 14932 - RNA, 21 nt, Artificial Sequence
  Ebola virus siRNA sense strand
acgcagacgagcaggaacaga

SEQ ID NO: 14933 - RNA, 21 nt, Artificial Sequence
  Ebola virus siRNA sense strand
cgcagacgagcaggaacagag

SEQ ID NO: 14934 - RNA, 21 nt, Artificial Sequence
  Ebola virus siRNA sense strand
gcagacgagcaggaacagagc

SEQ ID NO: 14935 - RNA, 21 nt, Artificial Sequence
  Ebola virus siRNA sense strand
cagacgagcaggaacagagcg

SEQ ID NO: 14936 - RNA, 21 nt, Artificial Sequence
  Ebola virus siRNA sense strand
agacgagcaggaacagagcgc

SEQ ID NO: 14937 - RNA, 21 nt, Artificial Sequence
  Ebola virus siRNA sense strand
gacgagcaggaacagagcgcc

SEQ ID NO: 14938 - RNA, 21 nt, Artificial Sequence
  Ebola virus siRNA sense strand
acgagcaggaacagagcgccg

SEQ ID NO: 14939 - RNA, 21 nt, Artificial Sequence
  Ebola virus siRNA sense strand
cgagcaggaacagagcgccga

SEQ ID NO: 14940 - RNA, 21 nt, Artificial Sequence
  Ebola virus siRNA sense strand
gagcaggaacagagcgccgaa

SEQ ID NO: 14941 - RNA, 21 nt, Artificial Sequence
  Ebola virus siRNA sense strand
agcaggaacagagcgccgaag

SEQ ID NO: 14942 - RNA, 21 nt, Artificial Sequence
  Ebola virus siRNA sense strand
gcaggaacagagcgccgaaga

SEQ ID NO: 14943 - RNA, 21 nt, Artificial Sequence
  Ebola virus siRNA sense strand
caggaacagagcgccgaagac

SEQ ID NO: 14944 - RNA, 21 nt, Artificial Sequence
  Ebola virus siRNA sense strand
aggaacagagcgccgaagaca

SEQ ID NO: 14945 - RNA, 21 nt, Artificial Sequence
  Ebola virus siRNA sense strand
ggaacagagcgccgaagacaa

SEQ ID NO: 14946 - RNA, 21 nt, Artificial Sequence
  Ebola virus siRNA sense strand
gaacagagcgccgaagacaau

SEQ ID NO: 14947 - RNA, 21 nt, Artificial Sequence
  Ebola virus siRNA sense strand
aacagagcgccgaagacaaug

SEQ ID NO: 14948 - RNA, 21 nt, Artificial Sequence
  Ebola virus siRNA sense strand
acagagcgccgaagacaaugc

SEQ ID NO: 14949 - RNA, 21 nt, Artificial Sequence
  Ebola virus siRNA sense strand
cagagcgccgaagacaaugca

SEQ ID NO: 14950 - RNA, 21 nt, Artificial Sequence
  Ebola virus siRNA sense strand
agagcgccgaagacaaugcag

SEQ ID NO: 14951 - RNA, 21 nt, Artificial Sequence
  Ebola virus siRNA sense strand
gagcgccgaagacaaugcagc

SEQ ID NO: 14952 - RNA, 21 nt, Artificial Sequence
  Ebola virus siRNA sense strand
agcgccgaagacaaugcagcg

SEQ ID NO: 14953 - RNA, 21 nt, Artificial Sequence
  Ebola virus siRNA sense strand
gcgccgaagacaaugcagcga

SEQ ID NO: 14954 - RNA, 21 nt, Artificial Sequence
  Ebola virus siRNA sense strand
cgccgaagacaaugcagcgag

SEQ ID NO: 14955 - RNA, 21 nt, Artificial Sequence
  Ebola virus siRNA sense strand
gccgaagacaaugcagcgagg

SEQ ID NO: 14956 - RNA, 21 nt, Artificial Sequence
  Ebola virus siRNA sense strand
ccgaagacaaugcagcgaggg

SEQ ID NO: 14957 - RNA, 21 nt, Artificial Sequence
  Ebola virus siRNA sense strand
cgaagacaaugcagcgagggu

SEQ ID NO: 14958 - RNA, 21 nt, Artificial Sequence
  Ebola virus siRNA sense strand
gaagacaaugcagcgagggug

SEQ ID NO: 14959 - RNA, 21 nt, Artificial Sequence
  Ebola virus siRNA sense strand
aagacaaugcagcgagggugg

SEQ ID NO: 14960 - RNA, 21 nt, Artificial Sequence
  Ebola virus siRNA sense strand
agacaaugcagcgaggguggc

SEQ ID NO: 14961 - RNA, 21 nt, Artificial Sequence
  Ebola virus siRNA sense strand
gacaaugcagcgaggguggcc

SEQ ID NO: 14962 - RNA, 21 nt, Artificial Sequence
  Ebola virus siRNA sense strand
acaaugcagcgaggguggccg

SEQ ID NO: 14963 - RNA, 21 nt, Artificial Sequence
  Ebola virus siRNA sense strand
caaugcagcgaggguggccgc

SEQ ID NO: 14964 - RNA, 21 nt, Artificial Sequence
  Ebola virus siRNA sense strand
aaugcagcgaggguggccgcc

SEQ ID NO: 14965 - RNA, 21 nt, Artificial Sequence
  Ebola virus siRNA sense strand
augcagcgaggguggccgcca

SEQ ID NO: 14966 - RNA, 21 nt, Artificial Sequence
  Ebola virus siRNA sense strand
ugcagcgaggguggccgccag

SEQ ID NO: 14967 - RNA, 21 nt, Artificial Sequence
  Ebola virus siRNA sense strand
gcagcgaggguggccgccagc

SEQ ID NO: 14968 - RNA, 21 nt, Artificial Sequence
  Ebola virus siRNA sense strand
cagcgaggguggccgccagcc

SEQ ID NO: 14969 - RNA, 21 nt, Artificial Sequence
  Ebola virus siRNA sense strand
agcgaggguggccgccagccu

SEQ ID NO: 14970 - RNA, 21 nt, Artificial Sequence
  Ebola virus siRNA sense strand
gcgaggguggccgccagccua

SEQ ID NO: 14971 - RNA, 21 nt, Artificial Sequence
  Ebola virus siRNA sense strand
cgaggguggccgccagccuag

SEQ ID NO: 14972 - RNA, 21 nt, Artificial Sequence
  Ebola virus siRNA sense strand
gaggguggccgccagccuagc

SEQ ID NO: 14973 - RNA, 21 nt, Artificial Sequence
  Ebola virus siRNA sense strand
aggguggccgccagccuagca

SEQ ID NO: 14974 - RNA, 21 nt, Artificial Sequence
  Ebola virus siRNA sense strand
ggguggccgccagccuagcaa

SEQ ID NO: 14975 - RNA, 21 nt, Artificial Sequence
  Ebola virus siRNA sense strand
gguggccgccagccuagcaaa

SEQ ID NO: 14976 - RNA, 21 nt, Artificial Sequence
  Ebola virus siRNA sense strand
guggccgccagccuagcaaaa

SEQ ID NO: 14977 - RNA, 21 nt, Artificial Sequence
  Ebola virus siRNA sense strand
uggccgccagccuagcaaaag

SEQ ID NO: 14978 - RNA, 21 nt, Artificial Sequence
  Ebola virus siRNA sense strand
ggccgccagccuagcaaaagu

SEQ ID NO: 14979 - RNA, 21 nt, Artificial Sequence
  Ebola virus siRNA sense strand
gccgccagccuagcaaaaguu

SEQ ID NO: 14980 - RNA, 21 nt, Artificial Sequence
  Ebola virus siRNA sense strand
ccgccagccuagcaaaaguua

SEQ ID NO: 14981 - RNA, 21 nt, Artificial Sequence
  Ebola virus siRNA sense strand
cgccagccuagcaaaaguuac

SEQ ID NO: 14982 - RNA, 21 nt, Artificial Sequence
  Ebola virus siRNA sense strand
gccagccuagcaaaaguuaca

SEQ ID NO: 14983 - RNA, 21 nt, Artificial Sequence
  Ebola virus siRNA sense strand
ccagccuagcaaaaguuacaa

SEQ ID NO: 14984 - RNA, 21 nt, Artificial Sequence
  Ebola virus siRNA sense strand
cagccuagcaaaaguuacaag

SEQ ID NO: 14985 - RNA, 21 nt, Artificial Sequence
  Ebola virus siRNA sense strand
agccuagcaaaaguuacaagu

SEQ ID NO: 14986 - RNA, 21 nt, Artificial Sequence
  Ebola virus siRNA sense strand
gccuagcaaaaguuacaagug

SEQ ID NO: 14987 - RNA, 21 nt, Artificial Sequence
  Ebola virus siRNA sense strand
ccuagcaaaaguuacaagugc

SEQ ID NO: 14988 - RNA, 21 nt, Artificial Sequence
  Ebola virus siRNA sense strand
cuagcaaaaguuacaagugcc

SEQ ID NO: 14989 - RNA, 21 nt, Artificial Sequence
  Ebola virus siRNA sense strand
uagcaaaaguuacaagugccu

SEQ ID NO: 14990 - RNA, 21 nt, Artificial Sequence
  Ebola virus siRNA sense strand
agcaaaaguuacaagugccug

SEQ ID NO: 14991 - RNA, 21 nt, Artificial Sequence
  Ebola virus siRNA sense strand
gcaaaaguuacaagugccugu

SEQ ID NO: 14992 - RNA, 21 nt, Artificial Sequence
  Ebola virus siRNA sense strand
caaaaguuacaagugccugug

SEQ ID NO: 14993 - RNA, 21 nt, Artificial Sequence
  Ebola virus siRNA sense strand
aaaaguuacaagugccugugg

SEQ ID NO: 14994 - RNA, 21 nt, Artificial Sequence
  Ebola virus siRNA sense strand
aaaguuacaagugccugugga

SEQ ID NO: 14995 - RNA, 21 nt, Artificial Sequence
  Ebola virus siRNA sense strand
aaguuacaagugccuguggaa

SEQ ID NO: 14996 - RNA, 21 nt, Artificial Sequence
  Ebola virus siRNA sense strand
aguuacaagugccuguggaau

SEQ ID NO: 14997 - RNA, 21 nt, Artificial Sequence
  Ebola virus siRNA sense strand
guuacaagugccuguggaauc

SEQ ID NO: 14998 - RNA, 21 nt, Artificial Sequence
  Ebola virus siRNA sense strand
uuacaagugccuguggaaucu

SEQ ID NO: 14999 - RNA, 21 nt, Artificial Sequence
  Ebola virus siRNA sense strand
uacaagugccuguggaaucuu

SEQ ID NO: 15000 - RNA, 21 nt, Artificial Sequence
  Ebola virus siRNA sense strand
acaagugccuguggaaucuuu

SEQ ID NO: 15001 - RNA, 21 nt, Artificial Sequence
  Ebola virus siRNA sense strand
caagugccuguggaaucuuuu

SEQ ID NO: 15002 - RNA, 21 nt, Artificial Sequence
  Ebola virus siRNA sense strand
aagugccuguggaaucuuuuu

SEQ ID NO: 15003 - RNA, 21 nt, Artificial Sequence
  Ebola virus siRNA sense strand
agugccuguggaaucuuuuua

SEQ ID NO: 15004 - RNA, 21 nt, Artificial Sequence
  Ebola virus siRNA sense strand
gugccuguggaaucuuuuuaa

SEQ ID NO: 15005 - RNA, 21 nt, Artificial Sequence
  Ebola virus siRNA sense strand
ugccuguggaaucuuuuuaaa

SEQ ID NO: 15006 - RNA, 21 nt, Artificial Sequence
  Ebola virus siRNA sense strand
gccuguggaaucuuuuuaaaa

SEQ ID NO: 15007 - RNA, 21 nt, Artificial Sequence
  Ebola virus siRNA sense strand
ccuguggaaucuuuuuaaaac

SEQ ID NO: 15008 - RNA, 21 nt, Artificial Sequence
  Ebola virus siRNA sense strand
cuguggaaucuuuuuaaaacc

SEQ ID NO: 15009 - RNA, 21 nt, Artificial Sequence
  Ebola virus siRNA sense strand
uguggaaucuuuuuaaaaccu

SEQ ID NO: 15010 - RNA, 21 nt, Artificial Sequence
  Ebola virus siRNA sense strand
guggaaucuuuuuaaaaccug

SEQ ID NO: 15011 - RNA, 21 nt, Artificial Sequence
  Ebola virus siRNA sense strand
uggaaucuuuuuaaaaccuga

SEQ ID NO: 15012 - RNA, 21 nt, Artificial Sequence
  Ebola virus siRNA sense strand
ggaaucuuuuuaaaaccugau

SEQ ID NO: 15013 - RNA, 21 nt, Artificial Sequence
  Ebola virus siRNA sense strand
gaaucuuuuuaaaaccugaug

SEQ ID NO: 15014 - RNA, 21 nt, Artificial Sequence
  Ebola virus siRNA sense strand
aaucuuuuuaaaaccugauga

SEQ ID NO: 15015 - RNA, 21 nt, Artificial Sequence
  Ebola virus siRNA sense strand
aucuuuuuaaaaccugaugaa

SEQ ID NO: 15016 - RNA, 21 nt, Artificial Sequence
  Ebola virus siRNA sense strand
ucuuuuuaaaaccugaugaaa

SEQ ID NO: 15017 - RNA, 21 nt, Artificial Sequence
  Ebola virus siRNA sense strand
cuuuuuaaaaccugaugaaac

SEQ ID NO: 15018 - RNA, 21 nt, Artificial Sequence
  Ebola virus siRNA sense strand
uuuuuaaaaccugaugaaaca

SEQ ID NO: 15019 - RNA, 21 nt, Artificial Sequence
  Ebola virus siRNA sense strand
uuuuaaaaccugaugaaacau

SEQ ID NO: 15020 - RNA, 21 nt, Artificial Sequence
  Ebola virus siRNA sense strand
uuuaaaaccugaugaaacauu

SEQ ID NO: 15021 - RNA, 21 nt, Artificial Sequence
  Ebola virus siRNA sense strand
uuaaaaccugaugaaacauuu

SEQ ID NO: 15022 - RNA, 21 nt, Artificial Sequence
  Ebola virus siRNA sense strand
uaaaaccugaugaaacauuug

SEQ ID NO: 15023 - RNA, 21 nt, Artificial Sequence
  Ebola virus siRNA sense strand
aaaaccugaugaaacauuugu

SEQ ID NO: 15024 - RNA, 21 nt, Artificial Sequence
  Ebola virus siRNA sense strand
aaaccugaugaaacauuugua

SEQ ID NO: 15025 - RNA, 21 nt, Artificial Sequence
  Ebola virus siRNA sense strand
aaccugaugaaacauuuguac

SEQ ID NO: 15026 - RNA, 21 nt, Artificial Sequence
  Ebola virus siRNA sense strand
accugaugaaacauuuguaca

SEQ ID NO: 15027 - RNA, 21 nt, Artificial Sequence
  Ebola virus siRNA sense strand
ccugaugaaacauuuguacau

SEQ ID NO: 15028 - RNA, 21 nt, Artificial Sequence
  Ebola virus siRNA sense strand
cugaugaaacauuuguacauu

SEQ ID NO: 15029 - RNA, 21 nt, Artificial Sequence
  Ebola virus siRNA sense strand
ugaugaaacauuuguacauuc

SEQ ID NO: 15030 - RNA, 21 nt, Artificial Sequence
  Ebola virus siRNA sense strand
gaugaaacauuuguacauuca

SEQ ID NO: 15031 - RNA, 21 nt, Artificial Sequence
  Ebola virus siRNA sense strand
augaaacauuuguacauucag

SEQ ID NO: 15032 - RNA, 21 nt, Artificial Sequence
  Ebola virus siRNA sense strand
ugaaacauuuguacauucagg

SEQ ID NO: 15033 - RNA, 21 nt, Artificial Sequence
  Ebola virus siRNA sense strand
gaaacauuuguacauucaggu

SEQ ID NO: 15034 - RNA, 21 nt, Artificial Sequence
  Ebola virus siRNA sense strand
aaacauuuguacauucagguu

SEQ ID NO: 15035 - RNA, 21 nt, Artificial Sequence
  Ebola virus siRNA sense strand
aacauuuguacauucagguuu

SEQ ID NO: 15036 - RNA, 21 nt, Artificial Sequence
  Ebola virus siRNA sense strand
acauuuguacauucagguuuu

SEQ ID NO: 15037 - RNA, 21 nt, Artificial Sequence
  Ebola virus siRNA sense strand
cauuuguacauucagguuuua

SEQ ID NO: 15038 - RNA, 21 nt, Artificial Sequence
  Ebola virus siRNA sense strand
auuuguacauucagguuuuau

SEQ ID NO: 15039 - RNA, 21 nt, Artificial Sequence
  Ebola virus siRNA sense strand
uuuguacauucagguuuuauc

SEQ ID NO: 15040 - RNA, 21 nt, Artificial Sequence
  Ebola virus siRNA sense strand
uuguacauucagguuuuaucu

SEQ ID NO: 15041 - RNA, 21 nt, Artificial Sequence
  Ebola virus siRNA sense strand
uguacauucagguuuuaucua

SEQ ID NO: 15042 - RNA, 21 nt, Artificial Sequence
  Ebola virus siRNA sense strand
guacauucagguuuuaucuau

SEQ ID NO: 15043 - RNA, 21 nt, Artificial Sequence
  Ebola virus siRNA sense strand
uacauucagguuuuaucuauu

SEQ ID NO: 15044 - RNA, 21 nt, Artificial Sequence
  Ebola virus siRNA sense strand
acauucagguuuuaucuauuu

SEQ ID NO: 15045 - RNA, 21 nt, Artificial Sequence
  Ebola virus siRNA sense strand
cauucagguuuuaucuauuuu

SEQ ID NO: 15046 - RNA, 21 nt, Artificial Sequence
  Ebola virus siRNA sense strand
auucagguuuuaucuauuuug

SEQ ID NO: 15047 - RNA, 21 nt, Artificial Sequence
  Ebola virus siRNA sense strand
uucagguuuuaucuauuuugg

SEQ ID NO: 15048 - RNA, 21 nt, Artificial Sequence
  Ebola virus siRNA sense strand
ucagguuuuaucuauuuugga

SEQ ID NO: 15049 - RNA, 21 nt, Artificial Sequence
  Ebola virus siRNA sense strand
cagguuuuaucuauuuuggaa

SEQ ID NO: 15050 - RNA, 21 nt, Artificial Sequence
  Ebola virus siRNA sense strand
agguuuuaucuauuuuggaaa

SEQ ID NO: 15051 - RNA, 21 nt, Artificial Sequence
  Ebola virus siRNA sense strand
gguuuuaucuauuuuggaaaa

SEQ ID NO: 15052 - RNA, 21 nt, Artificial Sequence
  Ebola virus siRNA sense strand
guuuuaucuauuuuggaaaaa

SEQ ID NO: 15053 - RNA, 21 nt, Artificial Sequence
  Ebola virus siRNA sense strand
uuuuaucuauuuuggaaaaaa

SEQ ID NO: 15054 - RNA, 21 nt, Artificial Sequence
  Ebola virus siRNA sense strand
uuuaucuauuuuggaaaaaaa

SEQ ID NO: 15055 - RNA, 21 nt, Artificial Sequence
  Ebola virus siRNA sense strand
uuaucuauuuuggaaaaaaac

SEQ ID NO: 15056 - RNA, 21 nt, Artificial Sequence
  Ebola virus siRNA sense strand
uaucuauuuuggaaaaaaaca

SEQ ID NO: 15057 - RNA, 21 nt, Artificial Sequence
  Ebola virus siRNA sense strand
aucuauuuuggaaaaaaacaa

SEQ ID NO: 15058 - RNA, 21 nt, Artificial Sequence
  Ebola virus siRNA sense strand
ucuauuuuggaaaaaaacaau

SEQ ID NO: 15059 - RNA, 21 nt, Artificial Sequence
  Ebola virus siRNA sense strand
cuauuuuggaaaaaaacaaua

SEQ ID NO: 15060 - RNA, 21 nt, Artificial Sequence
  Ebola virus siRNA sense strand
uauuuuggaaaaaaacaauau

SEQ ID NO: 15061 - RNA, 21 nt, Artificial Sequence
  Ebola virus siRNA sense strand
auuuuggaaaaaaacaauauu

SEQ ID NO: 15062 - RNA, 21 nt, Artificial Sequence
  Ebola virus siRNA sense strand
uuuuggaaaaaaacaauauuu

SEQ ID NO: 15063 - RNA, 21 nt, Artificial Sequence
  Ebola virus siRNA sense strand
uuuggaaaaaaacaauauuug

SEQ ID NO: 15064 - RNA, 21 nt, Artificial Sequence
  Ebola virus siRNA sense strand
uuggaaaaaaacaauauuuga

SEQ ID NO: 15065 - RNA, 21 nt, Artificial Sequence
  Ebola virus siRNA sense strand
uggaaaaaaacaauauuugaa

SEQ ID NO: 15066 - RNA, 21 nt, Artificial Sequence
  Ebola virus siRNA sense strand
ggaaaaaaacaauauuugaau

SEQ ID NO: 15067 - RNA, 21 nt, Artificial Sequence
  Ebola virus siRNA sense strand
gaaaaaaacaauauuugaaug

SEQ ID NO: 15068 - RNA, 21 nt, Artificial Sequence
  Ebola virus siRNA sense strand
aaaaaaacaauauuugaaugg

SEQ ID NO: 15069 - RNA, 21 nt, Artificial Sequence
  Ebola virus siRNA sense strand
aaaaaacaauauuugaauggg

SEQ ID NO: 15070 - RNA, 21 nt, Artificial Sequence
  Ebola virus siRNA sense strand
aaaaacaauauuugaaugggg

SEQ ID NO: 15071 - RNA, 21 nt, Artificial Sequence
  Ebola virus siRNA sense strand
aaaacaauauuugaauggggu

SEQ ID NO: 15072 - RNA, 21 nt, Artificial Sequence
  Ebola virus siRNA sense strand
aaacaauauuugaaugggguc

SEQ ID NO: 15073 - RNA, 21 nt, Artificial Sequence
  Ebola virus siRNA sense strand
aacaauauuugaauggggucc

SEQ ID NO: 15074 - RNA, 21 nt, Artificial Sequence
  Ebola virus siRNA sense strand
acaauauuugaauggggucca

SEQ ID NO: 15075 - RNA, 21 nt, Artificial Sequence
  Ebola virus siRNA sense strand
caauauuugaaugggguccaa

SEQ ID NO: 15076 - RNA, 21 nt, Artificial Sequence
  Ebola virus siRNA sense strand
aauauuugaaugggguccaau

SEQ ID NO: 15077 - RNA, 21 nt, Artificial Sequence
  Ebola virus siRNA sense strand
auauuugaaugggguccaauu

SEQ ID NO: 15078 - RNA, 21 nt, Artificial Sequence
  Ebola virus siRNA sense strand
uauuugaaugggguccaauug

SEQ ID NO: 15079 - RNA, 21 nt, Artificial Sequence
  Ebola virus siRNA sense strand
auuugaaugggguccaauugc

SEQ ID NO: 15080 - RNA, 21 nt, Artificial Sequence
  Ebola virus siRNA sense strand
uuugaaugggguccaauugcc

SEQ ID NO: 15081 - RNA, 21 nt, Artificial Sequence
  Ebola virus siRNA sense strand
uugaaugggguccaauugccu

SEQ ID NO: 15082 - RNA, 21 nt, Artificial Sequence
  Ebola virus siRNA sense strand
ugaaugggguccaauugccuc

SEQ ID NO: 15083 - RNA, 21 nt, Artificial Sequence
  Ebola virus siRNA sense strand
gaaugggguccaauugccuca

SEQ ID NO: 15084 - RNA, 21 nt, Artificial Sequence
  Ebola virus siRNA sense strand
aaugggguccaauugccucag

SEQ ID NO: 15085 - RNA, 21 nt, Artificial Sequence
  Ebola virus siRNA sense strand
augggguccaauugccucagu

SEQ ID NO: 15086 - RNA, 21 nt, Artificial Sequence
  Ebola virus siRNA sense strand
ugggguccaauugccucaguc

SEQ ID NO: 15087 - RNA, 21 nt, Artificial Sequence
  Ebola virus siRNA sense strand
gggguccaauugccucagucc

SEQ ID NO: 15088 - RNA, 21 nt, Artificial Sequence
  Ebola virus siRNA sense strand
ggguccaauugccucaguccc

SEQ ID NO: 15089 - RNA, 21 nt, Artificial Sequence
  Ebola virus siRNA sense strand
gguccaauugccucagucccu

SEQ ID NO: 15090 - RNA, 21 nt, Artificial Sequence
  Ebola virus siRNA sense strand
guccaauugccucagucccuu

SEQ ID NO: 15091 - RNA, 21 nt, Artificial Sequence
  Ebola virus siRNA sense strand
uccaauugccucagucccuua

SEQ ID NO: 15092 - RNA, 21 nt, Artificial Sequence
  Ebola virus siRNA sense strand
ccaauugccucagucccuuaa

SEQ ID NO: 15093 - RNA, 21 nt, Artificial Sequence
  Ebola virus siRNA sense strand
caauugccucagucccuuaaa

SEQ ID NO: 15094 - RNA, 21 nt, Artificial Sequence
  Ebola virus siRNA sense strand
aauugccucagucccuuaaaa

SEQ ID NO: 15095 - RNA, 21 nt, Artificial Sequence
  Ebola virus siRNA sense strand
auugccucagucccuuaaaac

SEQ ID NO: 15096 - RNA, 21 nt, Artificial Sequence
  Ebola virus siRNA sense strand
uugccucagucccuuaaaacg

SEQ ID NO: 15097 - RNA, 21 nt, Artificial Sequence
  Ebola virus siRNA sense strand
ugccucagucccuuaaaacgg

SEQ ID NO: 15098 - RNA, 21 nt, Artificial Sequence
  Ebola virus siRNA sense strand
gccucagucccuuaaaacggc

SEQ ID NO: 15099 - RNA, 21 nt, Artificial Sequence
  Ebola virus siRNA sense strand
ccucagucccuuaaaacggcu

SEQ ID NO: 15100 - RNA, 21 nt, Artificial Sequence
  Ebola virus siRNA sense strand
cucagucccuuaaaacggcua

SEQ ID NO: 15101 - RNA, 21 nt, Artificial Sequence
  Ebola virus siRNA sense strand
ucagucccuuaaaacggcuac

SEQ ID NO: 15102 - RNA, 21 nt, Artificial Sequence
  Ebola virus siRNA sense strand
cagucccuuaaaacggcuaca

SEQ ID NO: 15103 - RNA, 21 nt, Artificial Sequence
  Ebola virus siRNA sense strand
agucccuuaaaacggcuacaa

SEQ ID NO: 15104 - RNA, 21 nt, Artificial Sequence
  Ebola virus siRNA sense strand
gucccuuaaaacggcuacaag

SEQ ID NO: 15105 - RNA, 21 nt, Artificial Sequence
  Ebola virus siRNA sense strand
ucccuuaaaacggcuacaaga

SEQ ID NO: 15106 - RNA, 21 nt, Artificial Sequence
  Ebola virus siRNA sense strand
cccuuaaaacggcuacaagaa

SEQ ID NO: 15107 - RNA, 21 nt, Artificial Sequence
  Ebola virus siRNA sense strand
ccuuaaaacggcuacaagaau

SEQ ID NO: 15108 - RNA, 21 nt, Artificial Sequence
  Ebola virus siRNA sense strand
cuuaaaacggcuacaagaaug

SEQ ID NO: 15109 - RNA, 21 nt, Artificial Sequence
  Ebola virus siRNA sense strand
uuaaaacggcuacaagaaugg

SEQ ID NO: 15110 - RNA, 21 nt, Artificial Sequence
  Ebola virus siRNA sense strand
uaaaacggcuacaagaauggc

SEQ ID NO: 15111 - RNA, 21 nt, Artificial Sequence
  Ebola virus siRNA sense strand
aaaacggcuacaagaauggca

SEQ ID NO: 15112 - RNA, 21 nt, Artificial Sequence
  Ebola virus siRNA sense strand
aaacggcuacaagaauggcac

SEQ ID NO: 15113 - RNA, 21 nt, Artificial Sequence
  Ebola virus siRNA sense strand
aacggcuacaagaauggcacc

SEQ ID NO: 15114 - RNA, 21 nt, Artificial Sequence
  Ebola virus siRNA sense strand
acggcuacaagaauggcacca

SEQ ID NO: 15115 - RNA, 21 nt, Artificial Sequence
  Ebola virus siRNA sense strand
cggcuacaagaauggcaccau

SEQ ID NO: 15116 - RNA, 21 nt, Artificial Sequence
  Ebola virus siRNA sense strand
ggcuacaagaauggcaccauu

SEQ ID NO: 15117 - RNA, 21 nt, Artificial Sequence
  Ebola virus siRNA sense strand
gcuacaagaauggcaccauug

SEQ ID NO: 15118 - RNA, 21 nt, Artificial Sequence
  Ebola virus siRNA sense strand
cuacaagaauggcaccauugu

SEQ ID NO: 15119 - RNA, 21 nt, Artificial Sequence
  Ebola virus siRNA sense strand
uacaagaauggcaccauuguc

SEQ ID NO: 15120 - RNA, 21 nt, Artificial Sequence
  Ebola virus siRNA sense strand
acaagaauggcaccauugucu

SEQ ID NO: 15121 - RNA, 21 nt, Artificial Sequence
  Ebola virus siRNA sense strand
caagaauggcaccauugucug

SEQ ID NO: 15122 - RNA, 21 nt, Artificial Sequence
  Ebola virus siRNA sense strand
aagaauggcaccauugucuga

SEQ ID NO: 15123 - RNA, 21 nt, Artificial Sequence
  Ebola virus siRNA sense strand
agaauggcaccauugucugau

SEQ ID NO: 15124 - RNA, 21 nt, Artificial Sequence
  Ebola virus siRNA sense strand
gaauggcaccauugucugaug

SEQ ID NO: 15125 - RNA, 21 nt, Artificial Sequence
  Ebola virus siRNA sense strand
aauggcaccauugucugaugc

SEQ ID NO: 15126 - RNA, 21 nt, Artificial Sequence
  Ebola virus siRNA sense strand
auggcaccauugucugaugca

SEQ ID NO: 15127 - RNA, 21 nt, Artificial Sequence
  Ebola virus siRNA sense strand
uggcaccauugucugaugcaa

SEQ ID NO: 15128 - RNA, 21 nt, Artificial Sequence
  Ebola virus siRNA sense strand
ggcaccauugucugaugcaau

SEQ ID NO: 15129 - RNA, 21 nt, Artificial Sequence
  Ebola virus siRNA sense strand
gcaccauugucugaugcaauu

SEQ ID NO: 15130 - RNA, 21 nt, Artificial Sequence
  Ebola virus siRNA sense strand
caccauugucugaugcaauuu

SEQ ID NO: 15131 - RNA, 21 nt, Artificial Sequence
  Ebola virus siRNA sense strand
accauugucugaugcaauuuu

SEQ ID NO: 15132 - RNA, 21 nt, Artificial Sequence
  Ebola virus siRNA sense strand
ccauugucugaugcaauuuuu

SEQ ID NO: 15133 - RNA, 21 nt, Artificial Sequence
  Ebola virus siRNA sense strand
cauugucugaugcaauuuuug

SEQ ID NO: 15134 - RNA, 21 nt, Artificial Sequence
  Ebola virus siRNA sense strand
auugucugaugcaauuuuuga

SEQ ID NO: 15135 - RNA, 21 nt, Artificial Sequence
  Ebola virus siRNA sense strand
uugucugaugcaauuuuugau

SEQ ID NO: 15136 - RNA, 21 nt, Artificial Sequence
  Ebola virus siRNA sense strand
ugucugaugcaauuuuugaug

SEQ ID NO: 15137 - RNA, 21 nt, Artificial Sequence
  Ebola virus siRNA sense strand
gucugaugcaauuuuugauga

SEQ ID NO: 15138 - RNA, 21 nt, Artificial Sequence
  Ebola virus siRNA sense strand
ucugaugcaauuuuugaugau

SEQ ID NO: 15139 - RNA, 21 nt, Artificial Sequence
  Ebola virus siRNA sense strand
cugaugcaauuuuugaugauc

SEQ ID NO: 15140 - RNA, 21 nt, Artificial Sequence
  Ebola virus siRNA sense strand
ugaugcaauuuuugaugaucu

SEQ ID NO: 15141 - RNA, 21 nt, Artificial Sequence
  Ebola virus siRNA sense strand
gaugcaauuuuugaugaucuu

SEQ ID NO: 15142 - RNA, 21 nt, Artificial Sequence
  Ebola virus siRNA sense strand
augcaauuuuugaugaucuuc

SEQ ID NO: 15143 - RNA, 21 nt, Artificial Sequence
  Ebola virus siRNA sense strand
ugcaauuuuugaugaucuuca

SEQ ID NO: 15144 - RNA, 21 nt, Artificial Sequence
  Ebola virus siRNA sense strand
gcaauuuuugaugaucuucaa

SEQ ID NO: 15145 - RNA, 21 nt, Artificial Sequence
  Ebola virus siRNA sense strand
caauuuuugaugaucuucaag

SEQ ID NO: 15146 - RNA, 21 nt, Artificial Sequence
  Ebola virus siRNA sense strand
aauuuuugaugaucuucaagg

SEQ ID NO: 15147 - RNA, 21 nt, Artificial Sequence
  Ebola virus siRNA sense strand
auuuuugaugaucuucaaggg

SEQ ID NO: 15148 - RNA, 21 nt, Artificial Sequence
  Ebola virus siRNA sense strand
uuuuugaugaucuucaaggga

SEQ ID NO: 15149 - RNA, 21 nt, Artificial Sequence
  Ebola virus siRNA sense strand
uuuugaugaucuucaagggac

SEQ ID NO: 15150 - RNA, 21 nt, Artificial Sequence
  Ebola virus siRNA sense strand
uuugaugaucuucaagggacc

SEQ ID NO: 15151 - RNA, 21 nt, Artificial Sequence
  Ebola virus siRNA sense strand
uugaugaucuucaagggaccc

SEQ ID NO: 15152 - RNA, 21 nt, Artificial Sequence
  Ebola virus siRNA sense strand
ugaugaucuucaagggacccu

SEQ ID NO: 15153 - RNA, 21 nt, Artificial Sequence
  Ebola virus siRNA sense strand
gaugaucuucaagggacccug

SEQ ID NO: 15154 - RNA, 21 nt, Artificial Sequence
  Ebola virus siRNA sense strand
augaucuucaagggacccugg

SEQ ID NO: 15155 - RNA, 21 nt, Artificial Sequence
  Ebola virus siRNA sense strand
ugaucuucaagggacccuggc

SEQ ID NO: 15156 - RNA, 21 nt, Artificial Sequence
  Ebola virus siRNA sense strand
gaucuucaagggacccuggcu

SEQ ID NO: 15157 - RNA, 21 nt, Artificial Sequence
  Ebola virus siRNA sense strand
aucuucaagggacccuggcua

SEQ ID NO: 15158 - RNA, 21 nt, Artificial Sequence
  Ebola virus siRNA sense strand
ucuucaagggacccuggcuag

SEQ ID NO: 15159 - RNA, 21 nt, Artificial Sequence
  Ebola virus siRNA sense strand
cuucaagggacccuggcuagu

SEQ ID NO: 15160 - RNA, 21 nt, Artificial Sequence
  Ebola virus siRNA sense strand
uucaagggacccuggcuagua

SEQ ID NO: 15161 - RNA, 21 nt, Artificial Sequence
  Ebola virus siRNA sense strand
ucaagggacccuggcuaguau

SEQ ID NO: 15162 - RNA, 21 nt, Artificial Sequence
  Ebola virus siRNA sense strand
caagggacccuggcuaguaua

SEQ ID NO: 15163 - RNA, 21 nt, Artificial Sequence
  Ebola virus siRNA sense strand
aagggacccuggcuaguauag

SEQ ID NO: 15164 - RNA, 21 nt, Artificial Sequence
  Ebola virus siRNA sense strand
agggacccuggcuaguauagg

SEQ ID NO: 15165 - RNA, 21 nt, Artificial Sequence
  Ebola virus siRNA sense strand
gggacccuggcuaguauaggc

SEQ ID NO: 15166 - RNA, 21 nt, Artificial Sequence
  Ebola virus siRNA sense strand
ggacccuggcuaguauaggca

SEQ ID NO: 15167 - RNA, 21 nt, Artificial Sequence
  Ebola virus siRNA sense strand
gacccuggcuaguauaggcac

SEQ ID NO: 15168 - RNA, 21 nt, Artificial Sequence
  Ebola virus siRNA sense strand
acccuggcuaguauaggcacu

SEQ ID NO: 15169 - RNA, 21 nt, Artificial Sequence
  Ebola virus siRNA sense strand
cccuggcuaguauaggcacug

SEQ ID NO: 15170 - RNA, 21 nt, Artificial Sequence
  Ebola virus siRNA sense strand
ccuggcuaguauaggcacugc

SEQ ID NO: 15171 - RNA, 21 nt, Artificial Sequence
  Ebola virus siRNA sense strand
cuggcuaguauaggcacugcu

SEQ ID NO: 15172 - RNA, 21 nt, Artificial Sequence
  Ebola virus siRNA sense strand
uggcuaguauaggcacugcuu

SEQ ID NO: 15173 - RNA, 21 nt, Artificial Sequence
  Ebola virus siRNA sense strand
ggcuaguauaggcacugcuuu

SEQ ID NO: 15174 - RNA, 21 nt, Artificial Sequence
  Ebola virus siRNA sense strand
gcuaguauaggcacugcuuuu

SEQ ID NO: 15175 - RNA, 21 nt, Artificial Sequence
  Ebola virus siRNA sense strand
cuaguauaggcacugcuuuug

SEQ ID NO: 15176 - RNA, 21 nt, Artificial Sequence
  Ebola virus siRNA sense strand
uaguauaggcacugcuuuuga

SEQ ID NO: 15177 - RNA, 21 nt, Artificial Sequence
  Ebola virus siRNA sense strand
aguauaggcacugcuuuugag

SEQ ID NO: 15178 - RNA, 21 nt, Artificial Sequence
  Ebola virus siRNA sense strand
guauaggcacugcuuuugagc

SEQ ID NO: 15179 - RNA, 21 nt, Artificial Sequence
  Ebola virus siRNA sense strand
uauaggcacugcuuuugagcg

SEQ ID NO: 15180 - RNA, 21 nt, Artificial Sequence
  Ebola virus siRNA sense strand
auaggcacugcuuuugagcga

SEQ ID NO: 15181 - RNA, 21 nt, Artificial Sequence
  Ebola virus siRNA sense strand
uaggcacugcuuuugagcgau

SEQ ID NO: 15182 - RNA, 21 nt, Artificial Sequence
  Ebola virus siRNA sense strand
aggcacugcuuuugagcgauc

SEQ ID NO: 15183 - RNA, 21 nt, Artificial Sequence
  Ebola virus siRNA sense strand
ggcacugcuuuugagcgaucc

SEQ ID NO: 15184 - RNA, 21 nt, Artificial Sequence
  Ebola virus siRNA sense strand
gcacugcuuuugagcgaucca

SEQ ID NO: 15185 - RNA, 21 nt, Artificial Sequence
  Ebola virus siRNA sense strand
cacugcuuuugagcgauccau

SEQ ID NO: 15186 - RNA, 21 nt, Artificial Sequence
  Ebola virus siRNA sense strand
acugcuuuugagcgauccauc

SEQ ID NO: 15187 - RNA, 21 nt, Artificial Sequence
  Ebola virus siRNA sense strand
cugcuuuugagcgauccaucu

SEQ ID NO: 15188 - RNA, 21 nt, Artificial Sequence
  Ebola virus siRNA sense strand
ugcuuuugagcgauccaucuc

SEQ ID NO: 15189 - RNA, 21 nt, Artificial Sequence
  Ebola virus siRNA sense strand
gcuuuugagcgauccaucucu

SEQ ID NO: 15190 - RNA, 21 nt, Artificial Sequence
  Ebola virus siRNA sense strand
cuuuugagcgauccaucucug

SEQ ID NO: 15191 - RNA, 21 nt, Artificial Sequence
  Ebola virus siRNA sense strand
uuuugagcgauccaucucuga

SEQ ID NO: 15192 - RNA, 21 nt, Artificial Sequence
  Ebola virus siRNA sense strand
uuugagcgauccaucucugag

SEQ ID NO: 15193 - RNA, 21 nt, Artificial Sequence
  Ebola virus siRNA sense strand
uugagcgauccaucucugaga

SEQ ID NO: 15194 - RNA, 21 nt, Artificial Sequence
  Ebola virus siRNA sense strand
ugagcgauccaucucugagac

SEQ ID NO: 15195 - RNA, 21 nt, Artificial Sequence
  Ebola virus siRNA sense strand
gagcgauccaucucugagaca

SEQ ID NO: 15196 - RNA, 21 nt, Artificial Sequence
  Ebola virus siRNA sense strand
agcgauccaucucugagacac

SEQ ID NO: 15197 - RNA, 21 nt, Artificial Sequence
  Ebola virus siRNA sense strand
gcgauccaucucugagacacg

SEQ ID NO: 15198 - RNA, 21 nt, Artificial Sequence
  Ebola virus siRNA sense strand
cgauccaucucugagacacga

SEQ ID NO: 15199 - RNA, 21 nt, Artificial Sequence
  Ebola virus siRNA sense strand
gauccaucucugagacacgac

SEQ ID NO: 15200 - RNA, 21 nt, Artificial Sequence
  Ebola virus siRNA sense strand
auccaucucugagacacgaca

SEQ ID NO: 15201 - RNA, 21 nt, Artificial Sequence
  Ebola virus siRNA sense strand
uccaucucugagacacgacau

SEQ ID NO: 15202 - RNA, 21 nt, Artificial Sequence
  Ebola virus siRNA sense strand
ccaucucugagacacgacaua

SEQ ID NO: 15203 - RNA, 21 nt, Artificial Sequence
  Ebola virus siRNA sense strand
caucucugagacacgacauau

SEQ ID NO: 15204 - RNA, 21 nt, Artificial Sequence
  Ebola virus siRNA sense strand
aucucugagacacgacauauc

SEQ ID NO: 15205 - RNA, 21 nt, Artificial Sequence
  Ebola virus siRNA sense strand
ucucugagacacgacauaucu

SEQ ID NO: 15206 - RNA, 21 nt, Artificial Sequence
  Ebola virus siRNA sense strand
cucugagacacgacauaucuu

SEQ ID NO: 15207 - RNA, 21 nt, Artificial Sequence
  Ebola virus siRNA sense strand
ucugagacacgacauaucuuu

SEQ ID NO: 15208 - RNA, 21 nt, Artificial Sequence
  Ebola virus siRNA sense strand
cugagacacgacauaucuuuc

SEQ ID NO: 15209 - RNA, 21 nt, Artificial Sequence
  Ebola virus siRNA sense strand
ugagacacgacauaucuuucc

SEQ ID NO: 15210 - RNA, 21 nt, Artificial Sequence
  Ebola virus siRNA sense strand
gagacacgacauaucuuuccu

SEQ ID NO: 15211 - RNA, 21 nt, Artificial Sequence
  Ebola virus siRNA sense strand
agacacgacauaucuuuccuu

SEQ ID NO: 15212 - RNA, 21 nt, Artificial Sequence
  Ebola virus siRNA sense strand
gacacgacauaucuuuccuug

SEQ ID NO: 15213 - RNA, 21 nt, Artificial Sequence
  Ebola virus siRNA sense strand
acacgacauaucuuuccuugc

SEQ ID NO: 15214 - RNA, 21 nt, Artificial Sequence
  Ebola virus siRNA sense strand
cacgacauaucuuuccuugca

SEQ ID NO: 15215 - RNA, 21 nt, Artificial Sequence
  Ebola virus siRNA sense strand
acgacauaucuuuccuugcag

SEQ ID NO: 15216 - RNA, 21 nt, Artificial Sequence
  Ebola virus siRNA sense strand
cgacauaucuuuccuugcagg

SEQ ID NO: 15217 - RNA, 21 nt, Artificial Sequence
  Ebola virus siRNA sense strand
gacauaucuuuccuugcagga

SEQ ID NO: 15218 - RNA, 21 nt, Artificial Sequence
  Ebola virus siRNA sense strand
acauaucuuuccuugcaggau

SEQ ID NO: 15219 - RNA, 21 nt, Artificial Sequence
  Ebola virus siRNA sense strand
cauaucuuuccuugcaggaua

SEQ ID NO: 15220 - RNA, 21 nt, Artificial Sequence
  Ebola virus siRNA sense strand
auaucuuuccuugcaggauaa

SEQ ID NO: 15221 - RNA, 21 nt, Artificial Sequence
  Ebola virus siRNA sense strand
uaucuuuccuugcaggauaac

SEQ ID NO: 15222 - RNA, 21 nt, Artificial Sequence
  Ebola virus siRNA sense strand
aucuuuccuugcaggauaacc

SEQ ID NO: 15223 - RNA, 21 nt, Artificial Sequence
  Ebola virus siRNA sense strand
ucuuuccuugcaggauaaccg

SEQ ID NO: 15224 - RNA, 21 nt, Artificial Sequence
  Ebola virus siRNA sense strand
cuuuccuugcaggauaaccgc

SEQ ID NO: 15225 - RNA, 21 nt, Artificial Sequence
  Ebola virus siRNA sense strand
uuuccuugcaggauaaccgca

SEQ ID NO: 15226 - RNA, 21 nt, Artificial Sequence
  Ebola virus siRNA sense strand
uuccuugcaggauaaccgcag

SEQ ID NO: 15227 - RNA, 21 nt, Artificial Sequence
  Ebola virus siRNA sense strand
uccuugcaggauaaccgcagc

SEQ ID NO: 15228 - RNA, 21 nt, Artificial Sequence
  Ebola virus siRNA sense strand
ccuugcaggauaaccgcagcu

SEQ ID NO: 15229 - RNA, 21 nt, Artificial Sequence
  Ebola virus siRNA sense strand
cuugcaggauaaccgcagcuu

SEQ ID NO: 15230 - RNA, 21 nt, Artificial Sequence
  Ebola virus siRNA sense strand
uugcaggauaaccgcagcuuu

SEQ ID NO: 15231 - RNA, 21 nt, Artificial Sequence
  Ebola virus siRNA sense strand
ugcaggauaaccgcagcuuuc

SEQ ID NO: 15232 - RNA, 21 nt, Artificial Sequence
  Ebola virus siRNA sense strand
gcaggauaaccgcagcuuucc

SEQ ID NO: 15233 - RNA, 21 nt, Artificial Sequence
  Ebola virus siRNA sense strand
caggauaaccgcagcuuucca

SEQ ID NO: 15234 - RNA, 21 nt, Artificial Sequence
  Ebola virus siRNA sense strand
aggauaaccgcagcuuuccau

SEQ ID NO: 15235 - RNA, 21 nt, Artificial Sequence
  Ebola virus siRNA sense strand
ggauaaccgcagcuuuccaua

SEQ ID NO: 15236 - RNA, 21 nt, Artificial Sequence
  Ebola virus siRNA sense strand
gauaaccgcagcuuuccauac

SEQ ID NO: 15237 - RNA, 21 nt, Artificial Sequence
  Ebola virus siRNA sense strand
auaaccgcagcuuuccauacg

SEQ ID NO: 15238 - RNA, 21 nt, Artificial Sequence
  Ebola virus siRNA sense strand
uaaccgcagcuuuccauacgu

SEQ ID NO: 15239 - RNA, 21 nt, Artificial Sequence
  Ebola virus siRNA sense strand
aaccgcagcuuuccauacguu

SEQ ID NO: 15240 - RNA, 21 nt, Artificial Sequence
  Ebola virus siRNA sense strand
accgcagcuuuccauacguuu

SEQ ID NO: 15241 - RNA, 21 nt, Artificial Sequence
  Ebola virus siRNA sense strand
ccgcagcuuuccauacguuuu

SEQ ID NO: 15242 - RNA, 21 nt, Artificial Sequence
  Ebola virus siRNA sense strand
cgcagcuuuccauacguuuuu

SEQ ID NO: 15243 - RNA, 21 nt, Artificial Sequence
  Ebola virus siRNA sense strand
gcagcuuuccauacguuuuuu

SEQ ID NO: 15244 - RNA, 21 nt, Artificial Sequence
  Ebola virus siRNA sense strand
cagcuuuccauacguuuuuuu

SEQ ID NO: 15245 - RNA, 21 nt, Artificial Sequence
  Ebola virus siRNA sense strand
agcuuuccauacguuuuuuuc

SEQ ID NO: 15246 - RNA, 21 nt, Artificial Sequence
  Ebola virus siRNA sense strand
gcuuuccauacguuuuuuucg

SEQ ID NO: 15247 - RNA, 21 nt, Artificial Sequence
  Ebola virus siRNA sense strand
cuuuccauacguuuuuuucgg

SEQ ID NO: 15248 - RNA, 21 nt, Artificial Sequence
  Ebola virus siRNA sense strand
uuuccauacguuuuuuucggu

SEQ ID NO: 15249 - RNA, 21 nt, Artificial Sequence
  Ebola virus siRNA sense strand
uuccauacguuuuuuucggug

SEQ ID NO: 15250 - RNA, 21 nt, Artificial Sequence
  Ebola virus siRNA sense strand
uccauacguuuuuuucgguga

SEQ ID NO: 15251 - RNA, 21 nt, Artificial Sequence
  Ebola virus siRNA sense strand
ccauacguuuuuuucggugag

SEQ ID NO: 15252 - RNA, 21 nt, Artificial Sequence
  Ebola virus siRNA sense strand
cauacguuuuuuucggugaga

SEQ ID NO: 15253 - RNA, 21 nt, Artificial Sequence
  Ebola virus siRNA sense strand
auacguuuuuuucggugagaa

SEQ ID NO: 15254 - RNA, 21 nt, Artificial Sequence
  Ebola virus siRNA sense strand
uacguuuuuuucggugagaau

SEQ ID NO: 15255 - RNA, 21 nt, Artificial Sequence
  Ebola virus siRNA sense strand
acguuuuuuucggugagaauc

SEQ ID NO: 15256 - RNA, 21 nt, Artificial Sequence
  Ebola virus siRNA sense strand
cguuuuuuucggugagaaucu

SEQ ID NO: 15257 - RNA, 21 nt, Artificial Sequence
  Ebola virus siRNA sense strand
guuuuuuucggugagaaucuu

SEQ ID NO: 15258 - RNA, 21 nt, Artificial Sequence
  Ebola virus siRNA sense strand
uuuuuuucggugagaaucuug

SEQ ID NO: 15259 - RNA, 21 nt, Artificial Sequence
  Ebola virus siRNA sense strand
uuuuuucggugagaaucuugc

SEQ ID NO: 15260 - RNA, 21 nt, Artificial Sequence
  Ebola virus siRNA sense strand
uuuuucggugagaaucuugca

SEQ ID NO: 15261 - RNA, 21 nt, Artificial Sequence
  Ebola virus siRNA sense strand
uuuucggugagaaucuugcaa

SEQ ID NO: 15262 - RNA, 21 nt, Artificial Sequence
  Ebola virus siRNA sense strand
uuucggugagaaucuugcaau

SEQ ID NO: 15263 - RNA, 21 nt, Artificial Sequence
  Ebola virus siRNA sense strand
uucggugagaaucuugcaaua

SEQ ID NO: 15264 - RNA, 21 nt, Artificial Sequence
  Ebola virus siRNA sense strand
ucggugagaaucuugcaauau

SEQ ID NO: 15265 - RNA, 21 nt, Artificial Sequence
  Ebola virus siRNA sense strand
cggugagaaucuugcaauauc

SEQ ID NO: 15266 - RNA, 21 nt, Artificial Sequence
  Ebola virus siRNA sense strand
ggugagaaucuugcaauauca

SEQ ID NO: 15267 - RNA, 21 nt, Artificial Sequence
  Ebola virus siRNA sense strand
gugagaaucuugcaauaucau

SEQ ID NO: 15268 - RNA, 21 nt, Artificial Sequence
  Ebola virus siRNA sense strand
ugagaaucuugcaauaucauc

SEQ ID NO: 15269 - RNA, 21 nt, Artificial Sequence
  Ebola virus siRNA sense strand
gagaaucuugcaauaucauca

SEQ ID NO: 15270 - RNA, 21 nt, Artificial Sequence
  Ebola virus siRNA sense strand
agaaucuugcaauaucaucau

SEQ ID NO: 15271 - RNA, 21 nt, Artificial Sequence
  Ebola virus siRNA sense strand
gaaucuugcaauaucaucauc

SEQ ID NO: 15272 - RNA, 21 nt, Artificial Sequence
  Ebola virus siRNA sense strand
aaucuugcaauaucaucaucu

SEQ ID NO: 15273 - RNA, 21 nt, Artificial Sequence
  Ebola virus siRNA sense strand
aucuugcaauaucaucaucuc

SEQ ID NO: 15274 - RNA, 21 nt, Artificial Sequence
  Ebola virus siRNA sense strand
ucuugcaauaucaucaucucg

SEQ ID NO: 15275 - RNA, 21 nt, Artificial Sequence
  Ebola virus siRNA sense strand
cuugcaauaucaucaucucgg

SEQ ID NO: 15276 - RNA, 21 nt, Artificial Sequence
  Ebola virus siRNA sense strand
uugcaauaucaucaucucggg

SEQ ID NO: 15277 - RNA, 21 nt, Artificial Sequence
  Ebola virus siRNA sense strand
ugcaauaucaucaucucgggu

SEQ ID NO: 15278 - RNA, 21 nt, Artificial Sequence
  Ebola virus siRNA sense strand
gcaauaucaucaucucggguu

SEQ ID NO: 15279 - RNA, 21 nt, Artificial Sequence
  Ebola virus siRNA sense strand
caauaucaucaucucggguuc

SEQ ID NO: 15280 - RNA, 21 nt, Artificial Sequence
  Ebola virus siRNA sense strand
aauaucaucaucucggguuca

SEQ ID NO: 15281 - RNA, 21 nt, Artificial Sequence
  Ebola virus siRNA sense strand
auaucaucaucucggguucaa

SEQ ID NO: 15282 - RNA, 21 nt, Artificial Sequence
  Ebola virus siRNA sense strand
uaucaucaucucggguucaau

SEQ ID NO: 15283 - RNA, 21 nt, Artificial Sequence
  Ebola virus siRNA sense strand
aucaucaucucggguucaaua

SEQ ID NO: 15284 - RNA, 21 nt, Artificial Sequence
  Ebola virus siRNA sense strand
ucaucaucucggguucaauaa

SEQ ID NO: 15285 - RNA, 21 nt, Artificial Sequence
  Ebola virus siRNA sense strand
caucaucucggguucaauaaa

SEQ ID NO: 15286 - RNA, 21 nt, Artificial Sequence
  Ebola virus siRNA sense strand
aucaucucggguucaauaaag

SEQ ID NO: 15287 - RNA, 21 nt, Artificial Sequence
  Ebola virus siRNA sense strand
ucaucucggguucaauaaagg

SEQ ID NO: 15288 - RNA, 21 nt, Artificial Sequence
  Ebola virus siRNA sense strand
caucucggguucaauaaaggu

SEQ ID NO: 15289 - RNA, 21 nt, Artificial Sequence
  Ebola virus siRNA sense strand
aucucggguucaauaaagguu

SEQ ID NO: 15290 - RNA, 21 nt, Artificial Sequence
  Ebola virus siRNA sense strand
ucucggguucaauaaagguuu

SEQ ID NO: 15291 - RNA, 21 nt, Artificial Sequence
  Ebola virus siRNA sense strand
cucggguucaauaaagguuuu

SEQ ID NO: 15292 - RNA, 21 nt, Artificial Sequence
  Ebola virus siRNA sense strand
ucggguucaauaaagguuuug

SEQ ID NO: 15293 - RNA, 21 nt, Artificial Sequence
  Ebola virus siRNA sense strand
cggguucaauaaagguuuuga

SEQ ID NO: 15294 - RNA, 21 nt, Artificial Sequence
  Ebola virus siRNA sense strand
ggguucaauaaagguuuugac

SEQ ID NO: 15295 - RNA, 21 nt, Artificial Sequence
  Ebola virus siRNA sense strand
gguucaauaaagguuuugacc

SEQ ID NO: 15296 - RNA, 21 nt, Artificial Sequence
  Ebola virus siRNA sense strand
guucaauaaagguuuugaccu

SEQ ID NO: 15297 - RNA, 21 nt, Artificial Sequence
  Ebola virus siRNA sense strand
uucaauaaagguuuugaccuu

SEQ ID NO: 15298 - RNA, 21 nt, Artificial Sequence
  Ebola virus siRNA sense strand
ucaauaaagguuuugaccuug

SEQ ID NO: 15299 - RNA, 21 nt, Artificial Sequence
  Ebola virus siRNA sense strand
caauaaagguuuugaccuugg

SEQ ID NO: 15300 - RNA, 21 nt, Artificial Sequence
  Ebola virus siRNA sense strand
aauaaagguuuugaccuugga

SEQ ID NO: 15301 - RNA, 21 nt, Artificial Sequence
  Ebola virus siRNA sense strand
auaaagguuuugaccuuggac

SEQ ID NO: 15302 - RNA, 21 nt, Artificial Sequence
  Ebola virus siRNA sense strand
uaaagguuuugaccuuggaca

SEQ ID NO: 15303 - RNA, 21 nt, Artificial Sequence
  Ebola virus siRNA sense strand
aaagguuuugaccuuggacag

SEQ ID NO: 15304 - RNA, 21 nt, Artificial Sequence
  Ebola virus siRNA sense strand
aagguuuugaccuuggacagu

SEQ ID NO: 15305 - RNA, 21 nt, Artificial Sequence
  Ebola virus siRNA sense strand
agguuuugaccuuggacaguu

SEQ ID NO: 15306 - RNA, 21 nt, Artificial Sequence
  Ebola virus siRNA sense strand
gguuuugaccuuggacaguua

SEQ ID NO: 15307 - RNA, 21 nt, Artificial Sequence
  Ebola virus siRNA sense strand
guuuugaccuuggacaguuaa

SEQ ID NO: 15308 - RNA, 21 nt, Artificial Sequence
  Ebola virus siRNA sense strand
uuuugaccuuggacaguuaac

SEQ ID NO: 15309 - RNA, 21 nt, Artificial Sequence
  Ebola virus siRNA sense strand
uuugaccuuggacaguuaaca

SEQ ID NO: 15310 - RNA, 21 nt, Artificial Sequence
  Ebola virus siRNA sense strand
uugaccuuggacaguuaacac

SEQ ID NO: 15311 - RNA, 21 nt, Artificial Sequence
  Ebola virus siRNA sense strand
ugaccuuggacaguuaacacu

SEQ ID NO: 15312 - RNA, 21 nt, Artificial Sequence
  Ebola virus siRNA sense strand
gaccuuggacaguuaacacuc

SEQ ID NO: 15313 - RNA, 21 nt, Artificial Sequence
  Ebola virus siRNA sense strand
accuuggacaguuaacacucg

SEQ ID NO: 15314 - RNA, 21 nt, Artificial Sequence
  Ebola virus siRNA sense strand
ccuuggacaguuaacacucgg

SEQ ID NO: 15315 - RNA, 21 nt, Artificial Sequence
  Ebola virus siRNA sense strand
cuuggacaguuaacacucggc

SEQ ID NO: 15316 - RNA, 21 nt, Artificial Sequence
  Ebola virus siRNA sense strand
uuggacaguuaacacucggca

SEQ ID NO: 15317 - RNA, 21 nt, Artificial Sequence
  Ebola virus siRNA sense strand
uggacaguuaacacucggcaa

SEQ ID NO: 15318 - RNA, 21 nt, Artificial Sequence
  Ebola virus siRNA sense strand
ggacaguuaacacucggcaaa

SEQ ID NO: 15319 - RNA, 21 nt, Artificial Sequence
  Ebola virus siRNA sense strand
gacaguuaacacucggcaaac

SEQ ID NO: 15320 - RNA, 21 nt, Artificial Sequence
  Ebola virus siRNA sense strand
acaguuaacacucggcaaacc

SEQ ID NO: 15321 - RNA, 21 nt, Artificial Sequence
  Ebola virus siRNA sense strand
caguuaacacucggcaaaccu

SEQ ID NO: 15322 - RNA, 21 nt, Artificial Sequence
  Ebola virus siRNA sense strand
aguuaacacucggcaaaccuc

SEQ ID NO: 15323 - RNA, 21 nt, Artificial Sequence
  Ebola virus siRNA sense strand
guuaacacucggcaaaccucu

SEQ ID NO: 15324 - RNA, 21 nt, Artificial Sequence
  Ebola virus siRNA sense strand
uuaacacucggcaaaccucug

SEQ ID NO: 15325 - RNA, 21 nt, Artificial Sequence
  Ebola virus siRNA sense strand
uaacacucggcaaaccucugg

SEQ ID NO: 15326 - RNA, 21 nt, Artificial Sequence
  Ebola virus siRNA sense strand
aacacucggcaaaccucugga

SEQ ID NO: 15327 - RNA, 21 nt, Artificial Sequence
  Ebola virus siRNA sense strand
acacucggcaaaccucuggau

SEQ ID NO: 15328 - RNA, 21 nt, Artificial Sequence
  Ebola virus siRNA sense strand
cacucggcaaaccucuggauu

SEQ ID NO: 15329 - RNA, 21 nt, Artificial Sequence
  Ebola virus siRNA sense strand
acucggcaaaccucuggauuu

SEQ ID NO: 15330 - RNA, 21 nt, Artificial Sequence
  Ebola virus siRNA sense strand
cucggcaaaccucuggauuuc

SEQ ID NO: 15331 - RNA, 21 nt, Artificial Sequence
  Ebola virus siRNA sense strand
ucggcaaaccucuggauuucg

SEQ ID NO: 15332 - RNA, 21 nt, Artificial Sequence
  Ebola virus siRNA sense strand
cggcaaaccucuggauuucgg

SEQ ID NO: 15333 - RNA, 21 nt, Artificial Sequence
  Ebola virus siRNA sense strand
ggcaaaccucuggauuucgga

SEQ ID NO: 15334 - RNA, 21 nt, Artificial Sequence
  Ebola virus siRNA sense strand
gcaaaccucuggauuucggaa

SEQ ID NO: 15335 - RNA, 21 nt, Artificial Sequence
  Ebola virus siRNA sense strand
caaaccucuggauuucggaac

SEQ ID NO: 15336 - RNA, 21 nt, Artificial Sequence
  Ebola virus siRNA sense strand
aaaccucuggauuucggaaca

SEQ ID NO: 15337 - RNA, 21 nt, Artificial Sequence
  Ebola virus siRNA sense strand
aaccucuggauuucggaacaa

SEQ ID NO: 15338 - RNA, 21 nt, Artificial Sequence
  Ebola virus siRNA sense strand
accucuggauuucggaacaau

SEQ ID NO: 15339 - RNA, 21 nt, Artificial Sequence
  Ebola virus siRNA sense strand
ccucuggauuucggaacaaua

SEQ ID NO: 15340 - RNA, 21 nt, Artificial Sequence
  Ebola virus siRNA sense strand
cucuggauuucggaacaauau

SEQ ID NO: 15341 - RNA, 21 nt, Artificial Sequence
  Ebola virus siRNA sense strand
ucuggauuucggaacaauauc

SEQ ID NO: 15342 - RNA, 21 nt, Artificial Sequence
  Ebola virus siRNA sense strand
cuggauuucggaacaauauca

SEQ ID NO: 15343 - RNA, 21 nt, Artificial Sequence
  Ebola virus siRNA sense strand
uggauuucggaacaauaucau

SEQ ID NO: 15344 - RNA, 21 nt, Artificial Sequence
  Ebola virus siRNA sense strand
ggauuucggaacaauaucauu

SEQ ID NO: 15345 - RNA, 21 nt, Artificial Sequence
  Ebola virus siRNA sense strand
gauuucggaacaauaucauug

SEQ ID NO: 15346 - RNA, 21 nt, Artificial Sequence
  Ebola virus siRNA sense strand
auuucggaacaauaucauugg

SEQ ID NO: 15347 - RNA, 21 nt, Artificial Sequence
  Ebola virus siRNA sense strand
uuucggaacaauaucauuggc

SEQ ID NO: 15348 - RNA, 21 nt, Artificial Sequence
  Ebola virus siRNA sense strand
uucggaacaauaucauuggca

SEQ ID NO: 15349 - RNA, 21 nt, Artificial Sequence
  Ebola virus siRNA sense strand
ucggaacaauaucauuggcac

SEQ ID NO: 15350 - RNA, 21 nt, Artificial Sequence
  Ebola virus siRNA sense strand
cggaacaauaucauuggcacu

SEQ ID NO: 15351 - RNA, 21 nt, Artificial Sequence
  Ebola virus siRNA sense strand
ggaacaauaucauuggcacua

SEQ ID NO: 15352 - RNA, 21 nt, Artificial Sequence
  Ebola virus siRNA sense strand
gaacaauaucauuggcacuag

SEQ ID NO: 15353 - RNA, 21 nt, Artificial Sequence
  Ebola virus siRNA sense strand
aacaauaucauuggcacuagc

SEQ ID NO: 15354 - RNA, 21 nt, Artificial Sequence
  Ebola virus siRNA sense strand
acaauaucauuggcacuagcg

SEQ ID NO: 15355 - RNA, 21 nt, Artificial Sequence
  Ebola virus siRNA sense strand
caauaucauuggcacuagcgg

SEQ ID NO: 15356 - RNA, 21 nt, Artificial Sequence
  Ebola virus siRNA sense strand
aauaucauuggcacuagcggu

SEQ ID NO: 15357 - RNA, 21 nt, Artificial Sequence
  Ebola virus siRNA sense strand
auaucauuggcacuagcggua

SEQ ID NO: 15358 - RNA, 21 nt, Artificial Sequence
  Ebola virus siRNA sense strand
uaucauuggcacuagcgguac

SEQ ID NO: 15359 - RNA, 21 nt, Artificial Sequence
  Ebola virus siRNA sense strand
aucauuggcacuagcgguacc

SEQ ID NO: 15360 - RNA, 21 nt, Artificial Sequence
  Ebola virus siRNA sense strand
ucauuggcacuagcgguaccg

SEQ ID NO: 15361 - RNA, 21 nt, Artificial Sequence
  Ebola virus siRNA sense strand
cauuggcacuagcgguaccgc

SEQ ID NO: 15362 - RNA, 21 nt, Artificial Sequence
  Ebola virus siRNA sense strand
auuggcacuagcgguaccgca

SEQ ID NO: 15363 - RNA, 21 nt, Artificial Sequence
  Ebola virus siRNA sense strand
uuggcacuagcgguaccgcag

SEQ ID NO: 15364 - RNA, 21 nt, Artificial Sequence
  Ebola virus siRNA sense strand
uggcacuagcgguaccgcagg

SEQ ID NO: 15365 - RNA, 21 nt, Artificial Sequence
  Ebola virus siRNA sense strand
ggcacuagcgguaccgcaggu

SEQ ID NO: 15366 - RNA, 21 nt, Artificial Sequence
  Ebola virus siRNA sense strand
gcacuagcgguaccgcaggug

SEQ ID NO: 15367 - RNA, 21 nt, Artificial Sequence
  Ebola virus siRNA sense strand
cacuagcgguaccgcaggugc

SEQ ID NO: 15368 - RNA, 21 nt, Artificial Sequence
  Ebola virus siRNA sense strand
acuagcgguaccgcaggugcu

SEQ ID NO: 15369 - RNA, 21 nt, Artificial Sequence
  Ebola virus siRNA sense strand
cuagcgguaccgcaggugcuu

SEQ ID NO: 15370 - RNA, 21 nt, Artificial Sequence
  Ebola virus siRNA sense strand
uagcgguaccgcaggugcuug

SEQ ID NO: 15371 - RNA, 21 nt, Artificial Sequence
  Ebola virus siRNA sense strand
agcgguaccgcaggugcuugg

SEQ ID NO: 15372 - RNA, 21 nt, Artificial Sequence
  Ebola virus siRNA sense strand
gcgguaccgcaggugcuugga

SEQ ID NO: 15373 - RNA, 21 nt, Artificial Sequence
  Ebola virus siRNA sense strand
cgguaccgcaggugcuuggag

SEQ ID NO: 15374 - RNA, 21 nt, Artificial Sequence
  Ebola virus siRNA sense strand
gguaccgcaggugcuuggagg

SEQ ID NO: 15375 - RNA, 21 nt, Artificial Sequence
  Ebola virus siRNA sense strand
guaccgcaggugcuuggaggg

SEQ ID NO: 15376 - RNA, 21 nt, Artificial Sequence
  Ebola virus siRNA sense strand
uaccgcaggugcuuggagggu

SEQ ID NO: 15377 - RNA, 21 nt, Artificial Sequence
  Ebola virus siRNA sense strand
accgcaggugcuuggaggguu

SEQ ID NO: 15378 - RNA, 21 nt, Artificial Sequence
  Ebola virus siRNA sense strand
ccgcaggugcuuggaggguua

SEQ ID NO: 15379 - RNA, 21 nt, Artificial Sequence
  Ebola virus siRNA sense strand
cgcaggugcuuggaggguuau

SEQ ID NO: 15380 - RNA, 21 nt, Artificial Sequence
  Ebola virus siRNA sense strand
gcaggugcuuggaggguuauc

SEQ ID NO: 15381 - RNA, 21 nt, Artificial Sequence
  Ebola virus siRNA sense strand
caggugcuuggaggguuaucc

SEQ ID NO: 15382 - RNA, 21 nt, Artificial Sequence
  Ebola virus siRNA sense strand
aggugcuuggaggguuauccu

SEQ ID NO: 15383 - RNA, 21 nt, Artificial Sequence
  Ebola virus siRNA sense strand
ggugcuuggaggguuauccuu

SEQ ID NO: 15384 - RNA, 21 nt, Artificial Sequence
  Ebola virus siRNA sense strand
gugcuuggaggguuauccuuc

SEQ ID NO: 15385 - RNA, 21 nt, Artificial Sequence
  Ebola virus siRNA sense strand
ugcuuggaggguuauccuucu

SEQ ID NO: 15386 - RNA, 21 nt, Artificial Sequence
  Ebola virus siRNA sense strand
gcuuggaggguuauccuucuu

SEQ ID NO: 15387 - RNA, 21 nt, Artificial Sequence
  Ebola virus siRNA sense strand
cuuggaggguuauccuucuug

SEQ ID NO: 15388 - RNA, 21 nt, Artificial Sequence
  Ebola virus siRNA sense strand
uuggaggguuauccuucuuga

SEQ ID NO: 15389 - RNA, 21 nt, Artificial Sequence
  Ebola virus siRNA sense strand
uggaggguuauccuucuugaa

SEQ ID NO: 15390 - RNA, 21 nt, Artificial Sequence
  Ebola virus siRNA sense strand
ggaggguuauccuucuugaau

SEQ ID NO: 15391 - RNA, 21 nt, Artificial Sequence
  Ebola virus siRNA sense strand
gaggguuauccuucuugaauc

SEQ ID NO: 15392 - RNA, 21 nt, Artificial Sequence
  Ebola virus siRNA sense strand
aggguuauccuucuugaaucc

SEQ ID NO: 15393 - RNA, 21 nt, Artificial Sequence
  Ebola virus siRNA sense strand
ggguuauccuucuugaauccu

SEQ ID NO: 15394 - RNA, 21 nt, Artificial Sequence
  Ebola virus siRNA sense strand
gguuauccuucuugaauccug

SEQ ID NO: 15395 - RNA, 21 nt, Artificial Sequence
  Ebola virus siRNA sense strand
guuauccuucuugaauccuga

SEQ ID NO: 15396 - RNA, 21 nt, Artificial Sequence
  Ebola virus siRNA sense strand
uuauccuucuugaauccugag

SEQ ID NO: 15397 - RNA, 21 nt, Artificial Sequence
  Ebola virus siRNA sense strand
uauccuucuugaauccugaga

SEQ ID NO: 15398 - RNA, 21 nt, Artificial Sequence
  Ebola virus siRNA sense strand
auccuucuugaauccugagaa

SEQ ID NO: 15399 - RNA, 21 nt, Artificial Sequence
  Ebola virus siRNA sense strand
uccuucuugaauccugagaaa

SEQ ID NO: 15400 - RNA, 21 nt, Artificial Sequence
  Ebola virus siRNA sense strand
ccuucuugaauccugagaaau

SEQ ID NO: 15401 - RNA, 21 nt, Artificial Sequence
  Ebola virus siRNA sense strand
cuucuugaauccugagaaaug

SEQ ID NO: 15402 - RNA, 21 nt, Artificial Sequence
  Ebola virus siRNA sense strand
uucuugaauccugagaaaugu

SEQ ID NO: 15403 - RNA, 21 nt, Artificial Sequence
  Ebola virus siRNA sense strand
ucuugaauccugagaaauguu

SEQ ID NO: 15404 - RNA, 21 nt, Artificial Sequence
  Ebola virus siRNA sense strand
cuugaauccugagaaauguuu

SEQ ID NO: 15405 - RNA, 21 nt, Artificial Sequence
  Ebola virus siRNA sense strand
uugaauccugagaaauguuuc

SEQ ID NO: 15406 - RNA, 21 nt, Artificial Sequence
  Ebola virus siRNA sense strand
ugaauccugagaaauguuucu

SEQ ID NO: 15407 - RNA, 21 nt, Artificial Sequence
  Ebola virus siRNA sense strand
gaauccugagaaauguuucua

SEQ ID NO: 15408 - RNA, 21 nt, Artificial Sequence
  Ebola virus siRNA sense strand
aauccugagaaauguuucuac

SEQ ID NO: 15409 - RNA, 21 nt, Artificial Sequence
  Ebola virus siRNA sense strand
auccugagaaauguuucuacc

SEQ ID NO: 15410 - RNA, 21 nt, Artificial Sequence
  Ebola virus siRNA sense strand
uccugagaaauguuucuaccg

SEQ ID NO: 15411 - RNA, 21 nt, Artificial Sequence
  Ebola virus siRNA sense strand
ccugagaaauguuucuaccgg

SEQ ID NO: 15412 - RNA, 21 nt, Artificial Sequence
  Ebola virus siRNA sense strand
cugagaaauguuucuaccgga

SEQ ID NO: 15413 - RNA, 21 nt, Artificial Sequence
  Ebola virus siRNA sense strand
ugagaaauguuucuaccggaa

SEQ ID NO: 15414 - RNA, 21 nt, Artificial Sequence
  Ebola virus siRNA sense strand
gagaaauguuucuaccggaau

SEQ ID NO: 15415 - RNA, 21 nt, Artificial Sequence
  Ebola virus siRNA sense strand
agaaauguuucuaccggaauc

SEQ ID NO: 15416 - RNA, 21 nt, Artificial Sequence
  Ebola virus siRNA sense strand
gaaauguuucuaccggaaucu

SEQ ID NO: 15417 - RNA, 21 nt, Artificial Sequence
  Ebola virus siRNA sense strand
aaauguuucuaccggaaucua

SEQ ID NO: 15418 - RNA, 21 nt, Artificial Sequence
  Ebola virus siRNA sense strand
aauguuucuaccggaaucuag

SEQ ID NO: 15419 - RNA, 21 nt, Artificial Sequence
  Ebola virus siRNA sense strand
auguuucuaccggaaucuagg

SEQ ID NO: 15420 - RNA, 21 nt, Artificial Sequence
  Ebola virus siRNA sense strand
uguuucuaccggaaucuagga

SEQ ID NO: 15421 - RNA, 21 nt, Artificial Sequence
  Ebola virus siRNA sense strand
guuucuaccggaaucuaggag

SEQ ID NO: 15422 - RNA, 21 nt, Artificial Sequence
  Ebola virus siRNA sense strand
uuucuaccggaaucuaggaga

SEQ ID NO: 15423 - RNA, 21 nt, Artificial Sequence
  Ebola virus siRNA sense strand
uucuaccggaaucuaggagau

SEQ ID NO: 15424 - RNA, 21 nt, Artificial Sequence
  Ebola virus siRNA sense strand
ucuaccggaaucuaggagauc

SEQ ID NO: 15425 - RNA, 21 nt, Artificial Sequence
  Ebola virus siRNA sense strand
cuaccggaaucuaggagaucc

SEQ ID NO: 15426 - RNA, 21 nt, Artificial Sequence
  Ebola virus siRNA sense strand
uaccggaaucuaggagaucca

SEQ ID NO: 15427 - RNA, 21 nt, Artificial Sequence
  Ebola virus siRNA sense strand
accggaaucuaggagauccag

SEQ ID NO: 15428 - RNA, 21 nt, Artificial Sequence
  Ebola virus siRNA sense strand
ccggaaucuaggagauccagu

SEQ ID NO: 15429 - RNA, 21 nt, Artificial Sequence
  Ebola virus siRNA sense strand
cggaaucuaggagauccaguu

SEQ ID NO: 15430 - RNA, 21 nt, Artificial Sequence
  Ebola virus siRNA sense strand
ggaaucuaggagauccaguua

SEQ ID NO: 15431 - RNA, 21 nt, Artificial Sequence
  Ebola virus siRNA sense strand
gaaucuaggagauccaguuac

SEQ ID NO: 15432 - RNA, 21 nt, Artificial Sequence
  Ebola virus siRNA sense strand
aaucuaggagauccaguuacc

SEQ ID NO: 15433 - RNA, 21 nt, Artificial Sequence
  Ebola virus siRNA sense strand
aucuaggagauccaguuaccu

SEQ ID NO: 15434 - RNA, 21 nt, Artificial Sequence
  Ebola virus siRNA sense strand
ucuaggagauccaguuaccuc

SEQ ID NO: 15435 - RNA, 21 nt, Artificial Sequence
  Ebola virus siRNA sense strand
cuaggagauccaguuaccuca

SEQ ID NO: 15436 - RNA, 21 nt, Artificial Sequence
  Ebola virus siRNA sense strand
uaggagauccaguuaccucag

SEQ ID NO: 15437 - RNA, 21 nt, Artificial Sequence
  Ebola virus siRNA sense strand
aggagauccaguuaccucagg

SEQ ID NO: 15438 - RNA, 21 nt, Artificial Sequence
  Ebola virus siRNA sense strand
ggagauccaguuaccucaggc

SEQ ID NO: 15439 - RNA, 21 nt, Artificial Sequence
  Ebola virus siRNA sense strand
gagauccaguuaccucaggcu

SEQ ID NO: 15440 - RNA, 21 nt, Artificial Sequence
  Ebola virus siRNA sense strand
agauccaguuaccucaggcuu

SEQ ID NO: 15441 - RNA, 21 nt, Artificial Sequence
  Ebola virus siRNA sense strand
gauccaguuaccucaggcuua

SEQ ID NO: 15442 - RNA, 21 nt, Artificial Sequence
  Ebola virus siRNA sense strand
auccaguuaccucaggcuuau

SEQ ID NO: 15443 - RNA, 21 nt, Artificial Sequence
  Ebola virus siRNA sense strand
uccaguuaccucaggcuuauu

SEQ ID NO: 15444 - RNA, 21 nt, Artificial Sequence
  Ebola virus siRNA sense strand
ccaguuaccucaggcuuauuc

SEQ ID NO: 15445 - RNA, 21 nt, Artificial Sequence
  Ebola virus siRNA sense strand
caguuaccucaggcuuauucc

SEQ ID NO: 15446 - RNA, 21 nt, Artificial Sequence
  Ebola virus siRNA sense strand
aguuaccucaggcuuauucca

SEQ ID NO: 15447 - RNA, 21 nt, Artificial Sequence
  Ebola virus siRNA sense strand
guuaccucaggcuuauuccag

SEQ ID NO: 15448 - RNA, 21 nt, Artificial Sequence
  Ebola virus siRNA sense strand
uuaccucaggcuuauuccagu

SEQ ID NO: 15449 - RNA, 21 nt, Artificial Sequence
  Ebola virus siRNA sense strand
uaccucaggcuuauuccaguu

SEQ ID NO: 15450 - RNA, 21 nt, Artificial Sequence
  Ebola virus siRNA sense strand
accucaggcuuauuccaguua

SEQ ID NO: 15451 - RNA, 21 nt, Artificial Sequence
  Ebola virus siRNA sense strand
ccucaggcuuauuccaguuaa

SEQ ID NO: 15452 - RNA, 21 nt, Artificial Sequence
  Ebola virus siRNA sense strand
cucaggcuuauuccaguuaaa

SEQ ID NO: 15453 - RNA, 21 nt, Artificial Sequence
  Ebola virus siRNA sense strand
ucaggcuuauuccaguuaaaa

SEQ ID NO: 15454 - RNA, 21 nt, Artificial Sequence
  Ebola virus siRNA sense strand
caggcuuauuccaguuaaaaa

SEQ ID NO: 15455 - RNA, 21 nt, Artificial Sequence
  Ebola virus siRNA sense strand
aggcuuauuccaguuaaaaac

SEQ ID NO: 15456 - RNA, 21 nt, Artificial Sequence
  Ebola virus siRNA sense strand
ggcuuauuccaguuaaaaacu

SEQ ID NO: 15457 - RNA, 21 nt, Artificial Sequence
  Ebola virus siRNA sense strand
gcuuauuccaguuaaaaacuu

SEQ ID NO: 15458 - RNA, 21 nt, Artificial Sequence
  Ebola virus siRNA sense strand
cuuauuccaguuaaaaacuua

SEQ ID NO: 15459 - RNA, 21 nt, Artificial Sequence
  Ebola virus siRNA sense strand
uuauuccaguuaaaaacuuau

SEQ ID NO: 15460 - RNA, 21 nt, Artificial Sequence
  Ebola virus siRNA sense strand
uauuccaguuaaaaacuuauc

SEQ ID NO: 15461 - RNA, 21 nt, Artificial Sequence
  Ebola virus siRNA sense strand
auuccaguuaaaaacuuaucu

SEQ ID NO: 15462 - RNA, 21 nt, Artificial Sequence
  Ebola virus siRNA sense strand
uuccaguuaaaaacuuaucuc

SEQ ID NO: 15463 - RNA, 21 nt, Artificial Sequence
  Ebola virus siRNA sense strand
uccaguuaaaaacuuaucucc

SEQ ID NO: 15464 - RNA, 21 nt, Artificial Sequence
  Ebola virus siRNA sense strand
ccaguuaaaaacuuaucuccg

SEQ ID NO: 15465 - RNA, 21 nt, Artificial Sequence
  Ebola virus siRNA sense strand
caguuaaaaacuuaucuccga

SEQ ID NO: 15466 - RNA, 21 nt, Artificial Sequence
  Ebola virus siRNA sense strand
aguuaaaaacuuaucuccgaa

SEQ ID NO: 15467 - RNA, 21 nt, Artificial Sequence
  Ebola virus siRNA sense strand
guuaaaaacuuaucuccgaau

SEQ ID NO: 15468 - RNA, 21 nt, Artificial Sequence
  Ebola virus siRNA sense strand
uuaaaaacuuaucuccgaaug

SEQ ID NO: 15469 - RNA, 21 nt, Artificial Sequence
  Ebola virus siRNA sense strand
uaaaaacuuaucuccgaauga

SEQ ID NO: 15470 - RNA, 21 nt, Artificial Sequence
  Ebola virus siRNA sense strand
aaaaacuuaucuccgaaugau

SEQ ID NO: 15471 - RNA, 21 nt, Artificial Sequence
  Ebola virus siRNA sense strand
aaaacuuaucuccgaaugauu

SEQ ID NO: 15472 - RNA, 21 nt, Artificial Sequence
  Ebola virus siRNA sense strand
aaacuuaucuccgaaugauug

SEQ ID NO: 15473 - RNA, 21 nt, Artificial Sequence
  Ebola virus siRNA sense strand
aacuuaucuccgaaugauuga

SEQ ID NO: 15474 - RNA, 21 nt, Artificial Sequence
  Ebola virus siRNA sense strand
acuuaucuccgaaugauugag

SEQ ID NO: 15475 - RNA, 21 nt, Artificial Sequence
  Ebola virus siRNA sense strand
cuuaucuccgaaugauugaga

SEQ ID NO: 15476 - RNA, 21 nt, Artificial Sequence
  Ebola virus siRNA sense strand
uuaucuccgaaugauugagau

SEQ ID NO: 15477 - RNA, 21 nt, Artificial Sequence
  Ebola virus siRNA sense strand
uaucuccgaaugauugagaug

SEQ ID NO: 15478 - RNA, 21 nt, Artificial Sequence
  Ebola virus siRNA sense strand
aucuccgaaugauugagaugg

SEQ ID NO: 15479 - RNA, 21 nt, Artificial Sequence
  Ebola virus siRNA sense strand
ucuccgaaugauugagaugga

SEQ ID NO: 15480 - RNA, 21 nt, Artificial Sequence
  Ebola virus siRNA sense strand
cuccgaaugauugagauggau

SEQ ID NO: 15481 - RNA, 21 nt, Artificial Sequence
  Ebola virus siRNA sense strand
uccgaaugauugagauggaug

SEQ ID NO: 15482 - RNA, 21 nt, Artificial Sequence
  Ebola virus siRNA sense strand
ccgaaugauugagauggauga

SEQ ID NO: 15483 - RNA, 21 nt, Artificial Sequence
  Ebola virus siRNA sense strand
cgaaugauugagauggaugau

SEQ ID NO: 15484 - RNA, 21 nt, Artificial Sequence
  Ebola virus siRNA sense strand
gaaugauugagauggaugauu

SEQ ID NO: 15485 - RNA, 21 nt, Artificial Sequence
  Ebola virus siRNA sense strand
aaugauugagauggaugauuu

SEQ ID NO: 15486 - RNA, 21 nt, Artificial Sequence
  Ebola virus siRNA sense strand
augauugagauggaugauuua

SEQ ID NO: 15487 - RNA, 21 nt, Artificial Sequence
  Ebola virus siRNA sense strand
ugauugagauggaugauuuau

SEQ ID NO: 15488 - RNA, 21 nt, Artificial Sequence
  Ebola virus siRNA sense strand
gauugagauggaugauuuauu

SEQ ID NO: 15489 - RNA, 21 nt, Artificial Sequence
  Ebola virus siRNA sense strand
auugagauggaugauuuauuc

SEQ ID NO: 15490 - RNA, 21 nt, Artificial Sequence
  Ebola virus siRNA sense strand
uugagauggaugauuuauucu

SEQ ID NO: 15491 - RNA, 21 nt, Artificial Sequence
  Ebola virus siRNA sense strand
ugagauggaugauuuauucuu

SEQ ID NO: 15492 - RNA, 21 nt, Artificial Sequence
  Ebola virus siRNA sense strand
gagauggaugauuuauucuua

SEQ ID NO: 15493 - RNA, 21 nt, Artificial Sequence
  Ebola virus siRNA sense strand
agauggaugauuuauucuuac

SEQ ID NO: 15494 - RNA, 21 nt, Artificial Sequence
  Ebola virus siRNA sense strand
gauggaugauuuauucuuacc

SEQ ID NO: 15495 - RNA, 21 nt, Artificial Sequence
  Ebola virus siRNA sense strand
auggaugauuuauucuuaccu

SEQ ID NO: 15496 - RNA, 21 nt, Artificial Sequence
  Ebola virus siRNA sense strand
uggaugauuuauucuuaccuu

SEQ ID NO: 15497 - RNA, 21 nt, Artificial Sequence
  Ebola virus siRNA sense strand
ggaugauuuauucuuaccuuu

SEQ ID NO: 15498 - RNA, 21 nt, Artificial Sequence
  Ebola virus siRNA sense strand
gaugauuuauucuuaccuuua

SEQ ID NO: 15499 - RNA, 21 nt, Artificial Sequence
  Ebola virus siRNA sense strand
augauuuauucuuaccuuuaa

SEQ ID NO: 15500 - RNA, 21 nt, Artificial Sequence
  Ebola virus siRNA sense strand
ugauuuauucuuaccuuuaau

SEQ ID NO: 15501 - RNA, 21 nt, Artificial Sequence
  Ebola virus siRNA sense strand
gauuuauucuuaccuuuaauu

SEQ ID NO: 15502 - RNA, 21 nt, Artificial Sequence
  Ebola virus siRNA sense strand
auuuauucuuaccuuuaauug

SEQ ID NO: 15503 - RNA, 21 nt, Artificial Sequence
  Ebola virus siRNA sense strand
uuuauucuuaccuuuaauugc

SEQ ID NO: 15504 - RNA, 21 nt, Artificial Sequence
  Ebola virus siRNA sense strand
uuauucuuaccuuuaauugcg

SEQ ID NO: 15505 - RNA, 21 nt, Artificial Sequence
  Ebola virus siRNA sense strand
uauucuuaccuuuaauugcga

SEQ ID NO: 15506 - RNA, 21 nt, Artificial Sequence
  Ebola virus siRNA sense strand
auucuuaccuuuaauugcgaa

SEQ ID NO: 15507 - RNA, 21 nt, Artificial Sequence
  Ebola virus siRNA sense strand
uucuuaccuuuaauugcgaag

SEQ ID NO: 15508 - RNA, 21 nt, Artificial Sequence
  Ebola virus siRNA sense strand
ucuuaccuuuaauugcgaaga

SEQ ID NO: 15509 - RNA, 21 nt, Artificial Sequence
  Ebola virus siRNA sense strand
cuuaccuuuaauugcgaagaa

SEQ ID NO: 15510 - RNA, 21 nt, Artificial Sequence
  Ebola virus siRNA sense strand
uuaccuuuaauugcgaagaac

SEQ ID NO: 15511 - RNA, 21 nt, Artificial Sequence
  Ebola virus siRNA sense strand
uaccuuuaauugcgaagaacc

SEQ ID NO: 15512 - RNA, 21 nt, Artificial Sequence
  Ebola virus siRNA sense strand
accuuuaauugcgaagaaccc

SEQ ID NO: 15513 - RNA, 21 nt, Artificial Sequence
  Ebola virus siRNA sense strand
ccuuuaauugcgaagaacccu

SEQ ID NO: 15514 - RNA, 21 nt, Artificial Sequence
  Ebola virus siRNA sense strand
cuuuaauugcgaagaacccug

SEQ ID NO: 15515 - RNA, 21 nt, Artificial Sequence
  Ebola virus siRNA sense strand
uuuaauugcgaagaacccugg

SEQ ID NO: 15516 - RNA, 21 nt, Artificial Sequence
  Ebola virus siRNA sense strand
uuaauugcgaagaacccuggg

SEQ ID NO: 15517 - RNA, 21 nt, Artificial Sequence
  Ebola virus siRNA sense strand
uaauugcgaagaacccuggga

SEQ ID NO: 15518 - RNA, 21 nt, Artificial Sequence
  Ebola virus siRNA sense strand
aauugcgaagaacccugggaa

SEQ ID NO: 15519 - RNA, 21 nt, Artificial Sequence
  Ebola virus siRNA sense strand
auugcgaagaacccugggaac

SEQ ID NO: 15520 - RNA, 21 nt, Artificial Sequence
  Ebola virus siRNA sense strand
uugcgaagaacccugggaacu

SEQ ID NO: 15521 - RNA, 21 nt, Artificial Sequence
  Ebola virus siRNA sense strand
ugcgaagaacccugggaacug

SEQ ID NO: 15522 - RNA, 21 nt, Artificial Sequence
  Ebola virus siRNA sense strand
gcgaagaacccugggaacugc

SEQ ID NO: 15523 - RNA, 21 nt, Artificial Sequence
  Ebola virus siRNA sense strand
cgaagaacccugggaacugca

SEQ ID NO: 15524 - RNA, 21 nt, Artificial Sequence
  Ebola virus siRNA sense strand
gaagaacccugggaacugcac

SEQ ID NO: 15525 - RNA, 21 nt, Artificial Sequence
  Ebola virus siRNA sense strand
aagaacccugggaacugcacu

SEQ ID NO: 15526 - RNA, 21 nt, Artificial Sequence
  Ebola virus siRNA sense strand
agaacccugggaacugcacug

SEQ ID NO: 15527 - RNA, 21 nt, Artificial Sequence
  Ebola virus siRNA sense strand
gaacccugggaacugcacugc

SEQ ID NO: 15528 - RNA, 21 nt, Artificial Sequence
  Ebola virus siRNA sense strand
aacccugggaacugcacugcc

SEQ ID NO: 15529 - RNA, 21 nt, Artificial Sequence
  Ebola virus siRNA sense strand
acccugggaacugcacugcca

SEQ ID NO: 15530 - RNA, 21 nt, Artificial Sequence
  Ebola virus siRNA sense strand
cccugggaacugcacugccau

SEQ ID NO: 15531 - RNA, 21 nt, Artificial Sequence
  Ebola virus siRNA sense strand
ccugggaacugcacugccauu

SEQ ID NO: 15532 - RNA, 21 nt, Artificial Sequence
  Ebola virus siRNA sense strand
cugggaacugcacugccauug

SEQ ID NO: 15533 - RNA, 21 nt, Artificial Sequence
  Ebola virus siRNA sense strand
ugggaacugcacugccauuga

SEQ ID NO: 15534 - RNA, 21 nt, Artificial Sequence
  Ebola virus siRNA sense strand
gggaacugcacugccauugac

SEQ ID NO: 15535 - RNA, 21 nt, Artificial Sequence
  Ebola virus siRNA sense strand
ggaacugcacugccauugacu

SEQ ID NO: 15536 - RNA, 21 nt, Artificial Sequence
  Ebola virus siRNA sense strand
gaacugcacugccauugacuu

SEQ ID NO: 15537 - RNA, 21 nt, Artificial Sequence
  Ebola virus siRNA sense strand
aacugcacugccauugacuuu

SEQ ID NO: 15538 - RNA, 21 nt, Artificial Sequence
  Ebola virus siRNA sense strand
acugcacugccauugacuuug

SEQ ID NO: 15539 - RNA, 21 nt, Artificial Sequence
  Ebola virus siRNA sense strand
cugcacugccauugacuuugu

SEQ ID NO: 15540 - RNA, 21 nt, Artificial Sequence
  Ebola virus siRNA sense strand
ugcacugccauugacuuugug

SEQ ID NO: 15541 - RNA, 21 nt, Artificial Sequence
  Ebola virus siRNA sense strand
gcacugccauugacuuugugc

SEQ ID NO: 15542 - RNA, 21 nt, Artificial Sequence
  Ebola virus siRNA sense strand
cacugccauugacuuugugcu

SEQ ID NO: 15543 - RNA, 21 nt, Artificial Sequence
  Ebola virus siRNA sense strand
acugccauugacuuugugcua

SEQ ID NO: 15544 - RNA, 21 nt, Artificial Sequence
  Ebola virus siRNA sense strand
cugccauugacuuugugcuaa

SEQ ID NO: 15545 - RNA, 21 nt, Artificial Sequence
  Ebola virus siRNA sense strand
ugccauugacuuugugcuaaa

SEQ ID NO: 15546 - RNA, 21 nt, Artificial Sequence
  Ebola virus siRNA sense strand
gccauugacuuugugcuaaau

SEQ ID NO: 15547 - RNA, 21 nt, Artificial Sequence
  Ebola virus siRNA sense strand
ccauugacuuugugcuaaauc

SEQ ID NO: 15548 - RNA, 21 nt, Artificial Sequence
  Ebola virus siRNA sense strand
cauugacuuugugcuaaaucc

SEQ ID NO: 15549 - RNA, 21 nt, Artificial Sequence
  Ebola virus siRNA sense strand
auugacuuugugcuaaauccu

SEQ ID NO: 15550 - RNA, 21 nt, Artificial Sequence
  Ebola virus siRNA sense strand
uugacuuugugcuaaauccua

SEQ ID NO: 15551 - RNA, 21 nt, Artificial Sequence
  Ebola virus siRNA sense strand
ugacuuugugcuaaauccuag

SEQ ID NO: 15552 - RNA, 21 nt, Artificial Sequence
  Ebola virus siRNA sense strand
gacuuugugcuaaauccuagc

SEQ ID NO: 15553 - RNA, 21 nt, Artificial Sequence
  Ebola virus siRNA sense strand
acuuugugcuaaauccuagcg

SEQ ID NO: 15554 - RNA, 21 nt, Artificial Sequence
  Ebola virus siRNA sense strand
cuuugugcuaaauccuagcgg

SEQ ID NO: 15555 - RNA, 21 nt, Artificial Sequence
  Ebola virus siRNA sense strand
uuugugcuaaauccuagcgga

SEQ ID NO: 15556 - RNA, 21 nt, Artificial Sequence
  Ebola virus siRNA sense strand
uugugcuaaauccuagcggau

SEQ ID NO: 15557 - RNA, 21 nt, Artificial Sequence
  Ebola virus siRNA sense strand
ugugcuaaauccuagcggauu

SEQ ID NO: 15558 - RNA, 21 nt, Artificial Sequence
  Ebola virus siRNA sense strand
gugcuaaauccuagcggauua

SEQ ID NO: 15559 - RNA, 21 nt, Artificial Sequence
  Ebola virus siRNA sense strand
ugcuaaauccuagcggauuaa

SEQ ID NO: 15560 - RNA, 21 nt, Artificial Sequence
  Ebola virus siRNA sense strand
gcuaaauccuagcggauuaaa

SEQ ID NO: 15561 - RNA, 21 nt, Artificial Sequence
  Ebola virus siRNA sense strand
cuaaauccuagcggauuaaau

SEQ ID NO: 15562 - RNA, 21 nt, Artificial Sequence
  Ebola virus siRNA sense strand
uaaauccuagcggauuaaaug

SEQ ID NO: 15563 - RNA, 21 nt, Artificial Sequence
  Ebola virus siRNA sense strand
aaauccuagcggauuaaaugu

SEQ ID NO: 15564 - RNA, 21 nt, Artificial Sequence
  Ebola virus siRNA sense strand
aauccuagcggauuaaauguc

SEQ ID NO: 15565 - RNA, 21 nt, Artificial Sequence
  Ebola virus siRNA sense strand
auccuagcggauuaaaugucc

SEQ ID NO: 15566 - RNA, 21 nt, Artificial Sequence
  Ebola virus siRNA sense strand
uccuagcggauuaaauguccc

SEQ ID NO: 15567 - RNA, 21 nt, Artificial Sequence
  Ebola virus siRNA sense strand
ccuagcggauuaaaugucccu

SEQ ID NO: 15568 - RNA, 21 nt, Artificial Sequence
  Ebola virus siRNA sense strand
cuagcggauuaaaugucccug

SEQ ID NO: 15569 - RNA, 21 nt, Artificial Sequence
  Ebola virus siRNA sense strand
uagcggauuaaaugucccugg

SEQ ID NO: 15570 - RNA, 21 nt, Artificial Sequence
  Ebola virus siRNA sense strand
agcggauuaaaugucccuggg

SEQ ID NO: 15571 - RNA, 21 nt, Artificial Sequence
  Ebola virus siRNA sense strand
gcggauuaaaugucccugggu

SEQ ID NO: 15572 - RNA, 21 nt, Artificial Sequence
  Ebola virus siRNA sense strand
cggauuaaaugucccuggguc

SEQ ID NO: 15573 - RNA, 21 nt, Artificial Sequence
  Ebola virus siRNA sense strand
ggauuaaaugucccugggucg

SEQ ID NO: 15574 - RNA, 21 nt, Artificial Sequence
  Ebola virus siRNA sense strand
gauuaaaugucccugggucgc

SEQ ID NO: 15575 - RNA, 21 nt, Artificial Sequence
  Ebola virus siRNA sense strand
auuaaaugucccugggucgca

SEQ ID NO: 15576 - RNA, 21 nt, Artificial Sequence
  Ebola virus siRNA sense strand
uuaaaugucccugggucgcaa

SEQ ID NO: 15577 - RNA, 21 nt, Artificial Sequence
  Ebola virus siRNA sense strand
uaaaugucccugggucgcaag

SEQ ID NO: 15578 - RNA, 21 nt, Artificial Sequence
  Ebola virus siRNA sense strand
aaaugucccugggucgcaaga

SEQ ID NO: 15579 - RNA, 21 nt, Artificial Sequence
  Ebola virus siRNA sense strand
aaugucccugggucgcaagac

SEQ ID NO: 15580 - RNA, 21 nt, Artificial Sequence
  Ebola virus siRNA sense strand
augucccugggucgcaagacu

SEQ ID NO: 15581 - RNA, 21 nt, Artificial Sequence
  Ebola virus siRNA sense strand
ugucccugggucgcaagacuu

SEQ ID NO: 15582 - RNA, 21 nt, Artificial Sequence
  Ebola virus siRNA sense strand
gucccugggucgcaagacuua

SEQ ID NO: 15583 - RNA, 21 nt, Artificial Sequence
  Ebola virus siRNA sense strand
ucccugggucgcaagacuuaa

SEQ ID NO: 15584 - RNA, 21 nt, Artificial Sequence
  Ebola virus siRNA sense strand
cccugggucgcaagacuuaac

SEQ ID NO: 15585 - RNA, 21 nt, Artificial Sequence
  Ebola virus siRNA sense strand
ccugggucgcaagacuuaacu

SEQ ID NO: 15586 - RNA, 21 nt, Artificial Sequence
  Ebola virus siRNA sense strand
cugggucgcaagacuuaacuu

SEQ ID NO: 15587 - RNA, 21 nt, Artificial Sequence
  Ebola virus siRNA sense strand
ugggucgcaagacuuaacuuc

SEQ ID NO: 15588 - RNA, 21 nt, Artificial Sequence
  Ebola virus siRNA sense strand
gggucgcaagacuuaacuuca

SEQ ID NO: 15589 - RNA, 21 nt, Artificial Sequence
  Ebola virus siRNA sense strand
ggucgcaagacuuaacuucau

SEQ ID NO: 15590 - RNA, 21 nt, Artificial Sequence
  Ebola virus siRNA sense strand
gucgcaagacuuaacuucauu

SEQ ID NO: 15591 - RNA, 21 nt, Artificial Sequence
  Ebola virus siRNA sense strand
ucgcaagacuuaacuucauuu

SEQ ID NO: 15592 - RNA, 21 nt, Artificial Sequence
  Ebola virus siRNA sense strand
cgcaagacuuaacuucauuuc

SEQ ID NO: 15593 - RNA, 21 nt, Artificial Sequence
  Ebola virus siRNA sense strand
gcaagacuuaacuucauuucu

SEQ ID NO: 15594 - RNA, 21 nt, Artificial Sequence
  Ebola virus siRNA sense strand
caagacuuaacuucauuucug

SEQ ID NO: 15595 - RNA, 21 nt, Artificial Sequence
  Ebola virus siRNA sense strand
aagacuuaacuucauuucugc

SEQ ID NO: 15596 - RNA, 21 nt, Artificial Sequence
  Ebola virus siRNA sense strand
agacuuaacuucauuucugcg

SEQ ID NO: 15597 - RNA, 21 nt, Artificial Sequence
  Ebola virus siRNA sense strand
gacuuaacuucauuucugcgc

SEQ ID NO: 15598 - RNA, 21 nt, Artificial Sequence
  Ebola virus siRNA sense strand
acuuaacuucauuucugcgcc

SEQ ID NO: 15599 - RNA, 21 nt, Artificial Sequence
  Ebola virus siRNA sense strand
cuuaacuucauuucugcgcca

SEQ ID NO: 15600 - RNA, 21 nt, Artificial Sequence
  Ebola virus siRNA sense strand
uuaacuucauuucugcgccag

SEQ ID NO: 15601 - RNA, 21 nt, Artificial Sequence
  Ebola virus siRNA sense strand
uaacuucauuucugcgccaga

SEQ ID NO: 15602 - RNA, 21 nt, Artificial Sequence
  Ebola virus siRNA sense strand
aacuucauuucugcgccagau

SEQ ID NO: 15603 - RNA, 21 nt, Artificial Sequence
  Ebola virus siRNA sense strand
acuucauuucugcgccagauu

SEQ ID NO: 15604 - RNA, 21 nt, Artificial Sequence
  Ebola virus siRNA sense strand
cuucauuucugcgccagauug

SEQ ID NO: 15605 - RNA, 21 nt, Artificial Sequence
  Ebola virus siRNA sense strand
uucauuucugcgccagauugu

SEQ ID NO: 15606 - RNA, 21 nt, Artificial Sequence
  Ebola virus siRNA sense strand
ucauuucugcgccagauugua

SEQ ID NO: 15607 - RNA, 21 nt, Artificial Sequence
  Ebola virus siRNA sense strand
cauuucugcgccagauuguac

SEQ ID NO: 15608 - RNA, 21 nt, Artificial Sequence
  Ebola virus siRNA sense strand
auuucugcgccagauuguacg

SEQ ID NO: 15609 - RNA, 21 nt, Artificial Sequence
  Ebola virus siRNA sense strand
uuucugcgccagauuguacgc

SEQ ID NO: 15610 - RNA, 21 nt, Artificial Sequence
  Ebola virus siRNA sense strand
uucugcgccagauuguacgca

SEQ ID NO: 15611 - RNA, 21 nt, Artificial Sequence
  Ebola virus siRNA sense strand
ucugcgccagauuguacgcag

SEQ ID NO: 15612 - RNA, 21 nt, Artificial Sequence
  Ebola virus siRNA sense strand
cugcgccagauuguacgcagg

SEQ ID NO: 15613 - RNA, 21 nt, Artificial Sequence
  Ebola virus siRNA sense strand
ugcgccagauuguacgcagga

SEQ ID NO: 15614 - RNA, 21 nt, Artificial Sequence
  Ebola virus siRNA sense strand
gcgccagauuguacgcaggac

SEQ ID NO: 15615 - RNA, 21 nt, Artificial Sequence
  Ebola virus siRNA sense strand
cgccagauuguacgcaggacc

SEQ ID NO: 15616 - RNA, 21 nt, Artificial Sequence
  Ebola virus siRNA sense strand
gccagauuguacgcaggacca

SEQ ID NO: 15617 - RNA, 21 nt, Artificial Sequence
  Ebola virus siRNA sense strand
ccagauuguacgcaggaccau

SEQ ID NO: 15618 - RNA, 21 nt, Artificial Sequence
  Ebola virus siRNA sense strand
cagauuguacgcaggaccauc

SEQ ID NO: 15619 - RNA, 21 nt, Artificial Sequence
  Ebola virus siRNA sense strand
agauuguacgcaggaccauca

SEQ ID NO: 15620 - RNA, 21 nt, Artificial Sequence
  Ebola virus siRNA sense strand
gauuguacgcaggaccaucac

SEQ ID NO: 15621 - RNA, 21 nt, Artificial Sequence
  Ebola virus siRNA sense strand
auuguacgcaggaccaucacc

SEQ ID NO: 15622 - RNA, 21 nt, Artificial Sequence
  Ebola virus siRNA sense strand
uuguacgcaggaccaucaccc

SEQ ID NO: 15623 - RNA, 21 nt, Artificial Sequence
  Ebola virus siRNA sense strand
uguacgcaggaccaucacccu

SEQ ID NO: 15624 - RNA, 21 nt, Artificial Sequence
  Ebola virus siRNA sense strand
guacgcaggaccaucacccua

SEQ ID NO: 15625 - RNA, 21 nt, Artificial Sequence
  Ebola virus siRNA sense strand
uacgcaggaccaucacccuaa

SEQ ID NO: 15626 - RNA, 21 nt, Artificial Sequence
  Ebola virus siRNA sense strand
acgcaggaccaucacccuaag

SEQ ID NO: 15627 - RNA, 21 nt, Artificial Sequence
  Ebola virus siRNA sense strand
cgcaggaccaucacccuaagu

SEQ ID NO: 15628 - RNA, 21 nt, Artificial Sequence
  Ebola virus siRNA sense strand
gcaggaccaucacccuaagug

SEQ ID NO: 15629 - RNA, 21 nt, Artificial Sequence
  Ebola virus siRNA sense strand
caggaccaucacccuaagugc

SEQ ID NO: 15630 - RNA, 21 nt, Artificial Sequence
  Ebola virus siRNA sense strand
aggaccaucacccuaagugcg

SEQ ID NO: 15631 - RNA, 21 nt, Artificial Sequence
  Ebola virus siRNA sense strand
ggaccaucacccuaagugcga

SEQ ID NO: 15632 - RNA, 21 nt, Artificial Sequence
  Ebola virus siRNA sense strand
gaccaucacccuaagugcgaa

SEQ ID NO: 15633 - RNA, 21 nt, Artificial Sequence
  Ebola virus siRNA sense strand
accaucacccuaagugcgaaa

SEQ ID NO: 15634 - RNA, 21 nt, Artificial Sequence
  Ebola virus siRNA sense strand
ccaucacccuaagugcgaaaa

SEQ ID NO: 15635 - RNA, 21 nt, Artificial Sequence
  Ebola virus siRNA sense strand
caucacccuaagugcgaaaaa

SEQ ID NO: 15636 - RNA, 21 nt, Artificial Sequence
  Ebola virus siRNA sense strand
aucacccuaagugcgaaaaac

SEQ ID NO: 15637 - RNA, 21 nt, Artificial Sequence
  Ebola virus siRNA sense strand
ucacccuaagugcgaaaaaca

SEQ ID NO: 15638 - RNA, 21 nt, Artificial Sequence
  Ebola virus siRNA sense strand
cacccuaagugcgaaaaacaa

SEQ ID NO: 15639 - RNA, 21 nt, Artificial Sequence
  Ebola virus siRNA sense strand
acccuaagugcgaaaaacaaa

SEQ ID NO: 15640 - RNA, 21 nt, Artificial Sequence
  Ebola virus siRNA sense strand
cccuaagugcgaaaaacaaac

SEQ ID NO: 15641 - RNA, 21 nt, Artificial Sequence
  Ebola virus siRNA sense strand
ccuaagugcgaaaaacaaacu

SEQ ID NO: 15642 - RNA, 21 nt, Artificial Sequence
  Ebola virus siRNA sense strand
cuaagugcgaaaaacaaacuu

SEQ ID NO: 15643 - RNA, 21 nt, Artificial Sequence
  Ebola virus siRNA sense strand
uaagugcgaaaaacaaacuua

SEQ ID NO: 15644 - RNA, 21 nt, Artificial Sequence
  Ebola virus siRNA sense strand
aagugcgaaaaacaaacuuau

SEQ ID NO: 15645 - RNA, 21 nt, Artificial Sequence
  Ebola virus siRNA sense strand
agugcgaaaaacaaacuuauu

SEQ ID NO: 15646 - RNA, 21 nt, Artificial Sequence
  Ebola virus siRNA sense strand
gugcgaaaaacaaacuuauua

SEQ ID NO: 15647 - RNA, 21 nt, Artificial Sequence
  Ebola virus siRNA sense strand
ugcgaaaaacaaacuuauuaa

SEQ ID NO: 15648 - RNA, 21 nt, Artificial Sequence
  Ebola virus siRNA sense strand
gcgaaaaacaaacuuauuaau

SEQ ID NO: 15649 - RNA, 21 nt, Artificial Sequence
  Ebola virus siRNA sense strand
cgaaaaacaaacuuauuaaua

SEQ ID NO: 15650 - RNA, 21 nt, Artificial Sequence
  Ebola virus siRNA sense strand
gaaaaacaaacuuauuaauac

SEQ ID NO: 15651 - RNA, 21 nt, Artificial Sequence
  Ebola virus siRNA sense strand
aaaaacaaacuuauuaauacc

SEQ ID NO: 15652 - RNA, 21 nt, Artificial Sequence
  Ebola virus siRNA sense strand
aaaacaaacuuauuaauaccu

SEQ ID NO: 15653 - RNA, 21 nt, Artificial Sequence
  Ebola virus siRNA sense strand
aaacaaacuuauuaauaccuu

SEQ ID NO: 15654 - RNA, 21 nt, Artificial Sequence
  Ebola virus siRNA sense strand
aacaaacuuauuaauaccuua

SEQ ID NO: 15655 - RNA, 21 nt, Artificial Sequence
  Ebola virus siRNA sense strand
acaaacuuauuaauaccuuau

SEQ ID NO: 15656 - RNA, 21 nt, Artificial Sequence
  Ebola virus siRNA sense strand
caaacuuauuaauaccuuauu

SEQ ID NO: 15657 - RNA, 21 nt, Artificial Sequence
  Ebola virus siRNA sense strand
aaacuuauuaauaccuuauuu

SEQ ID NO: 15658 - RNA, 21 nt, Artificial Sequence
  Ebola virus siRNA sense strand
aacuuauuaauaccuuauuuc

SEQ ID NO: 15659 - RNA, 21 nt, Artificial Sequence
  Ebola virus siRNA sense strand
acuuauuaauaccuuauuuca

SEQ ID NO: 15660 - RNA, 21 nt, Artificial Sequence
  Ebola virus siRNA sense strand
cuuauuaauaccuuauuucau

SEQ ID NO: 15661 - RNA, 21 nt, Artificial Sequence
  Ebola virus siRNA sense strand
uuauuaauaccuuauuucaug

SEQ ID NO: 15662 - RNA, 21 nt, Artificial Sequence
  Ebola virus siRNA sense strand
uauuaauaccuuauuucaugc

SEQ ID NO: 15663 - RNA, 21 nt, Artificial Sequence
  Ebola virus siRNA sense strand
auuaauaccuuauuucaugcg

SEQ ID NO: 15664 - RNA, 21 nt, Artificial Sequence
  Ebola virus siRNA sense strand
uuaauaccuuauuucaugcgu

SEQ ID NO: 15665 - RNA, 21 nt, Artificial Sequence
  Ebola virus siRNA sense strand
uaauaccuuauuucaugcguc

SEQ ID NO: 15666 - RNA, 21 nt, Artificial Sequence
  Ebola virus siRNA sense strand
aauaccuuauuucaugcguca

SEQ ID NO: 15667 - RNA, 21 nt, Artificial Sequence
  Ebola virus siRNA sense strand
auaccuuauuucaugcgucag

SEQ ID NO: 15668 - RNA, 21 nt, Artificial Sequence
  Ebola virus siRNA sense strand
uaccuuauuucaugcgucagc

SEQ ID NO: 15669 - RNA, 21 nt, Artificial Sequence
  Ebola virus siRNA sense strand
accuuauuucaugcgucagcu

SEQ ID NO: 15670 - RNA, 21 nt, Artificial Sequence
  Ebola virus siRNA sense strand
ccuuauuucaugcgucagcug

SEQ ID NO: 15671 - RNA, 21 nt, Artificial Sequence
  Ebola virus siRNA sense strand
cuuauuucaugcgucagcuga

SEQ ID NO: 15672 - RNA, 21 nt, Artificial Sequence
  Ebola virus siRNA sense strand
uuauuucaugcgucagcugac

SEQ ID NO: 15673 - RNA, 21 nt, Artificial Sequence
  Ebola virus siRNA sense strand
uauuucaugcgucagcugacu

SEQ ID NO: 15674 - RNA, 21 nt, Artificial Sequence
  Ebola virus siRNA sense strand
auuucaugcgucagcugacuu

SEQ ID NO: 15675 - RNA, 21 nt, Artificial Sequence
  Ebola virus siRNA sense strand
uuucaugcgucagcugacuuc

SEQ ID NO: 15676 - RNA, 21 nt, Artificial Sequence
  Ebola virus siRNA sense strand
uucaugcgucagcugacuucg

SEQ ID NO: 15677 - RNA, 21 nt, Artificial Sequence
  Ebola virus siRNA sense strand
ucaugcgucagcugacuucga

SEQ ID NO: 15678 - RNA, 21 nt, Artificial Sequence
  Ebola virus siRNA sense strand
caugcgucagcugacuucgaa

SEQ ID NO: 15679 - RNA, 21 nt, Artificial Sequence
  Ebola virus siRNA sense strand
augcgucagcugacuucgaag

SEQ ID NO: 15680 - RNA, 21 nt, Artificial Sequence
  Ebola virus siRNA sense strand
ugcgucagcugacuucgaaga

SEQ ID NO: 15681 - RNA, 21 nt, Artificial Sequence
  Ebola virus siRNA sense strand
gcgucagcugacuucgaagac

SEQ ID NO: 15682 - RNA, 21 nt, Artificial Sequence
  Ebola virus siRNA sense strand
cgucagcugacuucgaagacg

SEQ ID NO: 15683 - RNA, 21 nt, Artificial Sequence
  Ebola virus siRNA sense strand
gucagcugacuucgaagacga

SEQ ID NO: 15684 - RNA, 21 nt, Artificial Sequence
  Ebola virus siRNA sense strand
ucagcugacuucgaagacgaa

SEQ ID NO: 15685 - RNA, 21 nt, Artificial Sequence
  Ebola virus siRNA sense strand
cagcugacuucgaagacgaaa

SEQ ID NO: 15686 - RNA, 21 nt, Artificial Sequence
  Ebola virus siRNA sense strand
agcugacuucgaagacgaaau

SEQ ID NO: 15687 - RNA, 21 nt, Artificial Sequence
  Ebola virus siRNA sense strand
gcugacuucgaagacgaaaug

SEQ ID NO: 15688 - RNA, 21 nt, Artificial Sequence
  Ebola virus siRNA sense strand
cugacuucgaagacgaaaugg

SEQ ID NO: 15689 - RNA, 21 nt, Artificial Sequence
  Ebola virus siRNA sense strand
ugacuucgaagacgaaauggu

SEQ ID NO: 15690 - RNA, 21 nt, Artificial Sequence
  Ebola virus siRNA sense strand
gacuucgaagacgaaaugguu

SEQ ID NO: 15691 - RNA, 21 nt, Artificial Sequence
  Ebola virus siRNA sense strand
acuucgaagacgaaaugguuu

SEQ ID NO: 15692 - RNA, 21 nt, Artificial Sequence
  Ebola virus siRNA sense strand
cuucgaagacgaaaugguuug

SEQ ID NO: 15693 - RNA, 21 nt, Artificial Sequence
  Ebola virus siRNA sense strand
uucgaagacgaaaugguuugu

SEQ ID NO: 15694 - RNA, 21 nt, Artificial Sequence
  Ebola virus siRNA sense strand
ucgaagacgaaaugguuugua

SEQ ID NO: 15695 - RNA, 21 nt, Artificial Sequence
  Ebola virus siRNA sense strand
cgaagacgaaaugguuuguaa

SEQ ID NO: 15696 - RNA, 21 nt, Artificial Sequence
  Ebola virus siRNA sense strand
gaagacgaaaugguuuguaaa

SEQ ID NO: 15697 - RNA, 21 nt, Artificial Sequence
  Ebola virus siRNA sense strand
aagacgaaaugguuuguaaau

SEQ ID NO: 15698 - RNA, 21 nt, Artificial Sequence
  Ebola virus siRNA sense strand
agacgaaaugguuuguaaaug

SEQ ID NO: 15699 - RNA, 21 nt, Artificial Sequence
  Ebola virus siRNA sense strand
gacgaaaugguuuguaaaugg

SEQ ID NO: 15700 - RNA, 21 nt, Artificial Sequence
  Ebola virus siRNA sense strand
acgaaaugguuuguaaauggc

SEQ ID NO: 15701 - RNA, 21 nt, Artificial Sequence
  Ebola virus siRNA sense strand
cgaaaugguuuguaaauggcu

SEQ ID NO: 15702 - RNA, 21 nt, Artificial Sequence
  Ebola virus siRNA sense strand
gaaaugguuuguaaauggcua

SEQ ID NO: 15703 - RNA, 21 nt, Artificial Sequence
  Ebola virus siRNA sense strand
aaaugguuuguaaauggcuau

SEQ ID NO: 15704 - RNA, 21 nt, Artificial Sequence
  Ebola virus siRNA sense strand
aaugguuuguaaauggcuauu

SEQ ID NO: 15705 - RNA, 21 nt, Artificial Sequence
  Ebola virus siRNA sense strand
augguuuguaaauggcuauua

SEQ ID NO: 15706 - RNA, 21 nt, Artificial Sequence
  Ebola virus siRNA sense strand
ugguuuguaaauggcuauuau

SEQ ID NO: 15707 - RNA, 21 nt, Artificial Sequence
  Ebola virus siRNA sense strand
gguuuguaaauggcuauuauc

SEQ ID NO: 15708 - RNA, 21 nt, Artificial Sequence
  Ebola virus siRNA sense strand
guuuguaaauggcuauuauca

SEQ ID NO: 15709 - RNA, 21 nt, Artificial Sequence
  Ebola virus siRNA sense strand
uuuguaaauggcuauuaucau

SEQ ID NO: 15710 - RNA, 21 nt, Artificial Sequence
  Ebola virus siRNA sense strand
uuguaaauggcuauuaucauc

SEQ ID NO: 15711 - RNA, 21 nt, Artificial Sequence
  Ebola virus siRNA sense strand
uguaaauggcuauuaucauca

SEQ ID NO: 15712 - RNA, 21 nt, Artificial Sequence
  Ebola virus siRNA sense strand
guaaauggcuauuaucaucaa

SEQ ID NO: 15713 - RNA, 21 nt, Artificial Sequence
  Ebola virus siRNA sense strand
uaaauggcuauuaucaucaac

SEQ ID NO: 15714 - RNA, 21 nt, Artificial Sequence
  Ebola virus siRNA sense strand
aaauggcuauuaucaucaacu

SEQ ID NO: 15715 - RNA, 21 nt, Artificial Sequence
  Ebola virus siRNA sense strand
aauggcuauuaucaucaacuc

SEQ ID NO: 15716 - RNA, 21 nt, Artificial Sequence
  Ebola virus siRNA sense strand
auggcuauuaucaucaacucc

SEQ ID NO: 15717 - RNA, 21 nt, Artificial Sequence
  Ebola virus siRNA sense strand
uggcuauuaucaucaacuccu

SEQ ID NO: 15718 - RNA, 21 nt, Artificial Sequence
  Ebola virus siRNA sense strand
ggcuauuaucaucaacuccug

SEQ ID NO: 15719 - RNA, 21 nt, Artificial Sequence
  Ebola virus siRNA sense strand
gcuauuaucaucaacuccugu

SEQ ID NO: 15720 - RNA, 21 nt, Artificial Sequence
  Ebola virus siRNA sense strand
cuauuaucaucaacuccuguu

SEQ ID NO: 15721 - RNA, 21 nt, Artificial Sequence
  Ebola virus siRNA sense strand
uauuaucaucaacuccuguua

SEQ ID NO: 15722 - RNA, 21 nt, Artificial Sequence
  Ebola virus siRNA sense strand
auuaucaucaacuccuguuau

SEQ ID NO: 15723 - RNA, 21 nt, Artificial Sequence
  Ebola virus siRNA sense strand
uuaucaucaacuccuguuaug

SEQ ID NO: 15724 - RNA, 21 nt, Artificial Sequence
  Ebola virus siRNA sense strand
uaucaucaacuccuguuauga

SEQ ID NO: 15725 - RNA, 21 nt, Artificial Sequence
  Ebola virus siRNA sense strand
aucaucaacuccuguuaugag

SEQ ID NO: 15726 - RNA, 21 nt, Artificial Sequence
  Ebola virus siRNA sense strand
ucaucaacuccuguuaugagu

SEQ ID NO: 15727 - RNA, 21 nt, Artificial Sequence
  Ebola virus siRNA sense strand
caucaacuccuguuaugaguc

SEQ ID NO: 15728 - RNA, 21 nt, Artificial Sequence
  Ebola virus siRNA sense strand
aucaacuccuguuaugagucg

SEQ ID NO: 15729 - RNA, 21 nt, Artificial Sequence
  Ebola virus siRNA sense strand
ucaacuccuguuaugagucgu

SEQ ID NO: 15730 - RNA, 21 nt, Artificial Sequence
  Ebola virus siRNA sense strand
caacuccuguuaugagucguu

SEQ ID NO: 15731 - RNA, 21 nt, Artificial Sequence
  Ebola virus siRNA sense strand
aacuccuguuaugagucguuu

SEQ ID NO: 15732 - RNA, 21 nt, Artificial Sequence
  Ebola virus siRNA sense strand
acuccuguuaugagucguuuu

SEQ ID NO: 15733 - RNA, 21 nt, Artificial Sequence
  Ebola virus siRNA sense strand
cuccuguuaugagucguuuug

SEQ ID NO: 15734 - RNA, 21 nt, Artificial Sequence
  Ebola virus siRNA sense strand
uccuguuaugagucguuuugc

SEQ ID NO: 15735 - RNA, 21 nt, Artificial Sequence
  Ebola virus siRNA sense strand
ccuguuaugagucguuuugcg

SEQ ID NO: 15736 - RNA, 21 nt, Artificial Sequence
  Ebola virus siRNA sense strand
cuguuaugagucguuuugcgg

SEQ ID NO: 15737 - RNA, 21 nt, Artificial Sequence
  Ebola virus siRNA sense strand
uguuaugagucguuuugcggc

SEQ ID NO: 15738 - RNA, 21 nt, Artificial Sequence
  Ebola virus siRNA sense strand
guuaugagucguuuugcggcc

SEQ ID NO: 15739 - RNA, 21 nt, Artificial Sequence
  Ebola virus siRNA sense strand
uuaugagucguuuugcggccg

SEQ ID NO: 15740 - RNA, 21 nt, Artificial Sequence
  Ebola virus siRNA sense strand
uaugagucguuuugcggccga

SEQ ID NO: 15741 - RNA, 21 nt, Artificial Sequence
  Ebola virus siRNA sense strand
augagucguuuugcggccgau

SEQ ID NO: 15742 - RNA, 21 nt, Artificial Sequence
  Ebola virus siRNA sense strand
ugagucguuuugcggccgaua

SEQ ID NO: 15743 - RNA, 21 nt, Artificial Sequence
  Ebola virus siRNA sense strand
gagucguuuugcggccgauau

SEQ ID NO: 15744 - RNA, 21 nt, Artificial Sequence
  Ebola virus siRNA sense strand
agucguuuugcggccgauauc

SEQ ID NO: 15745 - RNA, 21 nt, Artificial Sequence
  Ebola virus siRNA sense strand
gucguuuugcggccgauaucu

SEQ ID NO: 15746 - RNA, 21 nt, Artificial Sequence
  Ebola virus siRNA sense strand
ucguuuugcggccgauaucuu

SEQ ID NO: 15747 - RNA, 21 nt, Artificial Sequence
  Ebola virus siRNA sense strand
cguuuugcggccgauaucuuu

SEQ ID NO: 15748 - RNA, 21 nt, Artificial Sequence
  Ebola virus siRNA sense strand
guuuugcggccgauaucuuuu

SEQ ID NO: 15749 - RNA, 21 nt, Artificial Sequence
  Ebola virus siRNA sense strand
uuuugcggccgauaucuuuuc

SEQ ID NO: 15750 - RNA, 21 nt, Artificial Sequence
  Ebola virus siRNA sense strand
uuugcggccgauaucuuuuca

SEQ ID NO: 15751 - RNA, 21 nt, Artificial Sequence
  Ebola virus siRNA sense strand
uugcggccgauaucuuuucac

SEQ ID NO: 15752 - RNA, 21 nt, Artificial Sequence
  Ebola virus siRNA sense strand
ugcggccgauaucuuuucacg

SEQ ID NO: 15753 - RNA, 21 nt, Artificial Sequence
  Ebola virus siRNA sense strand
gcggccgauaucuuuucacgc

SEQ ID NO: 15754 - RNA, 21 nt, Artificial Sequence
  Ebola virus siRNA sense strand
cggccgauaucuuuucacgca

SEQ ID NO: 15755 - RNA, 21 nt, Artificial Sequence
  Ebola virus siRNA sense strand
ggccgauaucuuuucacgcac

SEQ ID NO: 15756 - RNA, 21 nt, Artificial Sequence
  Ebola virus siRNA sense strand
gccgauaucuuuucacgcacg

SEQ ID NO: 15757 - RNA, 21 nt, Artificial Sequence
  Ebola virus siRNA sense strand
ccgauaucuuuucacgcacgc

SEQ ID NO: 15758 - RNA, 21 nt, Artificial Sequence
  Ebola virus siRNA sense strand
cgauaucuuuucacgcacgcc

SEQ ID NO: 15759 - RNA, 21 nt, Artificial Sequence
  Ebola virus siRNA sense strand
gauaucuuuucacgcacgccg

SEQ ID NO: 15760 - RNA, 21 nt, Artificial Sequence
  Ebola virus siRNA sense strand
auaucuuuucacgcacgccga

SEQ ID NO: 15761 - RNA, 21 nt, Artificial Sequence
  Ebola virus siRNA sense strand
uaucuuuucacgcacgccgag

SEQ ID NO: 15762 - RNA, 21 nt, Artificial Sequence
  Ebola virus siRNA sense strand
aucuuuucacgcacgccgagc

SEQ ID NO: 15763 - RNA, 21 nt, Artificial Sequence
  Ebola virus siRNA sense strand
ucuuuucacgcacgccgagcg

SEQ ID NO: 15764 - RNA, 21 nt, Artificial Sequence
  Ebola virus siRNA sense strand
cuuuucacgcacgccgagcgg

SEQ ID NO: 15765 - RNA, 21 nt, Artificial Sequence
  Ebola virus siRNA sense strand
uuuucacgcacgccgagcggg

SEQ ID NO: 15766 - RNA, 21 nt, Artificial Sequence
  Ebola virus siRNA sense strand
uuucacgcacgccgagcggga

SEQ ID NO: 15767 - RNA, 21 nt, Artificial Sequence
  Ebola virus siRNA sense strand
uucacgcacgccgagcgggaa

SEQ ID NO: 15768 - RNA, 21 nt, Artificial Sequence
  Ebola virus siRNA sense strand
ucacgcacgccgagcgggaag

SEQ ID NO: 15769 - RNA, 21 nt, Artificial Sequence
  Ebola virus siRNA sense strand
cacgcacgccgagcgggaagc

SEQ ID NO: 15770 - RNA, 21 nt, Artificial Sequence
  Ebola virus siRNA sense strand
acgcacgccgagcgggaagcg

SEQ ID NO: 15771 - RNA, 21 nt, Artificial Sequence
  Ebola virus siRNA sense strand
cgcacgccgagcgggaagcga

SEQ ID NO: 15772 - RNA, 21 nt, Artificial Sequence
  Ebola virus siRNA sense strand
gcacgccgagcgggaagcgau

SEQ ID NO: 15773 - RNA, 21 nt, Artificial Sequence
  Ebola virus siRNA sense strand
cacgccgagcgggaagcgauu

SEQ ID NO: 15774 - RNA, 21 nt, Artificial Sequence
  Ebola virus siRNA sense strand
acgccgagcgggaagcgauug

SEQ ID NO: 15775 - RNA, 21 nt, Artificial Sequence
  Ebola virus siRNA sense strand
cgccgagcgggaagcgauugc

SEQ ID NO: 15776 - RNA, 21 nt, Artificial Sequence
  Ebola virus siRNA sense strand
gccgagcgggaagcgauugca

SEQ ID NO: 15777 - RNA, 21 nt, Artificial Sequence
  Ebola virus siRNA sense strand
ccgagcgggaagcgauugcaa

SEQ ID NO: 15778 - RNA, 21 nt, Artificial Sequence
  Ebola virus siRNA sense strand
cgagcgggaagcgauugcaaa

SEQ ID NO: 15779 - RNA, 21 nt, Artificial Sequence
  Ebola virus siRNA sense strand
gagcgggaagcgauugcaaau

SEQ ID NO: 15780 - RNA, 21 nt, Artificial Sequence
  Ebola virus siRNA sense strand
agcgggaagcgauugcaaauu

SEQ ID NO: 15781 - RNA, 21 nt, Artificial Sequence
  Ebola virus siRNA sense strand
gcgggaagcgauugcaaauuc

SEQ ID NO: 15782 - RNA, 21 nt, Artificial Sequence
  Ebola virus siRNA sense strand
cgggaagcgauugcaaauucu

SEQ ID NO: 15783 - RNA, 21 nt, Artificial Sequence
  Ebola virus siRNA sense strand
gggaagcgauugcaaauucua

SEQ ID NO: 15784 - RNA, 21 nt, Artificial Sequence
  Ebola virus siRNA sense strand
ggaagcgauugcaaauucuag

SEQ ID NO: 15785 - RNA, 21 nt, Artificial Sequence
  Ebola virus siRNA sense strand
gaagcgauugcaaauucuagg

SEQ ID NO: 15786 - RNA, 21 nt, Artificial Sequence
  Ebola virus siRNA sense strand
aagcgauugcaaauucuagga

SEQ ID NO: 15787 - RNA, 21 nt, Artificial Sequence
  Ebola virus siRNA sense strand
agcgauugcaaauucuaggau

SEQ ID NO: 15788 - RNA, 21 nt, Artificial Sequence
  Ebola virus siRNA sense strand
gcgauugcaaauucuaggaua

SEQ ID NO: 15789 - RNA, 21 nt, Artificial Sequence
  Ebola virus siRNA sense strand
cgauugcaaauucuaggauac

SEQ ID NO: 15790 - RNA, 21 nt, Artificial Sequence
  Ebola virus siRNA sense strand
gauugcaaauucuaggauacc

SEQ ID NO: 15791 - RNA, 21 nt, Artificial Sequence
  Ebola virus siRNA sense strand
auugcaaauucuaggauaccu

SEQ ID NO: 15792 - RNA, 21 nt, Artificial Sequence
  Ebola virus siRNA sense strand
uugcaaauucuaggauaccug

SEQ ID NO: 15793 - RNA, 21 nt, Artificial Sequence
  Ebola virus siRNA sense strand
ugcaaauucuaggauaccugg

SEQ ID NO: 15794 - RNA, 21 nt, Artificial Sequence
  Ebola virus siRNA sense strand
gcaaauucuaggauaccugga

SEQ ID NO: 15795 - RNA, 21 nt, Artificial Sequence
  Ebola virus siRNA sense strand
caaauucuaggauaccuggaa

SEQ ID NO: 15796 - RNA, 21 nt, Artificial Sequence
  Ebola virus siRNA sense strand
aaauucuaggauaccuggaag

SEQ ID NO: 15797 - RNA, 21 nt, Artificial Sequence
  Ebola virus siRNA sense strand
aauucuaggauaccuggaagg

SEQ ID NO: 15798 - RNA, 21 nt, Artificial Sequence
  Ebola virus siRNA sense strand
auucuaggauaccuggaagga

SEQ ID NO: 15799 - RNA, 21 nt, Artificial Sequence
  Ebola virus siRNA sense strand
uucuaggauaccuggaaggaa

SEQ ID NO: 15800 - RNA, 21 nt, Artificial Sequence
  Ebola virus siRNA sense strand
ucuaggauaccuggaaggaac

SEQ ID NO: 15801 - RNA, 21 nt, Artificial Sequence
  Ebola virus siRNA sense strand
cuaggauaccuggaaggaaca

SEQ ID NO: 15802 - RNA, 21 nt, Artificial Sequence
  Ebola virus siRNA sense strand
uaggauaccuggaaggaacac

SEQ ID NO: 15803 - RNA, 21 nt, Artificial Sequence
  Ebola virus siRNA sense strand
aggauaccuggaaggaacacg

SEQ ID NO: 15804 - RNA, 21 nt, Artificial Sequence
  Ebola virus siRNA sense strand
ggauaccuggaaggaacacgc

SEQ ID NO: 15805 - RNA, 21 nt, Artificial Sequence
  Ebola virus siRNA sense strand
gauaccuggaaggaacacgca

SEQ ID NO: 15806 - RNA, 21 nt, Artificial Sequence
  Ebola virus siRNA sense strand
auaccuggaaggaacacgcac

SEQ ID NO: 15807 - RNA, 21 nt, Artificial Sequence
  Ebola virus siRNA sense strand
uaccuggaaggaacacgcaca

SEQ ID NO: 15808 - RNA, 21 nt, Artificial Sequence
  Ebola virus siRNA sense strand
accuggaaggaacacgcacau

SEQ ID NO: 15809 - RNA, 21 nt, Artificial Sequence
  Ebola virus siRNA sense strand
ccuggaaggaacacgcacauu

SEQ ID NO: 15810 - RNA, 21 nt, Artificial Sequence
  Ebola virus siRNA sense strand
cuggaaggaacacgcacauua

SEQ ID NO: 15811 - RNA, 21 nt, Artificial Sequence
  Ebola virus siRNA sense strand
uggaaggaacacgcacauuau

SEQ ID NO: 15812 - RNA, 21 nt, Artificial Sequence
  Ebola virus siRNA sense strand
ggaaggaacacgcacauuauu

SEQ ID NO: 15813 - RNA, 21 nt, Artificial Sequence
  Ebola virus siRNA sense strand
gaaggaacacgcacauuauua

SEQ ID NO: 15814 - RNA, 21 nt, Artificial Sequence
  Ebola virus siRNA sense strand
aaggaacacgcacauuauuag

SEQ ID NO: 15815 - RNA, 21 nt, Artificial Sequence
  Ebola virus siRNA sense strand
aggaacacgcacauuauuagc

SEQ ID NO: 15816 - RNA, 21 nt, Artificial Sequence
  Ebola virus siRNA sense strand
ggaacacgcacauuauuagcc

SEQ ID NO: 15817 - RNA, 21 nt, Artificial Sequence
  Ebola virus siRNA sense strand
gaacacgcacauuauuagccu

SEQ ID NO: 15818 - RNA, 21 nt, Artificial Sequence
  Ebola virus siRNA sense strand
aacacgcacauuauuagccuc

SEQ ID NO: 15819 - RNA, 21 nt, Artificial Sequence
  Ebola virus siRNA sense strand
acacgcacauuauuagccucu

SEQ ID NO: 15820 - RNA, 21 nt, Artificial Sequence
  Ebola virus siRNA sense strand
cacgcacauuauuagccucua

SEQ ID NO: 15821 - RNA, 21 nt, Artificial Sequence
  Ebola virus siRNA sense strand
acgcacauuauuagccucuaa

SEQ ID NO: 15822 - RNA, 21 nt, Artificial Sequence
  Ebola virus siRNA sense strand
cgcacauuauuagccucuaag

SEQ ID NO: 15823 - RNA, 21 nt, Artificial Sequence
  Ebola virus siRNA sense strand
gcacauuauuagccucuaaga

SEQ ID NO: 15824 - RNA, 21 nt, Artificial Sequence
  Ebola virus siRNA sense strand
cacauuauuagccucuaagau

SEQ ID NO: 15825 - RNA, 21 nt, Artificial Sequence
  Ebola virus siRNA sense strand
acauuauuagccucuaagauc

SEQ ID NO: 15826 - RNA, 21 nt, Artificial Sequence
  Ebola virus siRNA sense strand
cauuauuagccucuaagauca

SEQ ID NO: 15827 - RNA, 21 nt, Artificial Sequence
  Ebola virus siRNA sense strand
auuauuagccucuaagaucau

SEQ ID NO: 15828 - RNA, 21 nt, Artificial Sequence
  Ebola virus siRNA sense strand
uuauuagccucuaagaucauc

SEQ ID NO: 15829 - RNA, 21 nt, Artificial Sequence
  Ebola virus siRNA sense strand
uauuagccucuaagaucauca

SEQ ID NO: 15830 - RNA, 21 nt, Artificial Sequence
  Ebola virus siRNA sense strand
auuagccucuaagaucaucaa

SEQ ID NO: 15831 - RNA, 21 nt, Artificial Sequence
  Ebola virus siRNA sense strand
uuagccucuaagaucaucaac

SEQ ID NO: 15832 - RNA, 21 nt, Artificial Sequence
  Ebola virus siRNA sense strand
uagccucuaagaucaucaaca

SEQ ID NO: 15833 - RNA, 21 nt, Artificial Sequence
  Ebola virus siRNA sense strand
agccucuaagaucaucaacaa

SEQ ID NO: 15834 - RNA, 21 nt, Artificial Sequence
  Ebola virus siRNA sense strand
gccucuaagaucaucaacaau

SEQ ID NO: 15835 - RNA, 21 nt, Artificial Sequence
  Ebola virus siRNA sense strand
ccucuaagaucaucaacaaua

SEQ ID NO: 15836 - RNA, 21 nt, Artificial Sequence
  Ebola virus siRNA sense strand
cucuaagaucaucaacaauaa

SEQ ID NO: 15837 - RNA, 21 nt, Artificial Sequence
  Ebola virus siRNA sense strand
ucuaagaucaucaacaauaau

SEQ ID NO: 15838 - RNA, 21 nt, Artificial Sequence
  Ebola virus siRNA sense strand
cuaagaucaucaacaauaaua

SEQ ID NO: 15839 - RNA, 21 nt, Artificial Sequence
  Ebola virus siRNA sense strand
uaagaucaucaacaauaauac

SEQ ID NO: 15840 - RNA, 21 nt, Artificial Sequence
  Ebola virus siRNA sense strand
aagaucaucaacaauaauaca

SEQ ID NO: 15841 - RNA, 21 nt, Artificial Sequence
  Ebola virus siRNA sense strand
agaucaucaacaauaauacag

SEQ ID NO: 15842 - RNA, 21 nt, Artificial Sequence
  Ebola virus siRNA sense strand
gaucaucaacaauaauacaga

SEQ ID NO: 15843 - RNA, 21 nt, Artificial Sequence
  Ebola virus siRNA sense strand
aucaucaacaauaauacagag

SEQ ID NO: 15844 - RNA, 21 nt, Artificial Sequence
  Ebola virus siRNA sense strand
ucaucaacaauaauacagaga

SEQ ID NO: 15845 - RNA, 21 nt, Artificial Sequence
  Ebola virus siRNA sense strand
caucaacaauaauacagagac

SEQ ID NO: 15846 - RNA, 21 nt, Artificial Sequence
  Ebola virus siRNA sense strand
aucaacaauaauacagagaca

SEQ ID NO: 15847 - RNA, 21 nt, Artificial Sequence
  Ebola virus siRNA sense strand
ucaacaauaauacagagacac

SEQ ID NO: 15848 - RNA, 21 nt, Artificial Sequence
  Ebola virus siRNA sense strand
caacaauaauacagagacacc

SEQ ID NO: 15849 - RNA, 21 nt, Artificial Sequence
  Ebola virus siRNA sense strand
aacaauaauacagagacaccg

SEQ ID NO: 15850 - RNA, 21 nt, Artificial Sequence
  Ebola virus siRNA sense strand
acaauaauacagagacaccgg

SEQ ID NO: 15851 - RNA, 21 nt, Artificial Sequence
  Ebola virus siRNA sense strand
caauaauacagagacaccggu

SEQ ID NO: 15852 - RNA, 21 nt, Artificial Sequence
  Ebola virus siRNA sense strand
aauaauacagagacaccgguu

SEQ ID NO: 15853 - RNA, 21 nt, Artificial Sequence
  Ebola virus siRNA sense strand
auaauacagagacaccgguuu

SEQ ID NO: 15854 - RNA, 21 nt, Artificial Sequence
  Ebola virus siRNA sense strand
uaauacagagacaccgguuuu

SEQ ID NO: 15855 - RNA, 21 nt, Artificial Sequence
  Ebola virus siRNA sense strand
aauacagagacaccgguuuug

SEQ ID NO: 15856 - RNA, 21 nt, Artificial Sequence
  Ebola virus siRNA sense strand
auacagagacaccgguuuugg

SEQ ID NO: 15857 - RNA, 21 nt, Artificial Sequence
  Ebola virus siRNA sense strand
uacagagacaccgguuuugga

SEQ ID NO: 15858 - RNA, 21 nt, Artificial Sequence
  Ebola virus siRNA sense strand
acagagacaccgguuuuggac

SEQ ID NO: 15859 - RNA, 21 nt, Artificial Sequence
  Ebola virus siRNA sense strand
cagagacaccgguuuuggaca

SEQ ID NO: 15860 - RNA, 21 nt, Artificial Sequence
  Ebola virus siRNA sense strand
agagacaccgguuuuggacag

SEQ ID NO: 15861 - RNA, 21 nt, Artificial Sequence
  Ebola virus siRNA sense strand
gagacaccgguuuuggacaga

SEQ ID NO: 15862 - RNA, 21 nt, Artificial Sequence
  Ebola virus siRNA sense strand
agacaccgguuuuggacagac

SEQ ID NO: 15863 - RNA, 21 nt, Artificial Sequence
  Ebola virus siRNA sense strand
gacaccgguuuuggacagacu

SEQ ID NO: 15864 - RNA, 21 nt, Artificial Sequence
  Ebola virus siRNA sense strand
acaccgguuuuggacagacug

SEQ ID NO: 15865 - RNA, 21 nt, Artificial Sequence
  Ebola virus siRNA sense strand
caccgguuuuggacagacuga

SEQ ID NO: 15866 - RNA, 21 nt, Artificial Sequence
  Ebola virus siRNA sense strand
accgguuuuggacagacugag

SEQ ID NO: 15867 - RNA, 21 nt, Artificial Sequence
  Ebola virus siRNA sense strand
ccgguuuuggacagacugagg

SEQ ID NO: 15868 - RNA, 21 nt, Artificial Sequence
  Ebola virus siRNA sense strand
cgguuuuggacagacugagga

SEQ ID NO: 15869 - RNA, 21 nt, Artificial Sequence
  Ebola virus siRNA sense strand
gguuuuggacagacugaggaa

SEQ ID NO: 15870 - RNA, 21 nt, Artificial Sequence
  Ebola virus siRNA sense strand
guuuuggacagacugaggaaa

SEQ ID NO: 15871 - RNA, 21 nt, Artificial Sequence
  Ebola virus siRNA sense strand
uuuuggacagacugaggaaaa

SEQ ID NO: 15872 - RNA, 21 nt, Artificial Sequence
  Ebola virus siRNA sense strand
uuuggacagacugaggaaaau

SEQ ID NO: 15873 - RNA, 21 nt, Artificial Sequence
  Ebola virus siRNA sense strand
uuggacagacugaggaaaaua

SEQ ID NO: 15874 - RNA, 21 nt, Artificial Sequence
  Ebola virus siRNA sense strand
uggacagacugaggaaaauaa

SEQ ID NO: 15875 - RNA, 21 nt, Artificial Sequence
  Ebola virus siRNA sense strand
ggacagacugaggaaaauaac

SEQ ID NO: 15876 - RNA, 21 nt, Artificial Sequence
  Ebola virus siRNA sense strand
gacagacugaggaaaauaaca

SEQ ID NO: 15877 - RNA, 21 nt, Artificial Sequence
  Ebola virus siRNA sense strand
acagacugaggaaaauaacau

SEQ ID NO: 15878 - RNA, 21 nt, Artificial Sequence
  Ebola virus siRNA sense strand
cagacugaggaaaauaacauu

SEQ ID NO: 15879 - RNA, 21 nt, Artificial Sequence
  Ebola virus siRNA sense strand
agacugaggaaaauaacauug

SEQ ID NO: 15880 - RNA, 21 nt, Artificial Sequence
  Ebola virus siRNA sense strand
gacugaggaaaauaacauugc

SEQ ID NO: 15881 - RNA, 21 nt, Artificial Sequence
  Ebola virus siRNA sense strand
acugaggaaaauaacauugca

SEQ ID NO: 15882 - RNA, 21 nt, Artificial Sequence
  Ebola virus siRNA sense strand
cugaggaaaauaacauugcaa

SEQ ID NO: 15883 - RNA, 21 nt, Artificial Sequence
  Ebola virus siRNA sense strand
ugaggaaaauaacauugcaaa

SEQ ID NO: 15884 - RNA, 21 nt, Artificial Sequence
  Ebola virus siRNA sense strand
gaggaaaauaacauugcaaag

SEQ ID NO: 15885 - RNA, 21 nt, Artificial Sequence
  Ebola virus siRNA sense strand
aggaaaauaacauugcaaagg

SEQ ID NO: 15886 - RNA, 21 nt, Artificial Sequence
  Ebola virus siRNA sense strand
ggaaaauaacauugcaaaggu

SEQ ID NO: 15887 - RNA, 21 nt, Artificial Sequence
  Ebola virus siRNA sense strand
gaaaauaacauugcaaaggug

SEQ ID NO: 15888 - RNA, 21 nt, Artificial Sequence
  Ebola virus siRNA sense strand
aaaauaacauugcaaaggugg

SEQ ID NO: 15889 - RNA, 21 nt, Artificial Sequence
  Ebola virus siRNA sense strand
aaauaacauugcaaaggugga

SEQ ID NO: 15890 - RNA, 21 nt, Artificial Sequence
  Ebola virus siRNA sense strand
aauaacauugcaaagguggag

SEQ ID NO: 15891 - RNA, 21 nt, Artificial Sequence
  Ebola virus siRNA sense strand
auaacauugcaaagguggagc

SEQ ID NO: 15892 - RNA, 21 nt, Artificial Sequence
  Ebola virus siRNA sense strand
uaacauugcaaagguggagcc

SEQ ID NO: 15893 - RNA, 21 nt, Artificial Sequence
  Ebola virus siRNA sense strand
aacauugcaaagguggagccu

SEQ ID NO: 15894 - RNA, 21 nt, Artificial Sequence
  Ebola virus siRNA sense strand
acauugcaaagguggagccua

SEQ ID NO: 15895 - RNA, 21 nt, Artificial Sequence
  Ebola virus siRNA sense strand
cauugcaaagguggagccuau

SEQ ID NO: 15896 - RNA, 21 nt, Artificial Sequence
  Ebola virus siRNA sense strand
auugcaaagguggagccuaug

SEQ ID NO: 15897 - RNA, 21 nt, Artificial Sequence
  Ebola virus siRNA sense strand
uugcaaagguggagccuaugg

SEQ ID NO: 15898 - RNA, 21 nt, Artificial Sequence
  Ebola virus siRNA sense strand
ugcaaagguggagccuauggu

SEQ ID NO: 15899 - RNA, 21 nt, Artificial Sequence
  Ebola virus siRNA sense strand
gcaaagguggagccuaugguu

SEQ ID NO: 15900 - RNA, 21 nt, Artificial Sequence
  Ebola virus siRNA sense strand
caaagguggagccuaugguuu

SEQ ID NO: 15901 - RNA, 21 nt, Artificial Sequence
  Ebola virus siRNA sense strand
aaagguggagccuaugguuua

SEQ ID NO: 15902 - RNA, 21 nt, Artificial Sequence
  Ebola virus siRNA sense strand
aagguggagccuaugguuuag

SEQ ID NO: 15903 - RNA, 21 nt, Artificial Sequence
  Ebola virus siRNA sense strand
agguggagccuaugguuuagu

SEQ ID NO: 15904 - RNA, 21 nt, Artificial Sequence
  Ebola virus siRNA sense strand
gguggagccuaugguuuaguu

SEQ ID NO: 15905 - RNA, 21 nt, Artificial Sequence
  Ebola virus siRNA sense strand
guggagccuaugguuuaguua

SEQ ID NO: 15906 - RNA, 21 nt, Artificial Sequence
  Ebola virus siRNA sense strand
uggagccuaugguuuaguuau

SEQ ID NO: 15907 - RNA, 21 nt, Artificial Sequence
  Ebola virus siRNA sense strand
ggagccuaugguuuaguuauc

SEQ ID NO: 15908 - RNA, 21 nt, Artificial Sequence
  Ebola virus siRNA sense strand
gagccuaugguuuaguuaucu

SEQ ID NO: 15909 - RNA, 21 nt, Artificial Sequence
  Ebola virus siRNA sense strand
agccuaugguuuaguuaucuu

SEQ ID NO: 15910 - RNA, 21 nt, Artificial Sequence
  Ebola virus siRNA sense strand
gccuaugguuuaguuaucuug

SEQ ID NO: 15911 - RNA, 21 nt, Artificial Sequence
  Ebola virus siRNA sense strand
ccuaugguuuaguuaucuuga

SEQ ID NO: 15912 - RNA, 21 nt, Artificial Sequence
  Ebola virus siRNA sense strand
cuaugguuuaguuaucuugau

SEQ ID NO: 15913 - RNA, 21 nt, Artificial Sequence
  Ebola virus siRNA sense strand
uaugguuuaguuaucuugauc

SEQ ID NO: 15914 - RNA, 21 nt, Artificial Sequence
  Ebola virus siRNA sense strand
augguuuaguuaucuugauca

SEQ ID NO: 15915 - RNA, 21 nt, Artificial Sequence
  Ebola virus siRNA sense strand
ugguuuaguuaucuugaucau

SEQ ID NO: 15916 - RNA, 21 nt, Artificial Sequence
  Ebola virus siRNA sense strand
gguuuaguuaucuugaucauu

SEQ ID NO: 15917 - RNA, 21 nt, Artificial Sequence
  Ebola virus siRNA sense strand
guuuaguuaucuugaucauug

SEQ ID NO: 15918 - RNA, 21 nt, Artificial Sequence
  Ebola virus siRNA sense strand
uuuaguuaucuugaucauugu

SEQ ID NO: 15919 - RNA, 21 nt, Artificial Sequence
  Ebola virus siRNA sense strand
uuaguuaucuugaucauugug

SEQ ID NO: 15920 - RNA, 21 nt, Artificial Sequence
  Ebola virus siRNA sense strand
uaguuaucuugaucauuguga

SEQ ID NO: 15921 - RNA, 21 nt, Artificial Sequence
  Ebola virus siRNA sense strand
aguuaucuugaucauugugau

SEQ ID NO: 15922 - RNA, 21 nt, Artificial Sequence
  Ebola virus siRNA sense strand
guuaucuugaucauugugaua

SEQ ID NO: 15923 - RNA, 21 nt, Artificial Sequence
  Ebola virus siRNA sense strand
uuaucuugaucauugugauaa

SEQ ID NO: 15924 - RNA, 21 nt, Artificial Sequence
  Ebola virus siRNA sense strand
uaucuugaucauugugauaau

SEQ ID NO: 15925 - RNA, 21 nt, Artificial Sequence
  Ebola virus siRNA sense strand
aucuugaucauugugauaaua

SEQ ID NO: 15926 - RNA, 21 nt, Artificial Sequence
  Ebola virus siRNA sense strand
ucuugaucauugugauaauau

SEQ ID NO: 15927 - RNA, 21 nt, Artificial Sequence
  Ebola virus siRNA sense strand
cuugaucauugugauaauauc

SEQ ID NO: 15928 - RNA, 21 nt, Artificial Sequence
  Ebola virus siRNA sense strand
uugaucauugugauaauaucc

SEQ ID NO: 15929 - RNA, 21 nt, Artificial Sequence
  Ebola virus siRNA sense strand
ugaucauugugauaauauccu

SEQ ID NO: 15930 - RNA, 21 nt, Artificial Sequence
  Ebola virus siRNA sense strand
gaucauugugauaauauccug

SEQ ID NO: 15931 - RNA, 21 nt, Artificial Sequence
  Ebola virus siRNA sense strand
aucauugugauaauauccugg

SEQ ID NO: 15932 - RNA, 21 nt, Artificial Sequence
  Ebola virus siRNA sense strand
ucauugugauaauauccuggc

SEQ ID NO: 15933 - RNA, 21 nt, Artificial Sequence
  Ebola virus siRNA sense strand
cauugugauaauauccuggcg

SEQ ID NO: 15934 - RNA, 21 nt, Artificial Sequence
  Ebola virus siRNA sense strand
auugugauaauauccuggcgg

SEQ ID NO: 15935 - RNA, 21 nt, Artificial Sequence
  Ebola virus siRNA sense strand
uugugauaauauccuggcgga

SEQ ID NO: 15936 - RNA, 21 nt, Artificial Sequence
  Ebola virus siRNA sense strand
ugugauaauauccuggcggag

SEQ ID NO: 15937 - RNA, 21 nt, Artificial Sequence
  Ebola virus siRNA sense strand
gugauaauauccuggcggagg

SEQ ID NO: 15938 - RNA, 21 nt, Artificial Sequence
  Ebola virus siRNA sense strand
ugauaauauccuggcggaggc

SEQ ID NO: 15939 - RNA, 21 nt, Artificial Sequence
  Ebola virus siRNA sense strand
gauaauauccuggcggaggcu

SEQ ID NO: 15940 - RNA, 21 nt, Artificial Sequence
  Ebola virus siRNA sense strand
auaauauccuggcggaggcuu

SEQ ID NO: 15941 - RNA, 21 nt, Artificial Sequence
  Ebola virus siRNA sense strand
uaauauccuggcggaggcuuu

SEQ ID NO: 15942 - RNA, 21 nt, Artificial Sequence
  Ebola virus siRNA sense strand
aauauccuggcggaggcuuua

SEQ ID NO: 15943 - RNA, 21 nt, Artificial Sequence
  Ebola virus siRNA sense strand
auauccuggcggaggcuuuaa

SEQ ID NO: 15944 - RNA, 21 nt, Artificial Sequence
  Ebola virus siRNA sense strand
uauccuggcggaggcuuuaac

SEQ ID NO: 15945 - RNA, 21 nt, Artificial Sequence
  Ebola virus siRNA sense strand
auccuggcggaggcuuuaacc

SEQ ID NO: 15946 - RNA, 21 nt, Artificial Sequence
  Ebola virus siRNA sense strand
uccuggcggaggcuuuaaccc

SEQ ID NO: 15947 - RNA, 21 nt, Artificial Sequence
  Ebola virus siRNA sense strand
ccuggcggaggcuuuaaccca

SEQ ID NO: 15948 - RNA, 21 nt, Artificial Sequence
  Ebola virus siRNA sense strand
cuggcggaggcuuuaacccaa

SEQ ID NO: 15949 - RNA, 21 nt, Artificial Sequence
  Ebola virus siRNA sense strand
uggcggaggcuuuaacccaaa

SEQ ID NO: 15950 - RNA, 21 nt, Artificial Sequence
  Ebola virus siRNA sense strand
ggcggaggcuuuaacccaaau

SEQ ID NO: 15951 - RNA, 21 nt, Artificial Sequence
  Ebola virus siRNA sense strand
gcggaggcuuuaacccaaaua

SEQ ID NO: 15952 - RNA, 21 nt, Artificial Sequence
  Ebola virus siRNA sense strand
cggaggcuuuaacccaaauaa

SEQ ID NO: 15953 - RNA, 21 nt, Artificial Sequence
  Ebola virus siRNA sense strand
ggaggcuuuaacccaaauaac

SEQ ID NO: 15954 - RNA, 21 nt, Artificial Sequence
  Ebola virus siRNA sense strand
gaggcuuuaacccaaauaacu

SEQ ID NO: 15955 - RNA, 21 nt, Artificial Sequence
  Ebola virus siRNA sense strand
aggcuuuaacccaaauaacuu

SEQ ID NO: 15956 - RNA, 21 nt, Artificial Sequence
  Ebola virus siRNA sense strand
ggcuuuaacccaaauaacuug

SEQ ID NO: 15957 - RNA, 21 nt, Artificial Sequence
  Ebola virus siRNA sense strand
gcuuuaacccaaauaacuugc

SEQ ID NO: 15958 - RNA, 21 nt, Artificial Sequence
  Ebola virus siRNA sense strand
cuuuaacccaaauaacuugca

SEQ ID NO: 15959 - RNA, 21 nt, Artificial Sequence
  Ebola virus siRNA sense strand
uuuaacccaaauaacuugcac

SEQ ID NO: 15960 - RNA, 21 nt, Artificial Sequence
  Ebola virus siRNA sense strand
uuaacccaaauaacuugcaca

SEQ ID NO: 15961 - RNA, 21 nt, Artificial Sequence
  Ebola virus siRNA sense strand
uaacccaaauaacuugcacag

SEQ ID NO: 15962 - RNA, 21 nt, Artificial Sequence
  Ebola virus siRNA sense strand
aacccaaauaacuugcacagu

SEQ ID NO: 15963 - RNA, 21 nt, Artificial Sequence
  Ebola virus siRNA sense strand
acccaaauaacuugcacaguu

SEQ ID NO: 15964 - RNA, 21 nt, Artificial Sequence
  Ebola virus siRNA sense strand
cccaaauaacuugcacaguug

SEQ ID NO: 15965 - RNA, 21 nt, Artificial Sequence
  Ebola virus siRNA sense strand
ccaaauaacuugcacaguuga

SEQ ID NO: 15966 - RNA, 21 nt, Artificial Sequence
  Ebola virus siRNA sense strand
caaauaacuugcacaguugau

SEQ ID NO: 15967 - RNA, 21 nt, Artificial Sequence
  Ebola virus siRNA sense strand
aaauaacuugcacaguugauu

SEQ ID NO: 15968 - RNA, 21 nt, Artificial Sequence
  Ebola virus siRNA sense strand
aauaacuugcacaguugauuu

SEQ ID NO: 15969 - RNA, 21 nt, Artificial Sequence
  Ebola virus siRNA sense strand
auaacuugcacaguugauuua

SEQ ID NO: 15970 - RNA, 21 nt, Artificial Sequence
  Ebola virus siRNA sense strand
uaacuugcacaguugauuuag

SEQ ID NO: 15971 - RNA, 21 nt, Artificial Sequence
  Ebola virus siRNA sense strand
aacuugcacaguugauuuagc

SEQ ID NO: 15972 - RNA, 21 nt, Artificial Sequence
  Ebola virus siRNA sense strand
acuugcacaguugauuuagca

SEQ ID NO: 15973 - RNA, 21 nt, Artificial Sequence
  Ebola virus siRNA sense strand
cuugcacaguugauuuagcac

SEQ ID NO: 15974 - RNA, 21 nt, Artificial Sequence
  Ebola virus siRNA sense strand
uugcacaguugauuuagcaca

SEQ ID NO: 15975 - RNA, 21 nt, Artificial Sequence
  Ebola virus siRNA sense strand
ugcacaguugauuuagcacag

SEQ ID NO: 15976 - RNA, 21 nt, Artificial Sequence
  Ebola virus siRNA sense strand
gcacaguugauuuagcacaga

SEQ ID NO: 15977 - RNA, 21 nt, Artificial Sequence
  Ebola virus siRNA sense strand
cacaguugauuuagcacagau

SEQ ID NO: 15978 - RNA, 21 nt, Artificial Sequence
  Ebola virus siRNA sense strand
acaguugauuuagcacagauu

SEQ ID NO: 15979 - RNA, 21 nt, Artificial Sequence
  Ebola virus siRNA sense strand
caguugauuuagcacagauuc

SEQ ID NO: 15980 - RNA, 21 nt, Artificial Sequence
  Ebola virus siRNA sense strand
aguugauuuagcacagauucu

SEQ ID NO: 15981 - RNA, 21 nt, Artificial Sequence
  Ebola virus siRNA sense strand
guugauuuagcacagauucug

SEQ ID NO: 15982 - RNA, 21 nt, Artificial Sequence
  Ebola virus siRNA sense strand
uugauuuagcacagauucuga

SEQ ID NO: 15983 - RNA, 21 nt, Artificial Sequence
  Ebola virus siRNA sense strand
ugauuuagcacagauucugag

SEQ ID NO: 15984 - RNA, 21 nt, Artificial Sequence
  Ebola virus siRNA sense strand
gauuuagcacagauucugagg

SEQ ID NO: 15985 - RNA, 21 nt, Artificial Sequence
  Ebola virus siRNA sense strand
auuuagcacagauucugaggg

SEQ ID NO: 15986 - RNA, 21 nt, Artificial Sequence
  Ebola virus siRNA sense strand
uuuagcacagauucugaggga

SEQ ID NO: 15987 - RNA, 21 nt, Artificial Sequence
  Ebola virus siRNA sense strand
uuagcacagauucugagggaa

SEQ ID NO: 15988 - RNA, 21 nt, Artificial Sequence
  Ebola virus siRNA sense strand
uagcacagauucugagggaau

SEQ ID NO: 15989 - RNA, 21 nt, Artificial Sequence
  Ebola virus siRNA sense strand
agcacagauucugagggaaua

SEQ ID NO: 15990 - RNA, 21 nt, Artificial Sequence
  Ebola virus siRNA sense strand
gcacagauucugagggaauau

SEQ ID NO: 15991 - RNA, 21 nt, Artificial Sequence
  Ebola virus siRNA sense strand
cacagauucugagggaauauu

SEQ ID NO: 15992 - RNA, 21 nt, Artificial Sequence
  Ebola virus siRNA sense strand
acagauucugagggaauauuc

SEQ ID NO: 15993 - RNA, 21 nt, Artificial Sequence
  Ebola virus siRNA sense strand
cagauucugagggaauauuca

SEQ ID NO: 15994 - RNA, 21 nt, Artificial Sequence
  Ebola virus siRNA sense strand
agauucugagggaauauucau

SEQ ID NO: 15995 - RNA, 21 nt, Artificial Sequence
  Ebola virus siRNA sense strand
gauucugagggaauauucaug

SEQ ID NO: 15996 - RNA, 21 nt, Artificial Sequence
  Ebola virus siRNA sense strand
auucugagggaauauucaugg

SEQ ID NO: 15997 - RNA, 21 nt, Artificial Sequence
  Ebola virus siRNA sense strand
uucugagggaauauucauggg

SEQ ID NO: 15998 - RNA, 21 nt, Artificial Sequence
  Ebola virus siRNA sense strand
ucugagggaauauucaugggc

SEQ ID NO: 15999 - RNA, 21 nt, Artificial Sequence
  Ebola virus siRNA sense strand
cugagggaauauucaugggcu

SEQ ID NO: 16000 - RNA, 21 nt, Artificial Sequence
  Ebola virus siRNA sense strand
ugagggaauauucaugggcuc

SEQ ID NO: 16001 - RNA, 21 nt, Artificial Sequence
  Ebola virus siRNA sense strand
gagggaauauucaugggcuca

SEQ ID NO: 16002 - RNA, 21 nt, Artificial Sequence
  Ebola virus siRNA sense strand
agggaauauucaugggcucau

SEQ ID NO: 16003 - RNA, 21 nt, Artificial Sequence
  Ebola virus siRNA sense strand
gggaauauucaugggcucaua

SEQ ID NO: 16004 - RNA, 21 nt, Artificial Sequence
  Ebola virus siRNA sense strand
ggaauauucaugggcucauau

SEQ ID NO: 16005 - RNA, 21 nt, Artificial Sequence
  Ebola virus siRNA sense strand
gaauauucaugggcucauauu

SEQ ID NO: 16006 - RNA, 21 nt, Artificial Sequence
  Ebola virus siRNA sense strand
aauauucaugggcucauauuu

SEQ ID NO: 16007 - RNA, 21 nt, Artificial Sequence
  Ebola virus siRNA sense strand
auauucaugggcucauauuuu

SEQ ID NO: 16008 - RNA, 21 nt, Artificial Sequence
  Ebola virus siRNA sense strand
uauucaugggcucauauuuua

SEQ ID NO: 16009 - RNA, 21 nt, Artificial Sequence
  Ebola virus siRNA sense strand
auucaugggcucauauuuuag

SEQ ID NO: 16010 - RNA, 21 nt, Artificial Sequence
  Ebola virus siRNA sense strand
uucaugggcucauauuuuaga

SEQ ID NO: 16011 - RNA, 21 nt, Artificial Sequence
  Ebola virus siRNA sense strand
ucaugggcucauauuuuagag

SEQ ID NO: 16012 - RNA, 21 nt, Artificial Sequence
  Ebola virus siRNA sense strand
caugggcucauauuuuagagg

SEQ ID NO: 16013 - RNA, 21 nt, Artificial Sequence
  Ebola virus siRNA sense strand
augggcucauauuuuagaggg

SEQ ID NO: 16014 - RNA, 21 nt, Artificial Sequence
  Ebola virus siRNA sense strand
ugggcucauauuuuagaggga

SEQ ID NO: 16015 - RNA, 21 nt, Artificial Sequence
  Ebola virus siRNA sense strand
gggcucauauuuuagagggaa

SEQ ID NO: 16016 - RNA, 21 nt, Artificial Sequence
  Ebola virus siRNA sense strand
ggcucauauuuuagagggaag

SEQ ID NO: 16017 - RNA, 21 nt, Artificial Sequence
  Ebola virus siRNA sense strand
gcucauauuuuagagggaaga

SEQ ID NO: 16018 - RNA, 21 nt, Artificial Sequence
  Ebola virus siRNA sense strand
cucauauuuuagagggaagac

SEQ ID NO: 16019 - RNA, 21 nt, Artificial Sequence
  Ebola virus siRNA sense strand
ucauauuuuagagggaagacc

SEQ ID NO: 16020 - RNA, 21 nt, Artificial Sequence
  Ebola virus siRNA sense strand
cauauuuuagagggaagaccu

SEQ ID NO: 16021 - RNA, 21 nt, Artificial Sequence
  Ebola virus siRNA sense strand
auauuuuagagggaagaccuc

SEQ ID NO: 16022 - RNA, 21 nt, Artificial Sequence
  Ebola virus siRNA sense strand
uauuuuagagggaagaccucu

SEQ ID NO: 16023 - RNA, 21 nt, Artificial Sequence
  Ebola virus siRNA sense strand
auuuuagagggaagaccucuu

SEQ ID NO: 16024 - RNA, 21 nt, Artificial Sequence
  Ebola virus siRNA sense strand
uuuuagagggaagaccucuua

SEQ ID NO: 16025 - RNA, 21 nt, Artificial Sequence
  Ebola virus siRNA sense strand
uuuagagggaagaccucuuau

SEQ ID NO: 16026 - RNA, 21 nt, Artificial Sequence
  Ebola virus siRNA sense strand
uuagagggaagaccucuuauu

SEQ ID NO: 16027 - RNA, 21 nt, Artificial Sequence
  Ebola virus siRNA sense strand
uagagggaagaccucuuauug

SEQ ID NO: 16028 - RNA, 21 nt, Artificial Sequence
  Ebola virus siRNA sense strand
agagggaagaccucuuauugg

SEQ ID NO: 16029 - RNA, 21 nt, Artificial Sequence
  Ebola virus siRNA sense strand
gagggaagaccucuuauugga

SEQ ID NO: 16030 - RNA, 21 nt, Artificial Sequence
  Ebola virus siRNA sense strand
agggaagaccucuuauuggag

SEQ ID NO: 16031 - RNA, 21 nt, Artificial Sequence
  Ebola virus siRNA sense strand
gggaagaccucuuauuggagc

SEQ ID NO: 16032 - RNA, 21 nt, Artificial Sequence
  Ebola virus siRNA sense strand
ggaagaccucuuauuggagcc

SEQ ID NO: 16033 - RNA, 21 nt, Artificial Sequence
  Ebola virus siRNA sense strand
gaagaccucuuauuggagcca

SEQ ID NO: 16034 - RNA, 21 nt, Artificial Sequence
  Ebola virus siRNA sense strand
aagaccucuuauuggagccac

SEQ ID NO: 16035 - RNA, 21 nt, Artificial Sequence
  Ebola virus siRNA sense strand
agaccucuuauuggagccaca

SEQ ID NO: 16036 - RNA, 21 nt, Artificial Sequence
  Ebola virus siRNA sense strand
gaccucuuauuggagccacac

SEQ ID NO: 16037 - RNA, 21 nt, Artificial Sequence
  Ebola virus siRNA sense strand
accucuuauuggagccacacu

SEQ ID NO: 16038 - RNA, 21 nt, Artificial Sequence
  Ebola virus siRNA sense strand
ccucuuauuggagccacacuc

SEQ ID NO: 16039 - RNA, 21 nt, Artificial Sequence
  Ebola virus siRNA sense strand
cucuuauuggagccacacucc

SEQ ID NO: 16040 - RNA, 21 nt, Artificial Sequence
  Ebola virus siRNA sense strand
ucuuauuggagccacacuccc

SEQ ID NO: 16041 - RNA, 21 nt, Artificial Sequence
  Ebola virus siRNA sense strand
cuuauuggagccacacuccca

SEQ ID NO: 16042 - RNA, 21 nt, Artificial Sequence
  Ebola virus siRNA sense strand
uuauuggagccacacucccau

SEQ ID NO: 16043 - RNA, 21 nt, Artificial Sequence
  Ebola virus siRNA sense strand
uauuggagccacacucccaug

SEQ ID NO: 16044 - RNA, 21 nt, Artificial Sequence
  Ebola virus siRNA sense strand
auuggagccacacucccaugu

SEQ ID NO: 16045 - RNA, 21 nt, Artificial Sequence
  Ebola virus siRNA sense strand
uuggagccacacucccaugua

SEQ ID NO: 16046 - RNA, 21 nt, Artificial Sequence
  Ebola virus siRNA sense strand
uggagccacacucccauguau

SEQ ID NO: 16047 - RNA, 21 nt, Artificial Sequence
  Ebola virus siRNA sense strand
ggagccacacucccauguaug

SEQ ID NO: 16048 - RNA, 21 nt, Artificial Sequence
  Ebola virus siRNA sense strand
gagccacacucccauguauga

SEQ ID NO: 16049 - RNA, 21 nt, Artificial Sequence
  Ebola virus siRNA sense strand
agccacacucccauguaugau

SEQ ID NO: 16050 - RNA, 21 nt, Artificial Sequence
  Ebola virus siRNA sense strand
gccacacucccauguaugauu

SEQ ID NO: 16051 - RNA, 21 nt, Artificial Sequence
  Ebola virus siRNA sense strand
ccacacucccauguaugauug

SEQ ID NO: 16052 - RNA, 21 nt, Artificial Sequence
  Ebola virus siRNA sense strand
cacacucccauguaugauuga

SEQ ID NO: 16053 - RNA, 21 nt, Artificial Sequence
  Ebola virus siRNA sense strand
acacucccauguaugauugag

SEQ ID NO: 16054 - RNA, 21 nt, Artificial Sequence
  Ebola virus siRNA sense strand
cacucccauguaugauugagc

SEQ ID NO: 16055 - RNA, 21 nt, Artificial Sequence
  Ebola virus siRNA sense strand
acucccauguaugauugagca

SEQ ID NO: 16056 - RNA, 21 nt, Artificial Sequence
  Ebola virus siRNA sense strand
cucccauguaugauugagcaa

SEQ ID NO: 16057 - RNA, 21 nt, Artificial Sequence
  Ebola virus siRNA sense strand
ucccauguaugauugagcaau

SEQ ID NO: 16058 - RNA, 21 nt, Artificial Sequence
  Ebola virus siRNA sense strand
cccauguaugauugagcaauu

SEQ ID NO: 16059 - RNA, 21 nt, Artificial Sequence
  Ebola virus siRNA sense strand
ccauguaugauugagcaauuc

SEQ ID NO: 16060 - RNA, 21 nt, Artificial Sequence
  Ebola virus siRNA sense strand
cauguaugauugagcaauuca

SEQ ID NO: 16061 - RNA, 21 nt, Artificial Sequence
  Ebola virus siRNA sense strand
auguaugauugagcaauucaa

SEQ ID NO: 16062 - RNA, 21 nt, Artificial Sequence
  Ebola virus siRNA sense strand
uguaugauugagcaauucaaa

SEQ ID NO: 16063 - RNA, 21 nt, Artificial Sequence
  Ebola virus siRNA sense strand
guaugauugagcaauucaaag

SEQ ID NO: 16064 - RNA, 21 nt, Artificial Sequence
  Ebola virus siRNA sense strand
uaugauugagcaauucaaagu

SEQ ID NO: 16065 - RNA, 21 nt, Artificial Sequence
  Ebola virus siRNA sense strand
augauugagcaauucaaagug

SEQ ID NO: 16066 - RNA, 21 nt, Artificial Sequence
  Ebola virus siRNA sense strand
ugauugagcaauucaaagugu

SEQ ID NO: 16067 - RNA, 21 nt, Artificial Sequence
  Ebola virus siRNA sense strand
gauugagcaauucaaaguguu

SEQ ID NO: 16068 - RNA, 21 nt, Artificial Sequence
  Ebola virus siRNA sense strand
auugagcaauucaaaguguuu

SEQ ID NO: 16069 - RNA, 21 nt, Artificial Sequence
  Ebola virus siRNA sense strand
uugagcaauucaaaguguuuu

SEQ ID NO: 16070 - RNA, 21 nt, Artificial Sequence
  Ebola virus siRNA sense strand
ugagcaauucaaaguguuuug

SEQ ID NO: 16071 - RNA, 21 nt, Artificial Sequence
  Ebola virus siRNA sense strand
gagcaauucaaaguguuuugg

SEQ ID NO: 16072 - RNA, 21 nt, Artificial Sequence
  Ebola virus siRNA sense strand
agcaauucaaaguguuuuggc

SEQ ID NO: 16073 - RNA, 21 nt, Artificial Sequence
  Ebola virus siRNA sense strand
gcaauucaaaguguuuuggcu

SEQ ID NO: 16074 - RNA, 21 nt, Artificial Sequence
  Ebola virus siRNA sense strand
caauucaaaguguuuuggcug

SEQ ID NO: 16075 - RNA, 21 nt, Artificial Sequence
  Ebola virus siRNA sense strand
aauucaaaguguuuuggcuga

SEQ ID NO: 16076 - RNA, 21 nt, Artificial Sequence
  Ebola virus siRNA sense strand
auucaaaguguuuuggcugaa

SEQ ID NO: 16077 - RNA, 21 nt, Artificial Sequence
  Ebola virus siRNA sense strand
uucaaaguguuuuggcugaaa

SEQ ID NO: 16078 - RNA, 21 nt, Artificial Sequence
  Ebola virus siRNA sense strand
ucaaaguguuuuggcugaaac

SEQ ID NO: 16079 - RNA, 21 nt, Artificial Sequence
  Ebola virus siRNA sense strand
caaaguguuuuggcugaaacc

SEQ ID NO: 16080 - RNA, 21 nt, Artificial Sequence
  Ebola virus siRNA sense strand
aaaguguuuuggcugaaaccc

SEQ ID NO: 16081 - RNA, 21 nt, Artificial Sequence
  Ebola virus siRNA sense strand
aaguguuuuggcugaaacccu

SEQ ID NO: 16082 - RNA, 21 nt, Artificial Sequence
  Ebola virus siRNA sense strand
aguguuuuggcugaaacccua

SEQ ID NO: 16083 - RNA, 21 nt, Artificial Sequence
  Ebola virus siRNA sense strand
guguuuuggcugaaacccuac

SEQ ID NO: 16084 - RNA, 21 nt, Artificial Sequence
  Ebola virus siRNA sense strand
uguuuuggcugaaacccuacg

SEQ ID NO: 16085 - RNA, 21 nt, Artificial Sequence
  Ebola virus siRNA sense strand
guuuuggcugaaacccuacga

SEQ ID NO: 16086 - RNA, 21 nt, Artificial Sequence
  Ebola virus siRNA sense strand
uuuuggcugaaacccuacgaa

SEQ ID NO: 16087 - RNA, 21 nt, Artificial Sequence
  Ebola virus siRNA sense strand
uuuggcugaaacccuacgaac

SEQ ID NO: 16088 - RNA, 21 nt, Artificial Sequence
  Ebola virus siRNA sense strand
uuggcugaaacccuacgaaca

SEQ ID NO: 16089 - RNA, 21 nt, Artificial Sequence
  Ebola virus siRNA sense strand
uggcugaaacccuacgaacaa

SEQ ID NO: 16090 - RNA, 21 nt, Artificial Sequence
  Ebola virus siRNA sense strand
ggcugaaacccuacgaacaau

SEQ ID NO: 16091 - RNA, 21 nt, Artificial Sequence
  Ebola virus siRNA sense strand
gcugaaacccuacgaacaaug

SEQ ID NO: 16092 - RNA, 21 nt, Artificial Sequence
  Ebola virus siRNA sense strand
cugaaacccuacgaacaaugu

SEQ ID NO: 16093 - RNA, 21 nt, Artificial Sequence
  Ebola virus siRNA sense strand
ugaaacccuacgaacaauguc

SEQ ID NO: 16094 - RNA, 21 nt, Artificial Sequence
  Ebola virus siRNA sense strand
gaaacccuacgaacaaugucc

SEQ ID NO: 16095 - RNA, 21 nt, Artificial Sequence
  Ebola virus siRNA sense strand
aaacccuacgaacaauguccg

SEQ ID NO: 16096 - RNA, 21 nt, Artificial Sequence
  Ebola virus siRNA sense strand
aacccuacgaacaauguccgc

SEQ ID NO: 16097 - RNA, 21 nt, Artificial Sequence
  Ebola virus siRNA sense strand
acccuacgaacaauguccgca

SEQ ID NO: 16098 - RNA, 21 nt, Artificial Sequence
  Ebola virus siRNA sense strand
cccuacgaacaauguccgcag

SEQ ID NO: 16099 - RNA, 21 nt, Artificial Sequence
  Ebola virus siRNA sense strand
ccuacgaacaauguccgcagu

SEQ ID NO: 16100 - RNA, 21 nt, Artificial Sequence
  Ebola virus siRNA sense strand
cuacgaacaauguccgcagug

SEQ ID NO: 16101 - RNA, 21 nt, Artificial Sequence
  Ebola virus siRNA sense strand
uacgaacaauguccgcagugu

SEQ ID NO: 16102 - RNA, 21 nt, Artificial Sequence
  Ebola virus siRNA sense strand
acgaacaauguccgcaguguu

SEQ ID NO: 16103 - RNA, 21 nt, Artificial Sequence
  Ebola virus siRNA sense strand
cgaacaauguccgcaguguuc

SEQ ID NO: 16104 - RNA, 21 nt, Artificial Sequence
  Ebola virus siRNA sense strand
gaacaauguccgcaguguuca

SEQ ID NO: 16105 - RNA, 21 nt, Artificial Sequence
  Ebola virus siRNA sense strand
aacaauguccgcaguguucaa

SEQ ID NO: 16106 - RNA, 21 nt, Artificial Sequence
  Ebola virus siRNA sense strand
acaauguccgcaguguucaaa

SEQ ID NO: 16107 - RNA, 21 nt, Artificial Sequence
  Ebola virus siRNA sense strand
caauguccgcaguguucaaau

SEQ ID NO: 16108 - RNA, 21 nt, Artificial Sequence
  Ebola virus siRNA sense strand
aauguccgcaguguucaaaug

SEQ ID NO: 16109 - RNA, 21 nt, Artificial Sequence
  Ebola virus siRNA sense strand
auguccgcaguguucaaaugc

SEQ ID NO: 16110 - RNA, 21 nt, Artificial Sequence
  Ebola virus siRNA sense strand
uguccgcaguguucaaaugca

SEQ ID NO: 16111 - RNA, 21 nt, Artificial Sequence
  Ebola virus siRNA sense strand
guccgcaguguucaaaugcaa

SEQ ID NO: 16112 - RNA, 21 nt, Artificial Sequence
  Ebola virus siRNA sense strand
uccgcaguguucaaaugcaaa

SEQ ID NO: 16113 - RNA, 21 nt, Artificial Sequence
  Ebola virus siRNA sense strand
ccgcaguguucaaaugcaaag

SEQ ID NO: 16114 - RNA, 21 nt, Artificial Sequence
  Ebola virus siRNA sense strand
cgcaguguucaaaugcaaagc

SEQ ID NO: 16115 - RNA, 21 nt, Artificial Sequence
  Ebola virus siRNA sense strand
gcaguguucaaaugcaaagca

SEQ ID NO: 16116 - RNA, 21 nt, Artificial Sequence
  Ebola virus siRNA sense strand
caguguucaaaugcaaagcaa

SEQ ID NO: 16117 - RNA, 21 nt, Artificial Sequence
  Ebola virus siRNA sense strand
aguguucaaaugcaaagcaac

SEQ ID NO: 16118 - RNA, 21 nt, Artificial Sequence
  Ebola virus siRNA sense strand
guguucaaaugcaaagcaacc

SEQ ID NO: 16119 - RNA, 21 nt, Artificial Sequence
  Ebola virus siRNA sense strand
uguucaaaugcaaagcaacca

SEQ ID NO: 16120 - RNA, 21 nt, Artificial Sequence
  Ebola virus siRNA sense strand
guucaaaugcaaagcaaccag

SEQ ID NO: 16121 - RNA, 21 nt, Artificial Sequence
  Ebola virus siRNA sense strand
uucaaaugcaaagcaaccagg

SEQ ID NO: 16122 - RNA, 21 nt, Artificial Sequence
  Ebola virus siRNA sense strand
ucaaaugcaaagcaaccaggu

SEQ ID NO: 16123 - RNA, 21 nt, Artificial Sequence
  Ebola virus siRNA sense strand
caaaugcaaagcaaccaggug

SEQ ID NO: 16124 - RNA, 21 nt, Artificial Sequence
  Ebola virus siRNA sense strand
aaaugcaaagcaaccaggugg

SEQ ID NO: 16125 - RNA, 21 nt, Artificial Sequence
  Ebola virus siRNA sense strand
aaugcaaagcaaccagguggg

SEQ ID NO: 16126 - RNA, 21 nt, Artificial Sequence
  Ebola virus siRNA sense strand
augcaaagcaaccagguggga

SEQ ID NO: 16127 - RNA, 21 nt, Artificial Sequence
  Ebola virus siRNA sense strand
ugcaaagcaaccaggugggaa

SEQ ID NO: 16128 - RNA, 21 nt, Artificial Sequence
  Ebola virus siRNA sense strand
gcaaagcaaccaggugggaaa

SEQ ID NO: 16129 - RNA, 21 nt, Artificial Sequence
  Ebola virus siRNA sense strand
caaagcaaccaggugggaaac

SEQ ID NO: 16130 - RNA, 21 nt, Artificial Sequence
  Ebola virus siRNA sense strand
aaagcaaccaggugggaaacc

SEQ ID NO: 16131 - RNA, 21 nt, Artificial Sequence
  Ebola virus siRNA sense strand
aagcaaccaggugggaaacca

SEQ ID NO: 16132 - RNA, 21 nt, Artificial Sequence
  Ebola virus siRNA sense strand
agcaaccaggugggaaaccau

SEQ ID NO: 16133 - RNA, 21 nt, Artificial Sequence
  Ebola virus siRNA sense strand
gcaaccaggugggaaaccauu

SEQ ID NO: 16134 - RNA, 21 nt, Artificial Sequence
  Ebola virus siRNA sense strand
caaccaggugggaaaccauuc

SEQ ID NO: 16135 - RNA, 21 nt, Artificial Sequence
  Ebola virus siRNA sense strand
aaccaggugggaaaccauucg

SEQ ID NO: 16136 - RNA, 21 nt, Artificial Sequence
  Ebola virus siRNA sense strand
accaggugggaaaccauucgu

SEQ ID NO: 16137 - RNA, 21 nt, Artificial Sequence
  Ebola virus siRNA sense strand
ccaggugggaaaccauucgug

SEQ ID NO: 16138 - RNA, 21 nt, Artificial Sequence
  Ebola virus siRNA sense strand
caggugggaaaccauucgugu

SEQ ID NO: 16139 - RNA, 21 nt, Artificial Sequence
  Ebola virus siRNA sense strand
aggugggaaaccauucguguc

SEQ ID NO: 16140 - RNA, 21 nt, Artificial Sequence
  Ebola virus siRNA sense strand
ggugggaaaccauucguguca

SEQ ID NO: 16141 - RNA, 21 nt, Artificial Sequence
  Ebola virus siRNA sense strand
gugggaaaccauucgugucag

SEQ ID NO: 16142 - RNA, 21 nt, Artificial Sequence
  Ebola virus siRNA sense strand
ugggaaaccauucgugucagu

SEQ ID NO: 16143 - RNA, 21 nt, Artificial Sequence
  Ebola virus siRNA sense strand
gggaaaccauucgugucagug

SEQ ID NO: 16144 - RNA, 21 nt, Artificial Sequence
  Ebola virus siRNA sense strand
ggaaaccauucgugucagugg

SEQ ID NO: 16145 - RNA, 21 nt, Artificial Sequence
  Ebola virus siRNA sense strand
gaaaccauucgugucaguggc

SEQ ID NO: 16146 - RNA, 21 nt, Artificial Sequence
  Ebola virus siRNA sense strand
aaaccauucgugucaguggca

SEQ ID NO: 16147 - RNA, 21 nt, Artificial Sequence
  Ebola virus siRNA sense strand
aaccauucgugucaguggcag

SEQ ID NO: 16148 - RNA, 21 nt, Artificial Sequence
  Ebola virus siRNA sense strand
accauucgugucaguggcagu

SEQ ID NO: 16149 - RNA, 21 nt, Artificial Sequence
  Ebola virus siRNA sense strand
ccauucgugucaguggcaguc

SEQ ID NO: 16150 - RNA, 21 nt, Artificial Sequence
  Ebola virus siRNA sense strand
cauucgugucaguggcaguca

SEQ ID NO: 16151 - RNA, 21 nt, Artificial Sequence
  Ebola virus siRNA sense strand
auucgugucaguggcagucaa

SEQ ID NO: 16152 - RNA, 21 nt, Artificial Sequence
  Ebola virus siRNA sense strand
uucgugucaguggcagucaag

SEQ ID NO: 16153 - RNA, 21 nt, Artificial Sequence
  Ebola virus siRNA sense strand
ucgugucaguggcagucaaga

SEQ ID NO: 16154 - RNA, 21 nt, Artificial Sequence
  Ebola virus siRNA sense strand
cgugucaguggcagucaagaa

SEQ ID NO: 16155 - RNA, 21 nt, Artificial Sequence
  Ebola virus siRNA sense strand
gugucaguggcagucaagaaa

SEQ ID NO: 16156 - RNA, 21 nt, Artificial Sequence
  Ebola virus siRNA sense strand
ugucaguggcagucaagaaac

SEQ ID NO: 16157 - RNA, 21 nt, Artificial Sequence
  Ebola virus siRNA sense strand
gucaguggcagucaagaaaca

SEQ ID NO: 16158 - RNA, 21 nt, Artificial Sequence
  Ebola virus siRNA sense strand
ucaguggcagucaagaaacau

SEQ ID NO: 16159 - RNA, 21 nt, Artificial Sequence
  Ebola virus siRNA sense strand
caguggcagucaagaaacaua

SEQ ID NO: 16160 - RNA, 21 nt, Artificial Sequence
  Ebola virus siRNA sense strand
aguggcagucaagaaacauau

SEQ ID NO: 16161 - RNA, 21 nt, Artificial Sequence
  Ebola virus siRNA sense strand
guggcagucaagaaacauauu

SEQ ID NO: 16162 - RNA, 21 nt, Artificial Sequence
  Ebola virus siRNA sense strand
uggcagucaagaaacauauug

SEQ ID NO: 16163 - RNA, 21 nt, Artificial Sequence
  Ebola virus siRNA sense strand
ggcagucaagaaacauauugu

SEQ ID NO: 16164 - RNA, 21 nt, Artificial Sequence
  Ebola virus siRNA sense strand
gcagucaagaaacauauuguu

SEQ ID NO: 16165 - RNA, 21 nt, Artificial Sequence
  Ebola virus siRNA sense strand
cagucaagaaacauauuguua

SEQ ID NO: 16166 - RNA, 21 nt, Artificial Sequence
  Ebola virus siRNA sense strand
agucaagaaacauauuguuag

SEQ ID NO: 16167 - RNA, 21 nt, Artificial Sequence
  Ebola virus siRNA sense strand
gucaagaaacauauuguuagu

SEQ ID NO: 16168 - RNA, 21 nt, Artificial Sequence
  Ebola virus siRNA sense strand
ucaagaaacauauuguuagug

SEQ ID NO: 16169 - RNA, 21 nt, Artificial Sequence
  Ebola virus siRNA sense strand
caagaaacauauuguuagugc

SEQ ID NO: 16170 - RNA, 21 nt, Artificial Sequence
  Ebola virus siRNA sense strand
aagaaacauauuguuagugca

SEQ ID NO: 16171 - RNA, 21 nt, Artificial Sequence
  Ebola virus siRNA sense strand
agaaacauauuguuagugcau

SEQ ID NO: 16172 - RNA, 21 nt, Artificial Sequence
  Ebola virus siRNA sense strand
gaaacauauuguuagugcaug

SEQ ID NO: 16173 - RNA, 21 nt, Artificial Sequence
  Ebola virus siRNA sense strand
aaacauauuguuagugcaugg

SEQ ID NO: 16174 - RNA, 21 nt, Artificial Sequence
  Ebola virus siRNA sense strand
aacauauuguuagugcauggc

SEQ ID NO: 16175 - RNA, 21 nt, Artificial Sequence
  Ebola virus siRNA sense strand
acauauuguuagugcauggcc

SEQ ID NO: 16176 - RNA, 21 nt, Artificial Sequence
  Ebola virus siRNA sense strand
cauauuguuagugcauggccg

SEQ ID NO: 16177 - RNA, 21 nt, Artificial Sequence
  Ebola virus siRNA sense strand
auauuguuagugcauggccga

SEQ ID NO: 16178 - RNA, 21 nt, Artificial Sequence
  Ebola virus siRNA sense strand
uauuguuagugcauggccgaa

SEQ ID NO: 16179 - RNA, 21 nt, Artificial Sequence
  Ebola virus siRNA sense strand
auuguuagugcauggccgaac

SEQ ID NO: 16180 - RNA, 21 nt, Artificial Sequence
  Ebola virus siRNA sense strand
uuguuagugcauggccgaacg

SEQ ID NO: 16181 - RNA, 21 nt, Artificial Sequence
  Ebola virus siRNA sense strand
uguuagugcauggccgaacgc

SEQ ID NO: 16182 - RNA, 21 nt, Artificial Sequence
  Ebola virus siRNA sense strand
guuagugcauggccgaacgca

SEQ ID NO: 16183 - RNA, 21 nt, Artificial Sequence
  Ebola virus siRNA sense strand
uuagugcauggccgaacgcau

SEQ ID NO: 16184 - RNA, 21 nt, Artificial Sequence
  Ebola virus siRNA sense strand
uagugcauggccgaacgcauc

SEQ ID NO: 16185 - RNA, 21 nt, Artificial Sequence
  Ebola virus siRNA sense strand
agugcauggccgaacgcaucc

SEQ ID NO: 16186 - RNA, 21 nt, Artificial Sequence
  Ebola virus siRNA sense strand
gugcauggccgaacgcauccc

SEQ ID NO: 16187 - RNA, 21 nt, Artificial Sequence
  Ebola virus siRNA sense strand
ugcauggccgaacgcaucccg

SEQ ID NO: 16188 - RNA, 21 nt, Artificial Sequence
  Ebola virus siRNA sense strand
gcauggccgaacgcaucccga

SEQ ID NO: 16189 - RNA, 21 nt, Artificial Sequence
  Ebola virus siRNA sense strand
cauggccgaacgcaucccgaa

SEQ ID NO: 16190 - RNA, 21 nt, Artificial Sequence
  Ebola virus siRNA sense strand
auggccgaacgcaucccgaau

SEQ ID NO: 16191 - RNA, 21 nt, Artificial Sequence
  Ebola virus siRNA sense strand
uggccgaacgcaucccgaaua

SEQ ID NO: 16192 - RNA, 21 nt, Artificial Sequence
  Ebola virus siRNA sense strand
ggccgaacgcaucccgaauaa

SEQ ID NO: 16193 - RNA, 21 nt, Artificial Sequence
  Ebola virus siRNA sense strand
gccgaacgcaucccgaauaag

SEQ ID NO: 16194 - RNA, 21 nt, Artificial Sequence
  Ebola virus siRNA sense strand
ccgaacgcaucccgaauaagc

SEQ ID NO: 16195 - RNA, 21 nt, Artificial Sequence
  Ebola virus siRNA sense strand
cgaacgcaucccgaauaagcu

SEQ ID NO: 16196 - RNA, 21 nt, Artificial Sequence
  Ebola virus siRNA sense strand
gaacgcaucccgaauaagcug

SEQ ID NO: 16197 - RNA, 21 nt, Artificial Sequence
  Ebola virus siRNA sense strand
aacgcaucccgaauaagcugg

SEQ ID NO: 16198 - RNA, 21 nt, Artificial Sequence
  Ebola virus siRNA sense strand
acgcaucccgaauaagcugga

SEQ ID NO: 16199 - RNA, 21 nt, Artificial Sequence
  Ebola virus siRNA sense strand
cgcaucccgaauaagcuggac

SEQ ID NO: 16200 - RNA, 21 nt, Artificial Sequence
  Ebola virus siRNA sense strand
gcaucccgaauaagcuggacu

SEQ ID NO: 16201 - RNA, 21 nt, Artificial Sequence
  Ebola virus siRNA sense strand
caucccgaauaagcuggacua

SEQ ID NO: 16202 - RNA, 21 nt, Artificial Sequence
  Ebola virus siRNA sense strand
aucccgaauaagcuggacuau

SEQ ID NO: 16203 - RNA, 21 nt, Artificial Sequence
  Ebola virus siRNA sense strand
ucccgaauaagcuggacuauc

SEQ ID NO: 16204 - RNA, 21 nt, Artificial Sequence
  Ebola virus siRNA sense strand
cccgaauaagcuggacuaucg

SEQ ID NO: 16205 - RNA, 21 nt, Artificial Sequence
  Ebola virus siRNA sense strand
ccgaauaagcuggacuaucgg

SEQ ID NO: 16206 - RNA, 21 nt, Artificial Sequence
  Ebola virus siRNA sense strand
cgaauaagcuggacuaucggg

SEQ ID NO: 16207 - RNA, 21 nt, Artificial Sequence
  Ebola virus siRNA sense strand
gaauaagcuggacuaucgggg

SEQ ID NO: 16208 - RNA, 21 nt, Artificial Sequence
  Ebola virus siRNA sense strand
aauaagcuggacuaucgggga

SEQ ID NO: 16209 - RNA, 21 nt, Artificial Sequence
  Ebola virus siRNA sense strand
auaagcuggacuaucggggau

SEQ ID NO: 16210 - RNA, 21 nt, Artificial Sequence
  Ebola virus siRNA sense strand
uaagcuggacuaucggggaug

SEQ ID NO: 16211 - RNA, 21 nt, Artificial Sequence
  Ebola virus siRNA sense strand
aagcuggacuaucggggaugg

SEQ ID NO: 16212 - RNA, 21 nt, Artificial Sequence
  Ebola virus siRNA sense strand
agcuggacuaucggggaugga

SEQ ID NO: 16213 - RNA, 21 nt, Artificial Sequence
  Ebola virus siRNA sense strand
gcuggacuaucggggauggaa

SEQ ID NO: 16214 - RNA, 21 nt, Artificial Sequence
  Ebola virus siRNA sense strand
cuggacuaucggggauggaau

SEQ ID NO: 16215 - RNA, 21 nt, Artificial Sequence
  Ebola virus siRNA sense strand
uggacuaucggggauggaauc

SEQ ID NO: 16216 - RNA, 21 nt, Artificial Sequence
  Ebola virus siRNA sense strand
ggacuaucggggauggaaucc

SEQ ID NO: 16217 - RNA, 21 nt, Artificial Sequence
  Ebola virus siRNA sense strand
gacuaucggggauggaauccc

SEQ ID NO: 16218 - RNA, 21 nt, Artificial Sequence
  Ebola virus siRNA sense strand
acuaucggggauggaauccca

SEQ ID NO: 16219 - RNA, 21 nt, Artificial Sequence
  Ebola virus siRNA sense strand
cuaucggggauggaaucccau

SEQ ID NO: 16220 - RNA, 21 nt, Artificial Sequence
  Ebola virus siRNA sense strand
uaucggggauggaaucccaua

SEQ ID NO: 16221 - RNA, 21 nt, Artificial Sequence
  Ebola virus siRNA sense strand
aucggggauggaaucccauac

SEQ ID NO: 16222 - RNA, 21 nt, Artificial Sequence
  Ebola virus siRNA sense strand
ucggggauggaaucccauaca

SEQ ID NO: 16223 - RNA, 21 nt, Artificial Sequence
  Ebola virus siRNA sense strand
cggggauggaaucccauacau

SEQ ID NO: 16224 - RNA, 21 nt, Artificial Sequence
  Ebola virus siRNA sense strand
ggggauggaaucccauacauu

SEQ ID NO: 16225 - RNA, 21 nt, Artificial Sequence
  Ebola virus siRNA sense strand
gggauggaaucccauacauug

SEQ ID NO: 16226 - RNA, 21 nt, Artificial Sequence
  Ebola virus siRNA sense strand
ggauggaaucccauacauugg

SEQ ID NO: 16227 - RNA, 21 nt, Artificial Sequence
  Ebola virus siRNA sense strand
gauggaaucccauacauugga

SEQ ID NO: 16228 - RNA, 21 nt, Artificial Sequence
  Ebola virus siRNA sense strand
auggaaucccauacauuggau

SEQ ID NO: 16229 - RNA, 21 nt, Artificial Sequence
  Ebola virus siRNA sense strand
uggaaucccauacauuggauc

SEQ ID NO: 16230 - RNA, 21 nt, Artificial Sequence
  Ebola virus siRNA sense strand
ggaaucccauacauuggauca

SEQ ID NO: 16231 - RNA, 21 nt, Artificial Sequence
  Ebola virus siRNA sense strand
gaaucccauacauuggaucaa

SEQ ID NO: 16232 - RNA, 21 nt, Artificial Sequence
  Ebola virus siRNA sense strand
aaucccauacauuggaucaag

SEQ ID NO: 16233 - RNA, 21 nt, Artificial Sequence
  Ebola virus siRNA sense strand
aucccauacauuggaucaagg

SEQ ID NO: 16234 - RNA, 21 nt, Artificial Sequence
  Ebola virus siRNA sense strand
ucccauacauuggaucaagga

SEQ ID NO: 16235 - RNA, 21 nt, Artificial Sequence
  Ebola virus siRNA sense strand
cccauacauuggaucaaggac

SEQ ID NO: 16236 - RNA, 21 nt, Artificial Sequence
  Ebola virus siRNA sense strand
ccauacauuggaucaaggaca

SEQ ID NO: 16237 - RNA, 21 nt, Artificial Sequence
  Ebola virus siRNA sense strand
cauacauuggaucaaggacag

SEQ ID NO: 16238 - RNA, 21 nt, Artificial Sequence
  Ebola virus siRNA sense strand
auacauuggaucaaggacaga

SEQ ID NO: 16239 - RNA, 21 nt, Artificial Sequence
  Ebola virus siRNA sense strand
uacauuggaucaaggacagaa

SEQ ID NO: 16240 - RNA, 21 nt, Artificial Sequence
  Ebola virus siRNA sense strand
acauuggaucaaggacagaag

SEQ ID NO: 16241 - RNA, 21 nt, Artificial Sequence
  Ebola virus siRNA sense strand
cauuggaucaaggacagaaga

SEQ ID NO: 16242 - RNA, 21 nt, Artificial Sequence
  Ebola virus siRNA sense strand
auuggaucaaggacagaagau

SEQ ID NO: 16243 - RNA, 21 nt, Artificial Sequence
  Ebola virus siRNA sense strand
uuggaucaaggacagaagaua

SEQ ID NO: 16244 - RNA, 21 nt, Artificial Sequence
  Ebola virus siRNA sense strand
uggaucaaggacagaagauaa

SEQ ID NO: 16245 - RNA, 21 nt, Artificial Sequence
  Ebola virus siRNA sense strand
ggaucaaggacagaagauaag

SEQ ID NO: 16246 - RNA, 21 nt, Artificial Sequence
  Ebola virus siRNA sense strand
gaucaaggacagaagauaaga

SEQ ID NO: 16247 - RNA, 21 nt, Artificial Sequence
  Ebola virus siRNA sense strand
aucaaggacagaagauaagau

SEQ ID NO: 16248 - RNA, 21 nt, Artificial Sequence
  Ebola virus siRNA sense strand
ucaaggacagaagauaagaua

SEQ ID NO: 16249 - RNA, 21 nt, Artificial Sequence
  Ebola virus siRNA sense strand
caaggacagaagauaagauag

SEQ ID NO: 16250 - RNA, 21 nt, Artificial Sequence
  Ebola virus siRNA sense strand
aaggacagaagauaagauagg

SEQ ID NO: 16251 - RNA, 21 nt, Artificial Sequence
  Ebola virus siRNA sense strand
aggacagaagauaagauagga

SEQ ID NO: 16252 - RNA, 21 nt, Artificial Sequence
  Ebola virus siRNA sense strand
ggacagaagauaagauaggac

SEQ ID NO: 16253 - RNA, 21 nt, Artificial Sequence
  Ebola virus siRNA sense strand
gacagaagauaagauaggaca

SEQ ID NO: 16254 - RNA, 21 nt, Artificial Sequence
  Ebola virus siRNA sense strand
acagaagauaagauaggacaa

SEQ ID NO: 16255 - RNA, 21 nt, Artificial Sequence
  Ebola virus siRNA sense strand
cagaagauaagauaggacaac

SEQ ID NO: 16256 - RNA, 21 nt, Artificial Sequence
  Ebola virus siRNA sense strand
agaagauaagauaggacaacc

SEQ ID NO: 16257 - RNA, 21 nt, Artificial Sequence
  Ebola virus siRNA sense strand
gaagauaagauaggacaaccu

SEQ ID NO: 16258 - RNA, 21 nt, Artificial Sequence
  Ebola virus siRNA sense strand
aagauaagauaggacaaccug

SEQ ID NO: 16259 - RNA, 21 nt, Artificial Sequence
  Ebola virus siRNA sense strand
agauaagauaggacaaccugc

SEQ ID NO: 16260 - RNA, 21 nt, Artificial Sequence
  Ebola virus siRNA sense strand
gauaagauaggacaaccugcu

SEQ ID NO: 16261 - RNA, 21 nt, Artificial Sequence
  Ebola virus siRNA sense strand
auaagauaggacaaccugcua

SEQ ID NO: 16262 - RNA, 21 nt, Artificial Sequence
  Ebola virus siRNA sense strand
uaagauaggacaaccugcuau

SEQ ID NO: 16263 - RNA, 21 nt, Artificial Sequence
  Ebola virus siRNA sense strand
aagauaggacaaccugcuauu

SEQ ID NO: 16264 - RNA, 21 nt, Artificial Sequence
  Ebola virus siRNA sense strand
agauaggacaaccugcuauua

SEQ ID NO: 16265 - RNA, 21 nt, Artificial Sequence
  Ebola virus siRNA sense strand
gauaggacaaccugcuauuaa

SEQ ID NO: 16266 - RNA, 21 nt, Artificial Sequence
  Ebola virus siRNA sense strand
auaggacaaccugcuauuaaa

SEQ ID NO: 16267 - RNA, 21 nt, Artificial Sequence
  Ebola virus siRNA sense strand
uaggacaaccugcuauuaaac

SEQ ID NO: 16268 - RNA, 21 nt, Artificial Sequence
  Ebola virus siRNA sense strand
aggacaaccugcuauuaaacc

SEQ ID NO: 16269 - RNA, 21 nt, Artificial Sequence
  Ebola virus siRNA sense strand
ggacaaccugcuauuaaacca

SEQ ID NO: 16270 - RNA, 21 nt, Artificial Sequence
  Ebola virus siRNA sense strand
gacaaccugcuauuaaaccaa

SEQ ID NO: 16271 - RNA, 21 nt, Artificial Sequence
  Ebola virus siRNA sense strand
acaaccugcuauuaaaccaaa

SEQ ID NO: 16272 - RNA, 21 nt, Artificial Sequence
  Ebola virus siRNA sense strand
caaccugcuauuaaaccaaaa

SEQ ID NO: 16273 - RNA, 21 nt, Artificial Sequence
  Ebola virus siRNA sense strand
aaccugcuauuaaaccaaaau

SEQ ID NO: 16274 - RNA, 21 nt, Artificial Sequence
  Ebola virus siRNA sense strand
accugcuauuaaaccaaaaug

SEQ ID NO: 16275 - RNA, 21 nt, Artificial Sequence
  Ebola virus siRNA sense strand
ccugcuauuaaaccaaaaugu

SEQ ID NO: 16276 - RNA, 21 nt, Artificial Sequence
  Ebola virus siRNA sense strand
cugcuauuaaaccaaaauguc

SEQ ID NO: 16277 - RNA, 21 nt, Artificial Sequence
  Ebola virus siRNA sense strand
ugcuauuaaaccaaaaugucc

SEQ ID NO: 16278 - RNA, 21 nt, Artificial Sequence
  Ebola virus siRNA sense strand
gcuauuaaaccaaaauguccu

SEQ ID NO: 16279 - RNA, 21 nt, Artificial Sequence
  Ebola virus siRNA sense strand
cuauuaaaccaaaauguccuu

SEQ ID NO: 16280 - RNA, 21 nt, Artificial Sequence
  Ebola virus siRNA sense strand
uauuaaaccaaaauguccuuc

SEQ ID NO: 16281 - RNA, 21 nt, Artificial Sequence
  Ebola virus siRNA sense strand
auuaaaccaaaauguccuucc

SEQ ID NO: 16282 - RNA, 21 nt, Artificial Sequence
  Ebola virus siRNA sense strand
uuaaaccaaaauguccuuccg

SEQ ID NO: 16283 - RNA, 21 nt, Artificial Sequence
  Ebola virus siRNA sense strand
uaaaccaaaauguccuuccgc

SEQ ID NO: 16284 - RNA, 21 nt, Artificial Sequence
  Ebola virus siRNA sense strand
aaaccaaaauguccuuccgca

SEQ ID NO: 16285 - RNA, 21 nt, Artificial Sequence
  Ebola virus siRNA sense strand
aaccaaaauguccuuccgcag

SEQ ID NO: 16286 - RNA, 21 nt, Artificial Sequence
  Ebola virus siRNA sense strand
accaaaauguccuuccgcagc

SEQ ID NO: 16287 - RNA, 21 nt, Artificial Sequence
  Ebola virus siRNA sense strand
ccaaaauguccuuccgcagcc

SEQ ID NO: 16288 - RNA, 21 nt, Artificial Sequence
  Ebola virus siRNA sense strand
caaaauguccuuccgcagccu

SEQ ID NO: 16289 - RNA, 21 nt, Artificial Sequence
  Ebola virus siRNA sense strand
aaaauguccuuccgcagccuu

SEQ ID NO: 16290 - RNA, 21 nt, Artificial Sequence
  Ebola virus siRNA sense strand
aaauguccuuccgcagccuua

SEQ ID NO: 16291 - RNA, 21 nt, Artificial Sequence
  Ebola virus siRNA sense strand
aauguccuuccgcagccuuaa

SEQ ID NO: 16292 - RNA, 21 nt, Artificial Sequence
  Ebola virus siRNA sense strand
auguccuuccgcagccuuaag

SEQ ID NO: 16293 - RNA, 21 nt, Artificial Sequence
  Ebola virus siRNA sense strand
uguccuuccgcagccuuaaga

SEQ ID NO: 16294 - RNA, 21 nt, Artificial Sequence
  Ebola virus siRNA sense strand
guccuuccgcagccuuaagag

SEQ ID NO: 16295 - RNA, 21 nt, Artificial Sequence
  Ebola virus siRNA sense strand
uccuuccgcagccuuaagaga

SEQ ID NO: 16296 - RNA, 21 nt, Artificial Sequence
  Ebola virus siRNA sense strand
ccuuccgcagccuuaagagag

SEQ ID NO: 16297 - RNA, 21 nt, Artificial Sequence
  Ebola virus siRNA sense strand
cuuccgcagccuuaagagagg

SEQ ID NO: 16298 - RNA, 21 nt, Artificial Sequence
  Ebola virus siRNA sense strand
uuccgcagccuuaagagaggc

SEQ ID NO: 16299 - RNA, 21 nt, Artificial Sequence
  Ebola virus siRNA sense strand
uccgcagccuuaagagaggcc

SEQ ID NO: 16300 - RNA, 21 nt, Artificial Sequence
  Ebola virus siRNA sense strand
ccgcagccuuaagagaggcca

SEQ ID NO: 16301 - RNA, 21 nt, Artificial Sequence
  Ebola virus siRNA sense strand
cgcagccuuaagagaggccau

SEQ ID NO: 16302 - RNA, 21 nt, Artificial Sequence
  Ebola virus siRNA sense strand
gcagccuuaagagaggccauu

SEQ ID NO: 16303 - RNA, 21 nt, Artificial Sequence
  Ebola virus siRNA sense strand
cagccuuaagagaggccauug

SEQ ID NO: 16304 - RNA, 21 nt, Artificial Sequence
  Ebola virus siRNA sense strand
agccuuaagagaggccauuga

SEQ ID NO: 16305 - RNA, 21 nt, Artificial Sequence
  Ebola virus siRNA sense strand
gccuuaagagaggccauugaa

SEQ ID NO: 16306 - RNA, 21 nt, Artificial Sequence
  Ebola virus siRNA sense strand
ccuuaagagaggccauugaau

SEQ ID NO: 16307 - RNA, 21 nt, Artificial Sequence
  Ebola virus siRNA sense strand
cuuaagagaggccauugaauu

SEQ ID NO: 16308 - RNA, 21 nt, Artificial Sequence
  Ebola virus siRNA sense strand
uuaagagaggccauugaauug

SEQ ID NO: 16309 - RNA, 21 nt, Artificial Sequence
  Ebola virus siRNA sense strand
uaagagaggccauugaauugg

SEQ ID NO: 16310 - RNA, 21 nt, Artificial Sequence
  Ebola virus siRNA sense strand
aagagaggccauugaauuggc

SEQ ID NO: 16311 - RNA, 21 nt, Artificial Sequence
  Ebola virus siRNA sense strand
agagaggccauugaauuggcg

SEQ ID NO: 16312 - RNA, 21 nt, Artificial Sequence
  Ebola virus siRNA sense strand
gagaggccauugaauuggcgu

SEQ ID NO: 16313 - RNA, 21 nt, Artificial Sequence
  Ebola virus siRNA sense strand
agaggccauugaauuggcguc

SEQ ID NO: 16314 - RNA, 21 nt, Artificial Sequence
  Ebola virus siRNA sense strand
gaggccauugaauuggcgucc

SEQ ID NO: 16315 - RNA, 21 nt, Artificial Sequence
  Ebola virus siRNA sense strand
aggccauugaauuggcguccc

SEQ ID NO: 16316 - RNA, 21 nt, Artificial Sequence
  Ebola virus siRNA sense strand
ggccauugaauuggcgucccg

SEQ ID NO: 16317 - RNA, 21 nt, Artificial Sequence
  Ebola virus siRNA sense strand
gccauugaauuggcgucccgu

SEQ ID NO: 16318 - RNA, 21 nt, Artificial Sequence
  Ebola virus siRNA sense strand
ccauugaauuggcgucccguu

SEQ ID NO: 16319 - RNA, 21 nt, Artificial Sequence
  Ebola virus siRNA sense strand
cauugaauuggcgucccguuu

SEQ ID NO: 16320 - RNA, 21 nt, Artificial Sequence
  Ebola virus siRNA sense strand
auugaauuggcgucccguuua

SEQ ID NO: 16321 - RNA, 21 nt, Artificial Sequence
  Ebola virus siRNA sense strand
uugaauuggcgucccguuuaa

SEQ ID NO: 16322 - RNA, 21 nt, Artificial Sequence
  Ebola virus siRNA sense strand
ugaauuggcgucccguuuaac

SEQ ID NO: 16323 - RNA, 21 nt, Artificial Sequence
  Ebola virus siRNA sense strand
gaauuggcgucccguuuaaca

SEQ ID NO: 16324 - RNA, 21 nt, Artificial Sequence
  Ebola virus siRNA sense strand
aauuggcgucccguuuaacau

SEQ ID NO: 16325 - RNA, 21 nt, Artificial Sequence
  Ebola virus siRNA sense strand
auuggcgucccguuuaacaug

SEQ ID NO: 16326 - RNA, 21 nt, Artificial Sequence
  Ebola virus siRNA sense strand
uuggcgucccguuuaacaugg

SEQ ID NO: 16327 - RNA, 21 nt, Artificial Sequence
  Ebola virus siRNA sense strand
uggcgucccguuuaacauggg

SEQ ID NO: 16328 - RNA, 21 nt, Artificial Sequence
  Ebola virus siRNA sense strand
ggcgucccguuuaacaugggu

SEQ ID NO: 16329 - RNA, 21 nt, Artificial Sequence
  Ebola virus siRNA sense strand
gcgucccguuuaacaugggua

SEQ ID NO: 16330 - RNA, 21 nt, Artificial Sequence
  Ebola virus siRNA sense strand
cgucccguuuaacauggguaa

SEQ ID NO: 16331 - RNA, 21 nt, Artificial Sequence
  Ebola virus siRNA sense strand
gucccguuuaacauggguaac

SEQ ID NO: 16332 - RNA, 21 nt, Artificial Sequence
  Ebola virus siRNA sense strand
ucccguuuaacauggguaacu

SEQ ID NO: 16333 - RNA, 21 nt, Artificial Sequence
  Ebola virus siRNA sense strand
cccguuuaacauggguaacuc

SEQ ID NO: 16334 - RNA, 21 nt, Artificial Sequence
  Ebola virus siRNA sense strand
ccguuuaacauggguaacuca

SEQ ID NO: 16335 - RNA, 21 nt, Artificial Sequence
  Ebola virus siRNA sense strand
cguuuaacauggguaacucaa

SEQ ID NO: 16336 - RNA, 21 nt, Artificial Sequence
  Ebola virus siRNA sense strand
guuuaacauggguaacucaag

SEQ ID NO: 16337 - RNA, 21 nt, Artificial Sequence
  Ebola virus siRNA sense strand
uuuaacauggguaacucaagg

SEQ ID NO: 16338 - RNA, 21 nt, Artificial Sequence
  Ebola virus siRNA sense strand
uuaacauggguaacucaaggc

SEQ ID NO: 16339 - RNA, 21 nt, Artificial Sequence
  Ebola virus siRNA sense strand
uaacauggguaacucaaggca

SEQ ID NO: 16340 - RNA, 21 nt, Artificial Sequence
  Ebola virus siRNA sense strand
aacauggguaacucaaggcag

SEQ ID NO: 16341 - RNA, 21 nt, Artificial Sequence
  Ebola virus siRNA sense strand
acauggguaacucaaggcagu

SEQ ID NO: 16342 - RNA, 21 nt, Artificial Sequence
  Ebola virus siRNA sense strand
cauggguaacucaaggcaguu

SEQ ID NO: 16343 - RNA, 21 nt, Artificial Sequence
  Ebola virus siRNA sense strand
auggguaacucaaggcaguuc

SEQ ID NO: 16344 - RNA, 21 nt, Artificial Sequence
  Ebola virus siRNA sense strand
uggguaacucaaggcaguucg

SEQ ID NO: 16345 - RNA, 21 nt, Artificial Sequence
  Ebola virus siRNA sense strand
ggguaacucaaggcaguucga

SEQ ID NO: 16346 - RNA, 21 nt, Artificial Sequence
  Ebola virus siRNA sense strand
gguaacucaaggcaguucgaa

SEQ ID NO: 16347 - RNA, 21 nt, Artificial Sequence
  Ebola virus siRNA sense strand
guaacucaaggcaguucgaac

SEQ ID NO: 16348 - RNA, 21 nt, Artificial Sequence
  Ebola virus siRNA sense strand
uaacucaaggcaguucgaaca

SEQ ID NO: 16349 - RNA, 21 nt, Artificial Sequence
  Ebola virus siRNA sense strand
aacucaaggcaguucgaacag

SEQ ID NO: 16350 - RNA, 21 nt, Artificial Sequence
  Ebola virus siRNA sense strand
acucaaggcaguucgaacagu

SEQ ID NO: 16351 - RNA, 21 nt, Artificial Sequence
  Ebola virus siRNA sense strand
cucaaggcaguucgaacagug

SEQ ID NO: 16352 - RNA, 21 nt, Artificial Sequence
  Ebola virus siRNA sense strand
ucaaggcaguucgaacaguga

SEQ ID NO: 16353 - RNA, 21 nt, Artificial Sequence
  Ebola virus siRNA sense strand
caaggcaguucgaacagugac

SEQ ID NO: 16354 - RNA, 21 nt, Artificial Sequence
  Ebola virus siRNA sense strand
aaggcaguucgaacagugacu

SEQ ID NO: 16355 - RNA, 21 nt, Artificial Sequence
  Ebola virus siRNA sense strand
aggcaguucgaacagugacuu

SEQ ID NO: 16356 - RNA, 21 nt, Artificial Sequence
  Ebola virus siRNA sense strand
ggcaguucgaacagugacuug

SEQ ID NO: 16357 - RNA, 21 nt, Artificial Sequence
  Ebola virus siRNA sense strand
gcaguucgaacagugacuugc

SEQ ID NO: 16358 - RNA, 21 nt, Artificial Sequence
  Ebola virus siRNA sense strand
caguucgaacagugacuugcu

SEQ ID NO: 16359 - RNA, 21 nt, Artificial Sequence
  Ebola virus siRNA sense strand
aguucgaacagugacuugcua

SEQ ID NO: 16360 - RNA, 21 nt, Artificial Sequence
  Ebola virus siRNA sense strand
guucgaacagugacuugcuaa

SEQ ID NO: 16361 - RNA, 21 nt, Artificial Sequence
  Ebola virus siRNA sense strand
uucgaacagugacuugcuaau

SEQ ID NO: 16362 - RNA, 21 nt, Artificial Sequence
  Ebola virus siRNA sense strand
ucgaacagugacuugcuaaua

SEQ ID NO: 16363 - RNA, 21 nt, Artificial Sequence
  Ebola virus siRNA sense strand
cgaacagugacuugcuaauaa

SEQ ID NO: 16364 - RNA, 21 nt, Artificial Sequence
  Ebola virus siRNA sense strand
gaacagugacuugcuaauaaa

SEQ ID NO: 16365 - RNA, 21 nt, Artificial Sequence
  Ebola virus siRNA sense strand
aacagugacuugcuaauaaaa

SEQ ID NO: 16366 - RNA, 21 nt, Artificial Sequence
  Ebola virus siRNA sense strand
acagugacuugcuaauaaaac

SEQ ID NO: 16367 - RNA, 21 nt, Artificial Sequence
  Ebola virus siRNA sense strand
cagugacuugcuaauaaaacc

SEQ ID NO: 16368 - RNA, 21 nt, Artificial Sequence
  Ebola virus siRNA sense strand
agugacuugcuaauaaaacca

SEQ ID NO: 16369 - RNA, 21 nt, Artificial Sequence
  Ebola virus siRNA sense strand
gugacuugcuaauaaaaccau

SEQ ID NO: 16370 - RNA, 21 nt, Artificial Sequence
  Ebola virus siRNA sense strand
ugacuugcuaauaaaaccauu

SEQ ID NO: 16371 - RNA, 21 nt, Artificial Sequence
  Ebola virus siRNA sense strand
gacuugcuaauaaaaccauuu

SEQ ID NO: 16372 - RNA, 21 nt, Artificial Sequence
  Ebola virus siRNA sense strand
acuugcuaauaaaaccauuuu

SEQ ID NO: 16373 - RNA, 21 nt, Artificial Sequence
  Ebola virus siRNA sense strand
cuugcuaauaaaaccauuuuu

SEQ ID NO: 16374 - RNA, 21 nt, Artificial Sequence
  Ebola virus siRNA sense strand
uugcuaauaaaaccauuuuug

SEQ ID NO: 16375 - RNA, 21 nt, Artificial Sequence
  Ebola virus siRNA sense strand
ugcuaauaaaaccauuuuugg

SEQ ID NO: 16376 - RNA, 21 nt, Artificial Sequence
  Ebola virus siRNA sense strand
gcuaauaaaaccauuuuugga

SEQ ID NO: 16377 - RNA, 21 nt, Artificial Sequence
  Ebola virus siRNA sense strand
cuaauaaaaccauuuuuggaa

SEQ ID NO: 16378 - RNA, 21 nt, Artificial Sequence
  Ebola virus siRNA sense strand
uaauaaaaccauuuuuggaag

SEQ ID NO: 16379 - RNA, 21 nt, Artificial Sequence
  Ebola virus siRNA sense strand
aauaaaaccauuuuuggaagc

SEQ ID NO: 16380 - RNA, 21 nt, Artificial Sequence
  Ebola virus siRNA sense strand
auaaaaccauuuuuggaagca

SEQ ID NO: 16381 - RNA, 21 nt, Artificial Sequence
  Ebola virus siRNA sense strand
uaaaaccauuuuuggaagcac

SEQ ID NO: 16382 - RNA, 21 nt, Artificial Sequence
  Ebola virus siRNA sense strand
aaaaccauuuuuggaagcacg

SEQ ID NO: 16383 - RNA, 21 nt, Artificial Sequence
  Ebola virus siRNA sense strand
aaaccauuuuuggaagcacga

SEQ ID NO: 16384 - RNA, 21 nt, Artificial Sequence
  Ebola virus siRNA sense strand
aaccauuuuuggaagcacgag

SEQ ID NO: 16385 - RNA, 21 nt, Artificial Sequence
  Ebola virus siRNA sense strand
accauuuuuggaagcacgagu

SEQ ID NO: 16386 - RNA, 21 nt, Artificial Sequence
  Ebola virus siRNA sense strand
ccauuuuuggaagcacgagua

SEQ ID NO: 16387 - RNA, 21 nt, Artificial Sequence
  Ebola virus siRNA sense strand
cauuuuuggaagcacgaguaa

SEQ ID NO: 16388 - RNA, 21 nt, Artificial Sequence
  Ebola virus siRNA sense strand
auuuuuggaagcacgaguaaa

SEQ ID NO: 16389 - RNA, 21 nt, Artificial Sequence
  Ebola virus siRNA sense strand
uuuuuggaagcacgaguaaau

SEQ ID NO: 16390 - RNA, 21 nt, Artificial Sequence
  Ebola virus siRNA sense strand
uuuuggaagcacgaguaaauu

SEQ ID NO: 16391 - RNA, 21 nt, Artificial Sequence
  Ebola virus siRNA sense strand
uuuggaagcacgaguaaauuu

SEQ ID NO: 16392 - RNA, 21 nt, Artificial Sequence
  Ebola virus siRNA sense strand
uuggaagcacgaguaaauuua

SEQ ID NO: 16393 - RNA, 21 nt, Artificial Sequence
  Ebola virus siRNA sense strand
uggaagcacgaguaaauuuaa

SEQ ID NO: 16394 - RNA, 21 nt, Artificial Sequence
  Ebola virus siRNA sense strand
ggaagcacgaguaaauuuaag

SEQ ID NO: 16395 - RNA, 21 nt, Artificial Sequence
  Ebola virus siRNA sense strand
gaagcacgaguaaauuuaagu

SEQ ID NO: 16396 - RNA, 21 nt, Artificial Sequence
  Ebola virus siRNA sense strand
aagcacgaguaaauuuaagug

SEQ ID NO: 16397 - RNA, 21 nt, Artificial Sequence
  Ebola virus siRNA sense strand
agcacgaguaaauuuaagugu

SEQ ID NO: 16398 - RNA, 21 nt, Artificial Sequence
  Ebola virus siRNA sense strand
gcacgaguaaauuuaaguguu

SEQ ID NO: 16399 - RNA, 21 nt, Artificial Sequence
  Ebola virus siRNA sense strand
cacgaguaaauuuaaguguuc

SEQ ID NO: 16400 - RNA, 21 nt, Artificial Sequence
  Ebola virus siRNA sense strand
acgaguaaauuuaaguguuca

SEQ ID NO: 16401 - RNA, 21 nt, Artificial Sequence
  Ebola virus siRNA sense strand
cgaguaaauuuaaguguucaa

SEQ ID NO: 16402 - RNA, 21 nt, Artificial Sequence
  Ebola virus siRNA sense strand
gaguaaauuuaaguguucaag

SEQ ID NO: 16403 - RNA, 21 nt, Artificial Sequence
  Ebola virus siRNA sense strand
aguaaauuuaaguguucaaga

SEQ ID NO: 16404 - RNA, 21 nt, Artificial Sequence
  Ebola virus siRNA sense strand
guaaauuuaaguguucaagaa

SEQ ID NO: 16405 - RNA, 21 nt, Artificial Sequence
  Ebola virus siRNA sense strand
uaaauuuaaguguucaagaaa

SEQ ID NO: 16406 - RNA, 21 nt, Artificial Sequence
  Ebola virus siRNA sense strand
aaauuuaaguguucaagaaau

SEQ ID NO: 16407 - RNA, 21 nt, Artificial Sequence
  Ebola virus siRNA sense strand
aauuuaaguguucaagaaaua

SEQ ID NO: 16408 - RNA, 21 nt, Artificial Sequence
  Ebola virus siRNA sense strand
auuuaaguguucaagaaauac

SEQ ID NO: 16409 - RNA, 21 nt, Artificial Sequence
  Ebola virus siRNA sense strand
uuuaaguguucaagaaauacu

SEQ ID NO: 16410 - RNA, 21 nt, Artificial Sequence
  Ebola virus siRNA sense strand
uuaaguguucaagaaauacuu

SEQ ID NO: 16411 - RNA, 21 nt, Artificial Sequence
  Ebola virus siRNA sense strand
uaaguguucaagaaauacuuc

SEQ ID NO: 16412 - RNA, 21 nt, Artificial Sequence
  Ebola virus siRNA sense strand
aaguguucaagaaauacuuca

SEQ ID NO: 16413 - RNA, 21 nt, Artificial Sequence
  Ebola virus siRNA sense strand
aguguucaagaaauacuucaa

SEQ ID NO: 16414 - RNA, 21 nt, Artificial Sequence
  Ebola virus siRNA sense strand
guguucaagaaauacuucaaa

SEQ ID NO: 16415 - RNA, 21 nt, Artificial Sequence
  Ebola virus siRNA sense strand
uguucaagaaauacuucaaau

SEQ ID NO: 16416 - RNA, 21 nt, Artificial Sequence
  Ebola virus siRNA sense strand
guucaagaaauacuucaaaug

SEQ ID NO: 16417 - RNA, 21 nt, Artificial Sequence
  Ebola virus siRNA sense strand
uucaagaaauacuucaaauga

SEQ ID NO: 16418 - RNA, 21 nt, Artificial Sequence
  Ebola virus siRNA sense strand
ucaagaaauacuucaaaugac

SEQ ID NO: 16419 - RNA, 21 nt, Artificial Sequence
  Ebola virus siRNA sense strand
caagaaauacuucaaaugacc

SEQ ID NO: 16420 - RNA, 21 nt, Artificial Sequence
  Ebola virus siRNA sense strand
aagaaauacuucaaaugaccc

SEQ ID NO: 16421 - RNA, 21 nt, Artificial Sequence
  Ebola virus siRNA sense strand
agaaauacuucaaaugacccc

SEQ ID NO: 16422 - RNA, 21 nt, Artificial Sequence
  Ebola virus siRNA sense strand
gaaauacuucaaaugaccccu

SEQ ID NO: 16423 - RNA, 21 nt, Artificial Sequence
  Ebola virus siRNA sense strand
aaauacuucaaaugaccccuu

SEQ ID NO: 16424 - RNA, 21 nt, Artificial Sequence
  Ebola virus siRNA sense strand
aauacuucaaaugaccccuuc

SEQ ID NO: 16425 - RNA, 21 nt, Artificial Sequence
  Ebola virus siRNA sense strand
auacuucaaaugaccccuuca

SEQ ID NO: 16426 - RNA, 21 nt, Artificial Sequence
  Ebola virus siRNA sense strand
uacuucaaaugaccccuucac

SEQ ID NO: 16427 - RNA, 21 nt, Artificial Sequence
  Ebola virus siRNA sense strand
acuucaaaugaccccuucaca

SEQ ID NO: 16428 - RNA, 21 nt, Artificial Sequence
  Ebola virus siRNA sense strand
cuucaaaugaccccuucacau

SEQ ID NO: 16429 - RNA, 21 nt, Artificial Sequence
  Ebola virus siRNA sense strand
uucaaaugaccccuucacauu

SEQ ID NO: 16430 - RNA, 21 nt, Artificial Sequence
  Ebola virus siRNA sense strand
ucaaaugaccccuucacauua

SEQ ID NO: 16431 - RNA, 21 nt, Artificial Sequence
  Ebola virus siRNA sense strand
caaaugaccccuucacauuac

SEQ ID NO: 16432 - RNA, 21 nt, Artificial Sequence
  Ebola virus siRNA sense strand
aaaugaccccuucacauuacu

SEQ ID NO: 16433 - RNA, 21 nt, Artificial Sequence
  Ebola virus siRNA sense strand
aaugaccccuucacauuacuc

SEQ ID NO: 16434 - RNA, 21 nt, Artificial Sequence
  Ebola virus siRNA sense strand
augaccccuucacauuacuca

SEQ ID NO: 16435 - RNA, 21 nt, Artificial Sequence
  Ebola virus siRNA sense strand
ugaccccuucacauuacucag

SEQ ID NO: 16436 - RNA, 21 nt, Artificial Sequence
  Ebola virus siRNA sense strand
gaccccuucacauuacucagg

SEQ ID NO: 16437 - RNA, 21 nt, Artificial Sequence
  Ebola virus siRNA sense strand
accccuucacauuacucagga

SEQ ID NO: 16438 - RNA, 21 nt, Artificial Sequence
  Ebola virus siRNA sense strand
ccccuucacauuacucaggaa

SEQ ID NO: 16439 - RNA, 21 nt, Artificial Sequence
  Ebola virus siRNA sense strand
cccuucacauuacucaggaaa

SEQ ID NO: 16440 - RNA, 21 nt, Artificial Sequence
  Ebola virus siRNA sense strand
ccuucacauuacucaggaaau

SEQ ID NO: 16441 - RNA, 21 nt, Artificial Sequence
  Ebola virus siRNA sense strand
cuucacauuacucaggaaaua

SEQ ID NO: 16442 - RNA, 21 nt, Artificial Sequence
  Ebola virus siRNA sense strand
uucacauuacucaggaaauau

SEQ ID NO: 16443 - RNA, 21 nt, Artificial Sequence
  Ebola virus siRNA sense strand
ucacauuacucaggaaauauu

SEQ ID NO: 16444 - RNA, 21 nt, Artificial Sequence
  Ebola virus siRNA sense strand
cacauuacucaggaaauauug

SEQ ID NO: 16445 - RNA, 21 nt, Artificial Sequence
  Ebola virus siRNA sense strand
acauuacucaggaaauauugu

SEQ ID NO: 16446 - RNA, 21 nt, Artificial Sequence
  Ebola virus siRNA sense strand
cauuacucaggaaauauuguu

SEQ ID NO: 16447 - RNA, 21 nt, Artificial Sequence
  Ebola virus siRNA sense strand
auuacucaggaaauauuguuc

SEQ ID NO: 16448 - RNA, 21 nt, Artificial Sequence
  Ebola virus siRNA sense strand
uuacucaggaaauauuguuca

SEQ ID NO: 16449 - RNA, 21 nt, Artificial Sequence
  Ebola virus siRNA sense strand
uacucaggaaauauuguucac

SEQ ID NO: 16450 - RNA, 21 nt, Artificial Sequence
  Ebola virus siRNA sense strand
acucaggaaauauuguucaca

SEQ ID NO: 16451 - RNA, 21 nt, Artificial Sequence
  Ebola virus siRNA sense strand
cucaggaaauauuguucacag

SEQ ID NO: 16452 - RNA, 21 nt, Artificial Sequence
  Ebola virus siRNA sense strand
ucaggaaauauuguucacagg

SEQ ID NO: 16453 - RNA, 21 nt, Artificial Sequence
  Ebola virus siRNA sense strand
caggaaauauuguucacaggu

SEQ ID NO: 16454 - RNA, 21 nt, Artificial Sequence
  Ebola virus siRNA sense strand
aggaaauauuguucacaggua

SEQ ID NO: 16455 - RNA, 21 nt, Artificial Sequence
  Ebola virus siRNA sense strand
ggaaauauuguucacagguac

SEQ ID NO: 16456 - RNA, 21 nt, Artificial Sequence
  Ebola virus siRNA sense strand
gaaauauuguucacagguaca

SEQ ID NO: 16457 - RNA, 21 nt, Artificial Sequence
  Ebola virus siRNA sense strand
aaauauuguucacagguacaa

SEQ ID NO: 16458 - RNA, 21 nt, Artificial Sequence
  Ebola virus siRNA sense strand
aauauuguucacagguacaac

SEQ ID NO: 16459 - RNA, 21 nt, Artificial Sequence
  Ebola virus siRNA sense strand
auauuguucacagguacaacg

SEQ ID NO: 16460 - RNA, 21 nt, Artificial Sequence
  Ebola virus siRNA sense strand
uauuguucacagguacaacga

SEQ ID NO: 16461 - RNA, 21 nt, Artificial Sequence
  Ebola virus siRNA sense strand
auuguucacagguacaacgau

SEQ ID NO: 16462 - RNA, 21 nt, Artificial Sequence
  Ebola virus siRNA sense strand
uuguucacagguacaacgauc

SEQ ID NO: 16463 - RNA, 21 nt, Artificial Sequence
  Ebola virus siRNA sense strand
uguucacagguacaacgauca

SEQ ID NO: 16464 - RNA, 21 nt, Artificial Sequence
  Ebola virus siRNA sense strand
guucacagguacaacgaucaa

SEQ ID NO: 16465 - RNA, 21 nt, Artificial Sequence
  Ebola virus siRNA sense strand
uucacagguacaacgaucaau

SEQ ID NO: 16466 - RNA, 21 nt, Artificial Sequence
  Ebola virus siRNA sense strand
ucacagguacaacgaucaaua

SEQ ID NO: 16467 - RNA, 21 nt, Artificial Sequence
  Ebola virus siRNA sense strand
cacagguacaacgaucaauac

SEQ ID NO: 16468 - RNA, 21 nt, Artificial Sequence
  Ebola virus siRNA sense strand
acagguacaacgaucaauaca

SEQ ID NO: 16469 - RNA, 21 nt, Artificial Sequence
  Ebola virus siRNA sense strand
cagguacaacgaucaauacag

SEQ ID NO: 16470 - RNA, 21 nt, Artificial Sequence
  Ebola virus siRNA sense strand
agguacaacgaucaauacagu

SEQ ID NO: 16471 - RNA, 21 nt, Artificial Sequence
  Ebola virus siRNA sense strand
gguacaacgaucaauacaguc

SEQ ID NO: 16472 - RNA, 21 nt, Artificial Sequence
  Ebola virus siRNA sense strand
guacaacgaucaauacagucc

SEQ ID NO: 16473 - RNA, 21 nt, Artificial Sequence
  Ebola virus siRNA sense strand
uacaacgaucaauacaguccu

SEQ ID NO: 16474 - RNA, 21 nt, Artificial Sequence
  Ebola virus siRNA sense strand
acaacgaucaauacaguccuc

SEQ ID NO: 16475 - RNA, 21 nt, Artificial Sequence
  Ebola virus siRNA sense strand
caacgaucaauacaguccuca

SEQ ID NO: 16476 - RNA, 21 nt, Artificial Sequence
  Ebola virus siRNA sense strand
aacgaucaauacaguccucau

SEQ ID NO: 16477 - RNA, 21 nt, Artificial Sequence
  Ebola virus siRNA sense strand
acgaucaauacaguccucauu

SEQ ID NO: 16478 - RNA, 21 nt, Artificial Sequence
  Ebola virus siRNA sense strand
cgaucaauacaguccucauuc

SEQ ID NO: 16479 - RNA, 21 nt, Artificial Sequence
  Ebola virus siRNA sense strand
gaucaauacaguccucauucu

SEQ ID NO: 16480 - RNA, 21 nt, Artificial Sequence
  Ebola virus siRNA sense strand
aucaauacaguccucauucuu

SEQ ID NO: 16481 - RNA, 21 nt, Artificial Sequence
  Ebola virus siRNA sense strand
ucaauacaguccucauucuuu

SEQ ID NO: 16482 - RNA, 21 nt, Artificial Sequence
  Ebola virus siRNA sense strand
caauacaguccucauucuuuc

SEQ ID NO: 16483 - RNA, 21 nt, Artificial Sequence
  Ebola virus siRNA sense strand
aauacaguccucauucuuuca

SEQ ID NO: 16484 - RNA, 21 nt, Artificial Sequence
  Ebola virus siRNA sense strand
auacaguccucauucuuucau

SEQ ID NO: 16485 - RNA, 21 nt, Artificial Sequence
  Ebola virus siRNA sense strand
uacaguccucauucuuucaug

SEQ ID NO: 16486 - RNA, 21 nt, Artificial Sequence
  Ebola virus siRNA sense strand
acaguccucauucuuucaugg

SEQ ID NO: 16487 - RNA, 21 nt, Artificial Sequence
  Ebola virus siRNA sense strand
caguccucauucuuucauggc

SEQ ID NO: 16488 - RNA, 21 nt, Artificial Sequence
  Ebola virus siRNA sense strand
aguccucauucuuucauggcc

SEQ ID NO: 16489 - RNA, 21 nt, Artificial Sequence
  Ebola virus siRNA sense strand
guccucauucuuucauggcca

SEQ ID NO: 16490 - RNA, 21 nt, Artificial Sequence
  Ebola virus siRNA sense strand
uccucauucuuucauggccaa

SEQ ID NO: 16491 - RNA, 21 nt, Artificial Sequence
  Ebola virus siRNA sense strand
ccucauucuuucauggccaau

SEQ ID NO: 16492 - RNA, 21 nt, Artificial Sequence
  Ebola virus siRNA sense strand
cucauucuuucauggccaauc

SEQ ID NO: 16493 - RNA, 21 nt, Artificial Sequence
  Ebola virus siRNA sense strand
ucauucuuucauggccaaucg

SEQ ID NO: 16494 - RNA, 21 nt, Artificial Sequence
  Ebola virus siRNA sense strand
cauucuuucauggccaaucgu

SEQ ID NO: 16495 - RNA, 21 nt, Artificial Sequence
  Ebola virus siRNA sense strand
auucuuucauggccaaucgua

SEQ ID NO: 16496 - RNA, 21 nt, Artificial Sequence
  Ebola virus siRNA sense strand
uucuuucauggccaaucguau

SEQ ID NO: 16497 - RNA, 21 nt, Artificial Sequence
  Ebola virus siRNA sense strand
ucuuucauggccaaucguaug

SEQ ID NO: 16498 - RNA, 21 nt, Artificial Sequence
  Ebola virus siRNA sense strand
cuuucauggccaaucguauga

SEQ ID NO: 16499 - RNA, 21 nt, Artificial Sequence
  Ebola virus siRNA sense strand
uuucauggccaaucguaugag

SEQ ID NO: 16500 - RNA, 21 nt, Artificial Sequence
  Ebola virus siRNA sense strand
uucauggccaaucguaugagu

SEQ ID NO: 16501 - RNA, 21 nt, Artificial Sequence
  Ebola virus siRNA sense strand
ucauggccaaucguaugagua

SEQ ID NO: 16502 - RNA, 21 nt, Artificial Sequence
  Ebola virus siRNA sense strand
cauggccaaucguaugaguaa

SEQ ID NO: 16503 - RNA, 21 nt, Artificial Sequence
  Ebola virus siRNA sense strand
auggccaaucguaugaguaau

SEQ ID NO: 16504 - RNA, 21 nt, Artificial Sequence
  Ebola virus siRNA sense strand
uggccaaucguaugaguaauu

SEQ ID NO: 16505 - RNA, 21 nt, Artificial Sequence
  Ebola virus siRNA sense strand
ggccaaucguaugaguaauuc

SEQ ID NO: 16506 - RNA, 21 nt, Artificial Sequence
  Ebola virus siRNA sense strand
gccaaucguaugaguaauuca

SEQ ID NO: 16507 - RNA, 21 nt, Artificial Sequence
  Ebola virus siRNA sense strand
ccaaucguaugaguaauucag

SEQ ID NO: 16508 - RNA, 21 nt, Artificial Sequence
  Ebola virus siRNA sense strand
caaucguaugaguaauucagc

SEQ ID NO: 16509 - RNA, 21 nt, Artificial Sequence
  Ebola virus siRNA sense strand
aaucguaugaguaauucagca

SEQ ID NO: 16510 - RNA, 21 nt, Artificial Sequence
  Ebola virus siRNA sense strand
aucguaugaguaauucagcaa

SEQ ID NO: 16511 - RNA, 21 nt, Artificial Sequence
  Ebola virus siRNA sense strand
ucguaugaguaauucagcaac

SEQ ID NO: 16512 - RNA, 21 nt, Artificial Sequence
  Ebola virus siRNA sense strand
cguaugaguaauucagcaacg

SEQ ID NO: 16513 - RNA, 21 nt, Artificial Sequence
  Ebola virus siRNA sense strand
guaugaguaauucagcaacgc

SEQ ID NO: 16514 - RNA, 21 nt, Artificial Sequence
  Ebola virus siRNA sense strand
uaugaguaauucagcaacgcg

SEQ ID NO: 16515 - RNA, 21 nt, Artificial Sequence
  Ebola virus siRNA sense strand
augaguaauucagcaacgcga

SEQ ID NO: 16516 - RNA, 21 nt, Artificial Sequence
  Ebola virus siRNA sense strand
ugaguaauucagcaacgcgau

SEQ ID NO: 16517 - RNA, 21 nt, Artificial Sequence
  Ebola virus siRNA sense strand
gaguaauucagcaacgcgauu

SEQ ID NO: 16518 - RNA, 21 nt, Artificial Sequence
  Ebola virus siRNA sense strand
aguaauucagcaacgcgauug

SEQ ID NO: 16519 - RNA, 21 nt, Artificial Sequence
  Ebola virus siRNA sense strand
guaauucagcaacgcgauuga

SEQ ID NO: 16520 - RNA, 21 nt, Artificial Sequence
  Ebola virus siRNA sense strand
uaauucagcaacgcgauugau

SEQ ID NO: 16521 - RNA, 21 nt, Artificial Sequence
  Ebola virus siRNA sense strand
aauucagcaacgcgauugauu

SEQ ID NO: 16522 - RNA, 21 nt, Artificial Sequence
  Ebola virus siRNA sense strand
auucagcaacgcgauugauug

SEQ ID NO: 16523 - RNA, 21 nt, Artificial Sequence
  Ebola virus siRNA sense strand
uucagcaacgcgauugauugu

SEQ ID NO: 16524 - RNA, 21 nt, Artificial Sequence
  Ebola virus siRNA sense strand
ucagcaacgcgauugauuguu

SEQ ID NO: 16525 - RNA, 21 nt, Artificial Sequence
  Ebola virus siRNA sense strand
cagcaacgcgauugauuguuu

SEQ ID NO: 16526 - RNA, 21 nt, Artificial Sequence
  Ebola virus siRNA sense strand
agcaacgcgauugauuguuuc

SEQ ID NO: 16527 - RNA, 21 nt, Artificial Sequence
  Ebola virus siRNA sense strand
gcaacgcgauugauuguuucu

SEQ ID NO: 16528 - RNA, 21 nt, Artificial Sequence
  Ebola virus siRNA sense strand
caacgcgauugauuguuucua

SEQ ID NO: 16529 - RNA, 21 nt, Artificial Sequence
  Ebola virus siRNA sense strand
aacgcgauugauuguuucuac

SEQ ID NO: 16530 - RNA, 21 nt, Artificial Sequence
  Ebola virus siRNA sense strand
acgcgauugauuguuucuaca

SEQ ID NO: 16531 - RNA, 21 nt, Artificial Sequence
  Ebola virus siRNA sense strand
cgcgauugauuguuucuacaa

SEQ ID NO: 16532 - RNA, 21 nt, Artificial Sequence
  Ebola virus siRNA sense strand
gcgauugauuguuucuacaaa

SEQ ID NO: 16533 - RNA, 21 nt, Artificial Sequence
  Ebola virus siRNA sense strand
cgauugauuguuucuacaaac

SEQ ID NO: 16534 - RNA, 21 nt, Artificial Sequence
  Ebola virus siRNA sense strand
gauugauuguuucuacaaaca

SEQ ID NO: 16535 - RNA, 21 nt, Artificial Sequence
  Ebola virus siRNA sense strand
auugauuguuucuacaaacac

SEQ ID NO: 16536 - RNA, 21 nt, Artificial Sequence
  Ebola virus siRNA sense strand
uugauuguuucuacaaacacu

SEQ ID NO: 16537 - RNA, 21 nt, Artificial Sequence
  Ebola virus siRNA sense strand
ugauuguuucuacaaacacuu

SEQ ID NO: 16538 - RNA, 21 nt, Artificial Sequence
  Ebola virus siRNA sense strand
gauuguuucuacaaacacuuu

SEQ ID NO: 16539 - RNA, 21 nt, Artificial Sequence
  Ebola virus siRNA sense strand
auuguuucuacaaacacuuua

SEQ ID NO: 16540 - RNA, 21 nt, Artificial Sequence
  Ebola virus siRNA sense strand
uuguuucuacaaacacuuuag

SEQ ID NO: 16541 - RNA, 21 nt, Artificial Sequence
  Ebola virus siRNA sense strand
uguuucuacaaacacuuuagg

SEQ ID NO: 16542 - RNA, 21 nt, Artificial Sequence
  Ebola virus siRNA sense strand
guuucuacaaacacuuuaggu

SEQ ID NO: 16543 - RNA, 21 nt, Artificial Sequence
  Ebola virus siRNA sense strand
uuucuacaaacacuuuaggug

SEQ ID NO: 16544 - RNA, 21 nt, Artificial Sequence
  Ebola virus siRNA sense strand
uucuacaaacacuuuagguga

SEQ ID NO: 16545 - RNA, 21 nt, Artificial Sequence
  Ebola virus siRNA sense strand
ucuacaaacacuuuaggugag

SEQ ID NO: 16546 - RNA, 21 nt, Artificial Sequence
  Ebola virus siRNA sense strand
cuacaaacacuuuaggugagu

SEQ ID NO: 16547 - RNA, 21 nt, Artificial Sequence
  Ebola virus siRNA sense strand
uacaaacacuuuaggugaguu

SEQ ID NO: 16548 - RNA, 21 nt, Artificial Sequence
  Ebola virus siRNA sense strand
acaaacacuuuaggugaguuu

SEQ ID NO: 16549 - RNA, 21 nt, Artificial Sequence
  Ebola virus siRNA sense strand
caaacacuuuaggugaguuuu

SEQ ID NO: 16550 - RNA, 21 nt, Artificial Sequence
  Ebola virus siRNA sense strand
aaacacuuuaggugaguuuuc

SEQ ID NO: 16551 - RNA, 21 nt, Artificial Sequence
  Ebola virus siRNA sense strand
aacacuuuaggugaguuuuca

SEQ ID NO: 16552 - RNA, 21 nt, Artificial Sequence
  Ebola virus siRNA sense strand
acacuuuaggugaguuuucag

SEQ ID NO: 16553 - RNA, 21 nt, Artificial Sequence
  Ebola virus siRNA sense strand
cacuuuaggugaguuuucagg

SEQ ID NO: 16554 - RNA, 21 nt, Artificial Sequence
  Ebola virus siRNA sense strand
acuuuaggugaguuuucagga

SEQ ID NO: 16555 - RNA, 21 nt, Artificial Sequence
  Ebola virus siRNA sense strand
cuuuaggugaguuuucaggag

SEQ ID NO: 16556 - RNA, 21 nt, Artificial Sequence
  Ebola virus siRNA sense strand
uuuaggugaguuuucaggagg

SEQ ID NO: 16557 - RNA, 21 nt, Artificial Sequence
  Ebola virus siRNA sense strand
uuaggugaguuuucaggaggu

SEQ ID NO: 16558 - RNA, 21 nt, Artificial Sequence
  Ebola virus siRNA sense strand
uaggugaguuuucaggaggug

SEQ ID NO: 16559 - RNA, 21 nt, Artificial Sequence
  Ebola virus siRNA sense strand
aggugaguuuucaggaggugg

SEQ ID NO: 16560 - RNA, 21 nt, Artificial Sequence
  Ebola virus siRNA sense strand
ggugaguuuucaggagguggc

SEQ ID NO: 16561 - RNA, 21 nt, Artificial Sequence
  Ebola virus siRNA sense strand
gugaguuuucaggagguggcc

SEQ ID NO: 16562 - RNA, 21 nt, Artificial Sequence
  Ebola virus siRNA sense strand
ugaguuuucaggagguggcca

SEQ ID NO: 16563 - RNA, 21 nt, Artificial Sequence
  Ebola virus siRNA sense strand
gaguuuucaggagguggccag

SEQ ID NO: 16564 - RNA, 21 nt, Artificial Sequence
  Ebola virus siRNA sense strand
aguuuucaggagguggccagu

SEQ ID NO: 16565 - RNA, 21 nt, Artificial Sequence
  Ebola virus siRNA sense strand
guuuucaggagguggccaguc

SEQ ID NO: 16566 - RNA, 21 nt, Artificial Sequence
  Ebola virus siRNA sense strand
uuuucaggagguggccagucu

SEQ ID NO: 16567 - RNA, 21 nt, Artificial Sequence
  Ebola virus siRNA sense strand
uuucaggagguggccagucug

SEQ ID NO: 16568 - RNA, 21 nt, Artificial Sequence
  Ebola virus siRNA sense strand
uucaggagguggccagucugc

SEQ ID NO: 16569 - RNA, 21 nt, Artificial Sequence
  Ebola virus siRNA sense strand
ucaggagguggccagucugca

SEQ ID NO: 16570 - RNA, 21 nt, Artificial Sequence
  Ebola virus siRNA sense strand
caggagguggccagucugcac

SEQ ID NO: 16571 - RNA, 21 nt, Artificial Sequence
  Ebola virus siRNA sense strand
aggagguggccagucugcacg

SEQ ID NO: 16572 - RNA, 21 nt, Artificial Sequence
  Ebola virus siRNA sense strand
ggagguggccagucugcacgc

SEQ ID NO: 16573 - RNA, 21 nt, Artificial Sequence
  Ebola virus siRNA sense strand
gagguggccagucugcacgcg

SEQ ID NO: 16574 - RNA, 21 nt, Artificial Sequence
  Ebola virus siRNA sense strand
agguggccagucugcacgcga

SEQ ID NO: 16575 - RNA, 21 nt, Artificial Sequence
  Ebola virus siRNA sense strand
gguggccagucugcacgcgac

SEQ ID NO: 16576 - RNA, 21 nt, Artificial Sequence
  Ebola virus siRNA sense strand
guggccagucugcacgcgaca

SEQ ID NO: 16577 - RNA, 21 nt, Artificial Sequence
  Ebola virus siRNA sense strand
uggccagucugcacgcgacag

SEQ ID NO: 16578 - RNA, 21 nt, Artificial Sequence
  Ebola virus siRNA sense strand
ggccagucugcacgcgacagc

SEQ ID NO: 16579 - RNA, 21 nt, Artificial Sequence
  Ebola virus siRNA sense strand
gccagucugcacgcgacagca

SEQ ID NO: 16580 - RNA, 21 nt, Artificial Sequence
  Ebola virus siRNA sense strand
ccagucugcacgcgacagcaa

SEQ ID NO: 16581 - RNA, 21 nt, Artificial Sequence
  Ebola virus siRNA sense strand
cagucugcacgcgacagcaau

SEQ ID NO: 16582 - RNA, 21 nt, Artificial Sequence
  Ebola virus siRNA sense strand
agucugcacgcgacagcaaua

SEQ ID NO: 16583 - RNA, 21 nt, Artificial Sequence
  Ebola virus siRNA sense strand
gucugcacgcgacagcaauau

SEQ ID NO: 16584 - RNA, 21 nt, Artificial Sequence
  Ebola virus siRNA sense strand
ucugcacgcgacagcaauauu

SEQ ID NO: 16585 - RNA, 21 nt, Artificial Sequence
  Ebola virus siRNA sense strand
cugcacgcgacagcaauauua

SEQ ID NO: 16586 - RNA, 21 nt, Artificial Sequence
  Ebola virus siRNA sense strand
ugcacgcgacagcaauauuau

SEQ ID NO: 16587 - RNA, 21 nt, Artificial Sequence
  Ebola virus siRNA sense strand
gcacgcgacagcaauauuauu

SEQ ID NO: 16588 - RNA, 21 nt, Artificial Sequence
  Ebola virus siRNA sense strand
cacgcgacagcaauauuauuu

SEQ ID NO: 16589 - RNA, 21 nt, Artificial Sequence
  Ebola virus siRNA sense strand
acgcgacagcaauauuauuuu

SEQ ID NO: 16590 - RNA, 21 nt, Artificial Sequence
  Ebola virus siRNA sense strand
cgcgacagcaauauuauuuuc

SEQ ID NO: 16591 - RNA, 21 nt, Artificial Sequence
  Ebola virus siRNA sense strand
gcgacagcaauauuauuuucc

SEQ ID NO: 16592 - RNA, 21 nt, Artificial Sequence
  Ebola virus siRNA sense strand
cgacagcaauauuauuuucca

SEQ ID NO: 16593 - RNA, 21 nt, Artificial Sequence
  Ebola virus siRNA sense strand
gacagcaauauuauuuuccag

SEQ ID NO: 16594 - RNA, 21 nt, Artificial Sequence
  Ebola virus siRNA sense strand
acagcaauauuauuuuccaga

SEQ ID NO: 16595 - RNA, 21 nt, Artificial Sequence
  Ebola virus siRNA sense strand
cagcaauauuauuuuccagaa

SEQ ID NO: 16596 - RNA, 21 nt, Artificial Sequence
  Ebola virus siRNA sense strand
agcaauauuauuuuccagaau

SEQ ID NO: 16597 - RNA, 21 nt, Artificial Sequence
  Ebola virus siRNA sense strand
gcaauauuauuuuccagaaug

SEQ ID NO: 16598 - RNA, 21 nt, Artificial Sequence
  Ebola virus siRNA sense strand
caauauuauuuuccagaaugu

SEQ ID NO: 16599 - RNA, 21 nt, Artificial Sequence
  Ebola virus siRNA sense strand
aauauuauuuuccagaauguu

SEQ ID NO: 16600 - RNA, 21 nt, Artificial Sequence
  Ebola virus siRNA sense strand
auauuauuuuccagaauguua

SEQ ID NO: 16601 - RNA, 21 nt, Artificial Sequence
  Ebola virus siRNA sense strand
uauuauuuuccagaauguuau

SEQ ID NO: 16602 - RNA, 21 nt, Artificial Sequence
  Ebola virus siRNA sense strand
auuauuuuccagaauguuaua

SEQ ID NO: 16603 - RNA, 21 nt, Artificial Sequence
  Ebola virus siRNA sense strand
uuauuuuccagaauguuauaa

SEQ ID NO: 16604 - RNA, 21 nt, Artificial Sequence
  Ebola virus siRNA sense strand
uauuuuccagaauguuauaaa

SEQ ID NO: 16605 - RNA, 21 nt, Artificial Sequence
  Ebola virus siRNA sense strand
auuuuccagaauguuauaaau

SEQ ID NO: 16606 - RNA, 21 nt, Artificial Sequence
  Ebola virus siRNA sense strand
uuuuccagaauguuauaaauu

SEQ ID NO: 16607 - RNA, 21 nt, Artificial Sequence
  Ebola virus siRNA sense strand
uuuccagaauguuauaaauua

SEQ ID NO: 16608 - RNA, 21 nt, Artificial Sequence
  Ebola virus siRNA sense strand
uuccagaauguuauaaauuau

SEQ ID NO: 16609 - RNA, 21 nt, Artificial Sequence
  Ebola virus siRNA sense strand
uccagaauguuauaaauuaug

SEQ ID NO: 16610 - RNA, 21 nt, Artificial Sequence
  Ebola virus siRNA sense strand
ccagaauguuauaaauuaugc

SEQ ID NO: 16611 - RNA, 21 nt, Artificial Sequence
  Ebola virus siRNA sense strand
cagaauguuauaaauuaugca

SEQ ID NO: 16612 - RNA, 21 nt, Artificial Sequence
  Ebola virus siRNA sense strand
agaauguuauaaauuaugcag

SEQ ID NO: 16613 - RNA, 21 nt, Artificial Sequence
  Ebola virus siRNA sense strand
gaauguuauaaauuaugcagu

SEQ ID NO: 16614 - RNA, 21 nt, Artificial Sequence
  Ebola virus siRNA sense strand
aauguuauaaauuaugcaguu

SEQ ID NO: 16615 - RNA, 21 nt, Artificial Sequence
  Ebola virus siRNA sense strand
auguuauaaauuaugcaguug

SEQ ID NO: 16616 - RNA, 21 nt, Artificial Sequence
  Ebola virus siRNA sense strand
uguuauaaauuaugcaguugc

SEQ ID NO: 16617 - RNA, 21 nt, Artificial Sequence
  Ebola virus siRNA sense strand
guuauaaauuaugcaguugca

SEQ ID NO: 16618 - RNA, 21 nt, Artificial Sequence
  Ebola virus siRNA sense strand
uuauaaauuaugcaguugcac

SEQ ID NO: 16619 - RNA, 21 nt, Artificial Sequence
  Ebola virus siRNA sense strand
uauaaauuaugcaguugcacu

SEQ ID NO: 16620 - RNA, 21 nt, Artificial Sequence
  Ebola virus siRNA sense strand
auaaauuaugcaguugcacug

SEQ ID NO: 16621 - RNA, 21 nt, Artificial Sequence
  Ebola virus siRNA sense strand
uaaauuaugcaguugcacugu

SEQ ID NO: 16622 - RNA, 21 nt, Artificial Sequence
  Ebola virus siRNA sense strand
aaauuaugcaguugcacuguu

SEQ ID NO: 16623 - RNA, 21 nt, Artificial Sequence
  Ebola virus siRNA sense strand
aauuaugcaguugcacuguuc

SEQ ID NO: 16624 - RNA, 21 nt, Artificial Sequence
  Ebola virus siRNA sense strand
auuaugcaguugcacuguucg

SEQ ID NO: 16625 - RNA, 21 nt, Artificial Sequence
  Ebola virus siRNA sense strand
uuaugcaguugcacuguucga

SEQ ID NO: 16626 - RNA, 21 nt, Artificial Sequence
  Ebola virus siRNA sense strand
uaugcaguugcacuguucgau

SEQ ID NO: 16627 - RNA, 21 nt, Artificial Sequence
  Ebola virus siRNA sense strand
augcaguugcacuguucgaua

SEQ ID NO: 16628 - RNA, 21 nt, Artificial Sequence
  Ebola virus siRNA sense strand
ugcaguugcacuguucgauau

SEQ ID NO: 16629 - RNA, 21 nt, Artificial Sequence
  Ebola virus siRNA sense strand
gcaguugcacuguucgauauu

SEQ ID NO: 16630 - RNA, 21 nt, Artificial Sequence
  Ebola virus siRNA sense strand
caguugcacuguucgauauua

SEQ ID NO: 16631 - RNA, 21 nt, Artificial Sequence
  Ebola virus siRNA sense strand
aguugcacuguucgauauuaa

SEQ ID NO: 16632 - RNA, 21 nt, Artificial Sequence
  Ebola virus siRNA sense strand
guugcacuguucgauauuaaa

SEQ ID NO: 16633 - RNA, 21 nt, Artificial Sequence
  Ebola virus siRNA sense strand
uugcacuguucgauauuaaau

SEQ ID NO: 16634 - RNA, 21 nt, Artificial Sequence
  Ebola virus siRNA sense strand
ugcacuguucgauauuaaauu

SEQ ID NO: 16635 - RNA, 21 nt, Artificial Sequence
  Ebola virus siRNA sense strand
gcacuguucgauauuaaauuu

SEQ ID NO: 16636 - RNA, 21 nt, Artificial Sequence
  Ebola virus siRNA sense strand
cacuguucgauauuaaauuua

SEQ ID NO: 16637 - RNA, 21 nt, Artificial Sequence
  Ebola virus siRNA sense strand
acuguucgauauuaaauuuag

SEQ ID NO: 16638 - RNA, 21 nt, Artificial Sequence
  Ebola virus siRNA sense strand
cuguucgauauuaaauuuaga

SEQ ID NO: 16639 - RNA, 21 nt, Artificial Sequence
  Ebola virus siRNA sense strand
uguucgauauuaaauuuagaa

SEQ ID NO: 16640 - RNA, 21 nt, Artificial Sequence
  Ebola virus siRNA sense strand
guucgauauuaaauuuagaaa

SEQ ID NO: 16641 - RNA, 21 nt, Artificial Sequence
  Ebola virus siRNA sense strand
uucgauauuaaauuuagaaac

SEQ ID NO: 16642 - RNA, 21 nt, Artificial Sequence
  Ebola virus siRNA sense strand
ucgauauuaaauuuagaaaca

SEQ ID NO: 16643 - RNA, 21 nt, Artificial Sequence
  Ebola virus siRNA sense strand
cgauauuaaauuuagaaacac

SEQ ID NO: 16644 - RNA, 21 nt, Artificial Sequence
  Ebola virus siRNA sense strand
gauauuaaauuuagaaacacu

SEQ ID NO: 16645 - RNA, 21 nt, Artificial Sequence
  Ebola virus siRNA sense strand
auauuaaauuuagaaacacug

SEQ ID NO: 16646 - RNA, 21 nt, Artificial Sequence
  Ebola virus siRNA sense strand
uauuaaauuuagaaacacuga

SEQ ID NO: 16647 - RNA, 21 nt, Artificial Sequence
  Ebola virus siRNA sense strand
auuaaauuuagaaacacugag

SEQ ID NO: 16648 - RNA, 21 nt, Artificial Sequence
  Ebola virus siRNA sense strand
uuaaauuuagaaacacugagg

SEQ ID NO: 16649 - RNA, 21 nt, Artificial Sequence
  Ebola virus siRNA sense strand
uaaauuuagaaacacugaggc

SEQ ID NO: 16650 - RNA, 21 nt, Artificial Sequence
  Ebola virus siRNA sense strand
aaauuuagaaacacugaggcu

SEQ ID NO: 16651 - RNA, 21 nt, Artificial Sequence
  Ebola virus siRNA sense strand
aauuuagaaacacugaggcua

SEQ ID NO: 16652 - RNA, 21 nt, Artificial Sequence
  Ebola virus siRNA sense strand
auuuagaaacacugaggcuac

SEQ ID NO: 16653 - RNA, 21 nt, Artificial Sequence
  Ebola virus siRNA sense strand
uuuagaaacacugaggcuaca

SEQ ID NO: 16654 - RNA, 21 nt, Artificial Sequence
  Ebola virus siRNA sense strand
uuagaaacacugaggcuacag

SEQ ID NO: 16655 - RNA, 21 nt, Artificial Sequence
  Ebola virus siRNA sense strand
uagaaacacugaggcuacaga

SEQ ID NO: 16656 - RNA, 21 nt, Artificial Sequence
  Ebola virus siRNA sense strand
agaaacacugaggcuacagau

SEQ ID NO: 16657 - RNA, 21 nt, Artificial Sequence
  Ebola virus siRNA sense strand
gaaacacugaggcuacagaua

SEQ ID NO: 16658 - RNA, 21 nt, Artificial Sequence
  Ebola virus siRNA sense strand
aaacacugaggcuacagauau

SEQ ID NO: 16659 - RNA, 21 nt, Artificial Sequence
  Ebola virus siRNA sense strand
aacacugaggcuacagauauc

SEQ ID NO: 16660 - RNA, 21 nt, Artificial Sequence
  Ebola virus siRNA sense strand
acacugaggcuacagauaucc

SEQ ID NO: 16661 - RNA, 21 nt, Artificial Sequence
  Ebola virus siRNA sense strand
cacugaggcuacagauaucca

SEQ ID NO: 16662 - RNA, 21 nt, Artificial Sequence
  Ebola virus siRNA sense strand
acugaggcuacagauauccaa

SEQ ID NO: 16663 - RNA, 21 nt, Artificial Sequence
  Ebola virus siRNA sense strand
cugaggcuacagauauccaau

SEQ ID NO: 16664 - RNA, 21 nt, Artificial Sequence
  Ebola virus siRNA sense strand
ugaggcuacagauauccaaua

SEQ ID NO: 16665 - RNA, 21 nt, Artificial Sequence
  Ebola virus siRNA sense strand
gaggcuacagauauccaauau

SEQ ID NO: 16666 - RNA, 21 nt, Artificial Sequence
  Ebola virus siRNA sense strand
aggcuacagauauccaauaua

SEQ ID NO: 16667 - RNA, 21 nt, Artificial Sequence
  Ebola virus siRNA sense strand
ggcuacagauauccaauauaa

SEQ ID NO: 16668 - RNA, 21 nt, Artificial Sequence
  Ebola virus siRNA sense strand
gcuacagauauccaauauaau

SEQ ID NO: 16669 - RNA, 21 nt, Artificial Sequence
  Ebola virus siRNA sense strand
cuacagauauccaauauaauc

SEQ ID NO: 16670 - RNA, 21 nt, Artificial Sequence
  Ebola virus siRNA sense strand
uacagauauccaauauaaucg

SEQ ID NO: 16671 - RNA, 21 nt, Artificial Sequence
  Ebola virus siRNA sense strand
acagauauccaauauaaucgu

SEQ ID NO: 16672 - RNA, 21 nt, Artificial Sequence
  Ebola virus siRNA sense strand
cagauauccaauauaaucgug

SEQ ID NO: 16673 - RNA, 21 nt, Artificial Sequence
  Ebola virus siRNA sense strand
agauauccaauauaaucgugc

SEQ ID NO: 16674 - RNA, 21 nt, Artificial Sequence
  Ebola virus siRNA sense strand
gauauccaauauaaucgugcu

SEQ ID NO: 16675 - RNA, 21 nt, Artificial Sequence
  Ebola virus siRNA sense strand
auauccaauauaaucgugcuc

SEQ ID NO: 16676 - RNA, 21 nt, Artificial Sequence
  Ebola virus siRNA sense strand
uauccaauauaaucgugcuca

SEQ ID NO: 16677 - RNA, 21 nt, Artificial Sequence
  Ebola virus siRNA sense strand
auccaauauaaucgugcucac

SEQ ID NO: 16678 - RNA, 21 nt, Artificial Sequence
  Ebola virus siRNA sense strand
uccaauauaaucgugcucacc

SEQ ID NO: 16679 - RNA, 21 nt, Artificial Sequence
  Ebola virus siRNA sense strand
ccaauauaaucgugcucaccu

SEQ ID NO: 16680 - RNA, 21 nt, Artificial Sequence
  Ebola virus siRNA sense strand
caauauaaucgugcucaccuu

SEQ ID NO: 16681 - RNA, 21 nt, Artificial Sequence
  Ebola virus siRNA sense strand
aauauaaucgugcucaccuuc

SEQ ID NO: 16682 - RNA, 21 nt, Artificial Sequence
  Ebola virus siRNA sense strand
auauaaucgugcucaccuuca

SEQ ID NO: 16683 - RNA, 21 nt, Artificial Sequence
  Ebola virus siRNA sense strand
uauaaucgugcucaccuucau

SEQ ID NO: 16684 - RNA, 21 nt, Artificial Sequence
  Ebola virus siRNA sense strand
auaaucgugcucaccuucauc

SEQ ID NO: 16685 - RNA, 21 nt, Artificial Sequence
  Ebola virus siRNA sense strand
uaaucgugcucaccuucaucu

SEQ ID NO: 16686 - RNA, 21 nt, Artificial Sequence
  Ebola virus siRNA sense strand
aaucgugcucaccuucaucua

SEQ ID NO: 16687 - RNA, 21 nt, Artificial Sequence
  Ebola virus siRNA sense strand
aucgugcucaccuucaucuaa

SEQ ID NO: 16688 - RNA, 21 nt, Artificial Sequence
  Ebola virus siRNA sense strand
ucgugcucaccuucaucuaac

SEQ ID NO: 16689 - RNA, 21 nt, Artificial Sequence
  Ebola virus siRNA sense strand
cgugcucaccuucaucuaacu

SEQ ID NO: 16690 - RNA, 21 nt, Artificial Sequence
  Ebola virus siRNA sense strand
gugcucaccuucaucuaacua

SEQ ID NO: 16691 - RNA, 21 nt, Artificial Sequence
  Ebola virus siRNA sense strand
ugcucaccuucaucuaacuaa

SEQ ID NO: 16692 - RNA, 21 nt, Artificial Sequence
  Ebola virus siRNA sense strand
gcucaccuucaucuaacuaag

SEQ ID NO: 16693 - RNA, 21 nt, Artificial Sequence
  Ebola virus siRNA sense strand
cucaccuucaucuaacuaagu

SEQ ID NO: 16694 - RNA, 21 nt, Artificial Sequence
  Ebola virus siRNA sense strand
ucaccuucaucuaacuaagug

SEQ ID NO: 16695 - RNA, 21 nt, Artificial Sequence
  Ebola virus siRNA sense strand
caccuucaucuaacuaagugu

SEQ ID NO: 16696 - RNA, 21 nt, Artificial Sequence
  Ebola virus siRNA sense strand
accuucaucuaacuaaguguu

SEQ ID NO: 16697 - RNA, 21 nt, Artificial Sequence
  Ebola virus siRNA sense strand
ccuucaucuaacuaaguguug

SEQ ID NO: 16698 - RNA, 21 nt, Artificial Sequence
  Ebola virus siRNA sense strand
cuucaucuaacuaaguguugc

SEQ ID NO: 16699 - RNA, 21 nt, Artificial Sequence
  Ebola virus siRNA sense strand
uucaucuaacuaaguguugca

SEQ ID NO: 16700 - RNA, 21 nt, Artificial Sequence
  Ebola virus siRNA sense strand
ucaucuaacuaaguguugcac

SEQ ID NO: 16701 - RNA, 21 nt, Artificial Sequence
  Ebola virus siRNA sense strand
caucuaacuaaguguugcacc

SEQ ID NO: 16702 - RNA, 21 nt, Artificial Sequence
  Ebola virus siRNA sense strand
aucuaacuaaguguugcaccc

SEQ ID NO: 16703 - RNA, 21 nt, Artificial Sequence
  Ebola virus siRNA sense strand
ucuaacuaaguguugcacccg

SEQ ID NO: 16704 - RNA, 21 nt, Artificial Sequence
  Ebola virus siRNA sense strand
cuaacuaaguguugcacccgg

SEQ ID NO: 16705 - RNA, 21 nt, Artificial Sequence
  Ebola virus siRNA sense strand
uaacuaaguguugcacccggg

SEQ ID NO: 16706 - RNA, 21 nt, Artificial Sequence
  Ebola virus siRNA sense strand
aacuaaguguugcacccggga

SEQ ID NO: 16707 - RNA, 21 nt, Artificial Sequence
  Ebola virus siRNA sense strand
acuaaguguugcacccgggaa

SEQ ID NO: 16708 - RNA, 21 nt, Artificial Sequence
  Ebola virus siRNA sense strand
cuaaguguugcacccgggaag

SEQ ID NO: 16709 - RNA, 21 nt, Artificial Sequence
  Ebola virus siRNA sense strand
uaaguguugcacccgggaagu

SEQ ID NO: 16710 - RNA, 21 nt, Artificial Sequence
  Ebola virus siRNA sense strand
aaguguugcacccgggaagua

SEQ ID NO: 16711 - RNA, 21 nt, Artificial Sequence
  Ebola virus siRNA sense strand
aguguugcacccgggaaguac

SEQ ID NO: 16712 - RNA, 21 nt, Artificial Sequence
  Ebola virus siRNA sense strand
guguugcacccgggaaguacc

SEQ ID NO: 16713 - RNA, 21 nt, Artificial Sequence
  Ebola virus siRNA sense strand
uguugcacccgggaaguacca

SEQ ID NO: 16714 - RNA, 21 nt, Artificial Sequence
  Ebola virus siRNA sense strand
guugcacccgggaaguaccag

SEQ ID NO: 16715 - RNA, 21 nt, Artificial Sequence
  Ebola virus siRNA sense strand
uugcacccgggaaguaccagc

SEQ ID NO: 16716 - RNA, 21 nt, Artificial Sequence
  Ebola virus siRNA sense strand
ugcacccgggaaguaccagcu

SEQ ID NO: 16717 - RNA, 21 nt, Artificial Sequence
  Ebola virus siRNA sense strand
gcacccgggaaguaccagcuc

SEQ ID NO: 16718 - RNA, 21 nt, Artificial Sequence
  Ebola virus siRNA sense strand
cacccgggaaguaccagcuca

SEQ ID NO: 16719 - RNA, 21 nt, Artificial Sequence
  Ebola virus siRNA sense strand
acccgggaaguaccagcucag

SEQ ID NO: 16720 - RNA, 21 nt, Artificial Sequence
  Ebola virus siRNA sense strand
cccgggaaguaccagcucagu

SEQ ID NO: 16721 - RNA, 21 nt, Artificial Sequence
  Ebola virus siRNA sense strand
ccgggaaguaccagcucagua

SEQ ID NO: 16722 - RNA, 21 nt, Artificial Sequence
  Ebola virus siRNA sense strand
cgggaaguaccagcucaguau

SEQ ID NO: 16723 - RNA, 21 nt, Artificial Sequence
  Ebola virus siRNA sense strand
gggaaguaccagcucaguauu

SEQ ID NO: 16724 - RNA, 21 nt, Artificial Sequence
  Ebola virus siRNA sense strand
ggaaguaccagcucaguauuu

SEQ ID NO: 16725 - RNA, 21 nt, Artificial Sequence
  Ebola virus siRNA sense strand
gaaguaccagcucaguauuua

SEQ ID NO: 16726 - RNA, 21 nt, Artificial Sequence
  Ebola virus siRNA sense strand
aaguaccagcucaguauuuaa

SEQ ID NO: 16727 - RNA, 21 nt, Artificial Sequence
  Ebola virus siRNA sense strand
aguaccagcucaguauuuaac

SEQ ID NO: 16728 - RNA, 21 nt, Artificial Sequence
  Ebola virus siRNA sense strand
guaccagcucaguauuuaaca

SEQ ID NO: 16729 - RNA, 21 nt, Artificial Sequence
  Ebola virus siRNA sense strand
uaccagcucaguauuuaacau

SEQ ID NO: 16730 - RNA, 21 nt, Artificial Sequence
  Ebola virus siRNA sense strand
accagcucaguauuuaacaua

SEQ ID NO: 16731 - RNA, 21 nt, Artificial Sequence
  Ebola virus siRNA sense strand
ccagcucaguauuuaacauac

SEQ ID NO: 16732 - RNA, 21 nt, Artificial Sequence
  Ebola virus siRNA sense strand
cagcucaguauuuaacauaca

SEQ ID NO: 16733 - RNA, 21 nt, Artificial Sequence
  Ebola virus siRNA sense strand
agcucaguauuuaacauacac

SEQ ID NO: 16734 - RNA, 21 nt, Artificial Sequence
  Ebola virus siRNA sense strand
gcucaguauuuaacauacaca

SEQ ID NO: 16735 - RNA, 21 nt, Artificial Sequence
  Ebola virus siRNA sense strand
cucaguauuuaacauacacau

SEQ ID NO: 16736 - RNA, 21 nt, Artificial Sequence
  Ebola virus siRNA sense strand
ucaguauuuaacauacacauc

SEQ ID NO: 16737 - RNA, 21 nt, Artificial Sequence
  Ebola virus siRNA sense strand
caguauuuaacauacacaucu

SEQ ID NO: 16738 - RNA, 21 nt, Artificial Sequence
  Ebola virus siRNA sense strand
aguauuuaacauacacaucua

SEQ ID NO: 16739 - RNA, 21 nt, Artificial Sequence
  Ebola virus siRNA sense strand
guauuuaacauacacaucuac

SEQ ID NO: 16740 - RNA, 21 nt, Artificial Sequence
  Ebola virus siRNA sense strand
uauuuaacauacacaucuaca

SEQ ID NO: 16741 - RNA, 21 nt, Artificial Sequence
  Ebola virus siRNA sense strand
auuuaacauacacaucuacau

SEQ ID NO: 16742 - RNA, 21 nt, Artificial Sequence
  Ebola virus siRNA sense strand
uuuaacauacacaucuacauu

SEQ ID NO: 16743 - RNA, 21 nt, Artificial Sequence
  Ebola virus siRNA sense strand
uuaacauacacaucuacauug

SEQ ID NO: 16744 - RNA, 21 nt, Artificial Sequence
  Ebola virus siRNA sense strand
uaacauacacaucuacauugg

SEQ ID NO: 16745 - RNA, 21 nt, Artificial Sequence
  Ebola virus siRNA sense strand
aacauacacaucuacauugga

SEQ ID NO: 16746 - RNA, 21 nt, Artificial Sequence
  Ebola virus siRNA sense strand
acauacacaucuacauuggau

SEQ ID NO: 16747 - RNA, 21 nt, Artificial Sequence
  Ebola virus siRNA sense strand
cauacacaucuacauuggauu

SEQ ID NO: 16748 - RNA, 21 nt, Artificial Sequence
  Ebola virus siRNA sense strand
auacacaucuacauuggauuu

SEQ ID NO: 16749 - RNA, 21 nt, Artificial Sequence
  Ebola virus siRNA sense strand
uacacaucuacauuggauuua

SEQ ID NO: 16750 - RNA, 21 nt, Artificial Sequence
  Ebola virus siRNA sense strand
acacaucuacauuggauuuag

SEQ ID NO: 16751 - RNA, 21 nt, Artificial Sequence
  Ebola virus siRNA sense strand
cacaucuacauuggauuuaga

SEQ ID NO: 16752 - RNA, 21 nt, Artificial Sequence
  Ebola virus siRNA sense strand
acaucuacauuggauuuagau

SEQ ID NO: 16753 - RNA, 21 nt, Artificial Sequence
  Ebola virus siRNA sense strand
caucuacauuggauuuagauu

SEQ ID NO: 16754 - RNA, 21 nt, Artificial Sequence
  Ebola virus siRNA sense strand
aucuacauuggauuuagauuu

SEQ ID NO: 16755 - RNA, 21 nt, Artificial Sequence
  Ebola virus siRNA sense strand
ucuacauuggauuuagauuua

SEQ ID NO: 16756 - RNA, 21 nt, Artificial Sequence
  Ebola virus siRNA sense strand
cuacauuggauuuagauuuaa

SEQ ID NO: 16757 - RNA, 21 nt, Artificial Sequence
  Ebola virus siRNA sense strand
uacauuggauuuagauuuaac

SEQ ID NO: 16758 - RNA, 21 nt, Artificial Sequence
  Ebola virus siRNA sense strand
acauuggauuuagauuuaaca

SEQ ID NO: 16759 - RNA, 21 nt, Artificial Sequence
  Ebola virus siRNA sense strand
cauuggauuuagauuuaacaa

SEQ ID NO: 16760 - RNA, 21 nt, Artificial Sequence
  Ebola virus siRNA sense strand
auuggauuuagauuuaacaag

SEQ ID NO: 16761 - RNA, 21 nt, Artificial Sequence
  Ebola virus siRNA sense strand
uuggauuuagauuuaacaaga

SEQ ID NO: 16762 - RNA, 21 nt, Artificial Sequence
  Ebola virus siRNA sense strand
uggauuuagauuuaacaagau

SEQ ID NO: 16763 - RNA, 21 nt, Artificial Sequence
  Ebola virus siRNA sense strand
ggauuuagauuuaacaagaua

SEQ ID NO: 16764 - RNA, 21 nt, Artificial Sequence
  Ebola virus siRNA sense strand
gauuuagauuuaacaagauac

SEQ ID NO: 16765 - RNA, 21 nt, Artificial Sequence
  Ebola virus siRNA sense strand
auuuagauuuaacaagauacc

SEQ ID NO: 16766 - RNA, 21 nt, Artificial Sequence
  Ebola virus siRNA sense strand
uuuagauuuaacaagauaccg

SEQ ID NO: 16767 - RNA, 21 nt, Artificial Sequence
  Ebola virus siRNA sense strand
uuagauuuaacaagauaccga

SEQ ID NO: 16768 - RNA, 21 nt, Artificial Sequence
  Ebola virus siRNA sense strand
uagauuuaacaagauaccgag

SEQ ID NO: 16769 - RNA, 21 nt, Artificial Sequence
  Ebola virus siRNA sense strand
agauuuaacaagauaccgaga

SEQ ID NO: 16770 - RNA, 21 nt, Artificial Sequence
  Ebola virus siRNA sense strand
gauuuaacaagauaccgagaa

SEQ ID NO: 16771 - RNA, 21 nt, Artificial Sequence
  Ebola virus siRNA sense strand
auuuaacaagauaccgagaaa

SEQ ID NO: 16772 - RNA, 21 nt, Artificial Sequence
  Ebola virus siRNA sense strand
uuuaacaagauaccgagaaaa

SEQ ID NO: 16773 - RNA, 21 nt, Artificial Sequence
  Ebola virus siRNA sense strand
uuaacaagauaccgagaaaac

SEQ ID NO: 16774 - RNA, 21 nt, Artificial Sequence
  Ebola virus siRNA sense strand
uaacaagauaccgagaaaacg

SEQ ID NO: 16775 - RNA, 21 nt, Artificial Sequence
  Ebola virus siRNA sense strand
aacaagauaccgagaaaacga

SEQ ID NO: 16776 - RNA, 21 nt, Artificial Sequence
  Ebola virus siRNA sense strand
acaagauaccgagaaaacgaa

SEQ ID NO: 16777 - RNA, 21 nt, Artificial Sequence
  Ebola virus siRNA sense strand
caagauaccgagaaaacgaau

SEQ ID NO: 16778 - RNA, 21 nt, Artificial Sequence
  Ebola virus siRNA sense strand
aagauaccgagaaaacgaauu

SEQ ID NO: 16779 - RNA, 21 nt, Artificial Sequence
  Ebola virus siRNA sense strand
agauaccgagaaaacgaauug

SEQ ID NO: 16780 - RNA, 21 nt, Artificial Sequence
  Ebola virus siRNA sense strand
gauaccgagaaaacgaauuga

SEQ ID NO: 16781 - RNA, 21 nt, Artificial Sequence
  Ebola virus siRNA sense strand
auaccgagaaaacgaauugau

SEQ ID NO: 16782 - RNA, 21 nt, Artificial Sequence
  Ebola virus siRNA sense strand
uaccgagaaaacgaauugauu

SEQ ID NO: 16783 - RNA, 21 nt, Artificial Sequence
  Ebola virus siRNA sense strand
accgagaaaacgaauugauuu

SEQ ID NO: 16784 - RNA, 21 nt, Artificial Sequence
  Ebola virus siRNA sense strand
ccgagaaaacgaauugauuua

SEQ ID NO: 16785 - RNA, 21 nt, Artificial Sequence
  Ebola virus siRNA sense strand
cgagaaaacgaauugauuuau

SEQ ID NO: 16786 - RNA, 21 nt, Artificial Sequence
  Ebola virus siRNA sense strand
gagaaaacgaauugauuuaug

SEQ ID NO: 16787 - RNA, 21 nt, Artificial Sequence
  Ebola virus siRNA sense strand
agaaaacgaauugauuuauga

SEQ ID NO: 16788 - RNA, 21 nt, Artificial Sequence
  Ebola virus siRNA sense strand
gaaaacgaauugauuuaugac

SEQ ID NO: 16789 - RNA, 21 nt, Artificial Sequence
  Ebola virus siRNA sense strand
aaaacgaauugauuuaugaca

SEQ ID NO: 16790 - RNA, 21 nt, Artificial Sequence
  Ebola virus siRNA sense strand
aaacgaauugauuuaugacag

SEQ ID NO: 16791 - RNA, 21 nt, Artificial Sequence
  Ebola virus siRNA sense strand
aacgaauugauuuaugacagu

SEQ ID NO: 16792 - RNA, 21 nt, Artificial Sequence
  Ebola virus siRNA sense strand
acgaauugauuuaugacagua

SEQ ID NO: 16793 - RNA, 21 nt, Artificial Sequence
  Ebola virus siRNA sense strand
cgaauugauuuaugacaguaa

SEQ ID NO: 16794 - RNA, 21 nt, Artificial Sequence
  Ebola virus siRNA sense strand
gaauugauuuaugacaguaau

SEQ ID NO: 16795 - RNA, 21 nt, Artificial Sequence
  Ebola virus siRNA sense strand
aauugauuuaugacaguaauc

SEQ ID NO: 16796 - RNA, 21 nt, Artificial Sequence
  Ebola virus siRNA sense strand
auugauuuaugacaguaaucc

SEQ ID NO: 16797 - RNA, 21 nt, Artificial Sequence
  Ebola virus siRNA sense strand
uugauuuaugacaguaauccu

SEQ ID NO: 16798 - RNA, 21 nt, Artificial Sequence
  Ebola virus siRNA sense strand
ugauuuaugacaguaauccuc

SEQ ID NO: 16799 - RNA, 21 nt, Artificial Sequence
  Ebola virus siRNA sense strand
gauuuaugacaguaauccucu

SEQ ID NO: 16800 - RNA, 21 nt, Artificial Sequence
  Ebola virus siRNA sense strand
auuuaugacaguaauccucua

SEQ ID NO: 16801 - RNA, 21 nt, Artificial Sequence
  Ebola virus siRNA sense strand
uuuaugacaguaauccucuaa

SEQ ID NO: 16802 - RNA, 21 nt, Artificial Sequence
  Ebola virus siRNA sense strand
uuaugacaguaauccucuaaa

SEQ ID NO: 16803 - RNA, 21 nt, Artificial Sequence
  Ebola virus siRNA sense strand
uaugacaguaauccucuaaaa

SEQ ID NO: 16804 - RNA, 21 nt, Artificial Sequence
  Ebola virus siRNA sense strand
augacaguaauccucuaaaag

SEQ ID NO: 16805 - RNA, 21 nt, Artificial Sequence
  Ebola virus siRNA sense strand
ugacaguaauccucuaaaagg

SEQ ID NO: 16806 - RNA, 21 nt, Artificial Sequence
  Ebola virus siRNA sense strand
gacaguaauccucuaaaagga

SEQ ID NO: 16807 - RNA, 21 nt, Artificial Sequence
  Ebola virus siRNA sense strand
acaguaauccucuaaaaggag

SEQ ID NO: 16808 - RNA, 21 nt, Artificial Sequence
  Ebola virus siRNA sense strand
caguaauccucuaaaaggagg

SEQ ID NO: 16809 - RNA, 21 nt, Artificial Sequence
  Ebola virus siRNA sense strand
aguaauccucuaaaaggagga

SEQ ID NO: 16810 - RNA, 21 nt, Artificial Sequence
  Ebola virus siRNA sense strand
guaauccucuaaaaggaggac

SEQ ID NO: 16811 - RNA, 21 nt, Artificial Sequence
  Ebola virus siRNA sense strand
uaauccucuaaaaggaggacu

SEQ ID NO: 16812 - RNA, 21 nt, Artificial Sequence
  Ebola virus siRNA sense strand
aauccucuaaaaggaggacuc

SEQ ID NO: 16813 - RNA, 21 nt, Artificial Sequence
  Ebola virus siRNA sense strand
auccucuaaaaggaggacuca

SEQ ID NO: 16814 - RNA, 21 nt, Artificial Sequence
  Ebola virus siRNA sense strand
uccucuaaaaggaggacucaa

SEQ ID NO: 16815 - RNA, 21 nt, Artificial Sequence
  Ebola virus siRNA sense strand
ccucuaaaaggaggacucaau

SEQ ID NO: 16816 - RNA, 21 nt, Artificial Sequence
  Ebola virus siRNA sense strand
cucuaaaaggaggacucaauu

SEQ ID NO: 16817 - RNA, 21 nt, Artificial Sequence
  Ebola virus siRNA sense strand
ucuaaaaggaggacucaauug

SEQ ID NO: 16818 - RNA, 21 nt, Artificial Sequence
  Ebola virus siRNA sense strand
cuaaaaggaggacucaauugc

SEQ ID NO: 16819 - RNA, 21 nt, Artificial Sequence
  Ebola virus siRNA sense strand
uaaaaggaggacucaauugca

SEQ ID NO: 16820 - RNA, 21 nt, Artificial Sequence
  Ebola virus siRNA sense strand
aaaaggaggacucaauugcaa

SEQ ID NO: 16821 - RNA, 21 nt, Artificial Sequence
  Ebola virus siRNA sense strand
aaaggaggacucaauugcaau

SEQ ID NO: 16822 - RNA, 21 nt, Artificial Sequence
  Ebola virus siRNA sense strand
aaggaggacucaauugcaaua

SEQ ID NO: 16823 - RNA, 21 nt, Artificial Sequence
  Ebola virus siRNA sense strand
aggaggacucaauugcaauau

SEQ ID NO: 16824 - RNA, 21 nt, Artificial Sequence
  Ebola virus siRNA sense strand
ggaggacucaauugcaauauc

SEQ ID NO: 16825 - RNA, 21 nt, Artificial Sequence
  Ebola virus siRNA sense strand
gaggacucaauugcaauaucu

SEQ ID NO: 16826 - RNA, 21 nt, Artificial Sequence
  Ebola virus siRNA sense strand
aggacucaauugcaauaucuc

SEQ ID NO: 16827 - RNA, 21 nt, Artificial Sequence
  Ebola virus siRNA sense strand
ggacucaauugcaauaucuca

SEQ ID NO: 16828 - RNA, 21 nt, Artificial Sequence
  Ebola virus siRNA sense strand
gacucaauugcaauaucucau

SEQ ID NO: 16829 - RNA, 21 nt, Artificial Sequence
  Ebola virus siRNA sense strand
acucaauugcaauaucucauu

SEQ ID NO: 16830 - RNA, 21 nt, Artificial Sequence
  Ebola virus siRNA sense strand
cucaauugcaauaucucauuc

SEQ ID NO: 16831 - RNA, 21 nt, Artificial Sequence
  Ebola virus siRNA sense strand
ucaauugcaauaucucauucg

SEQ ID NO: 16832 - RNA, 21 nt, Artificial Sequence
  Ebola virus siRNA sense strand
caauugcaauaucucauucga

SEQ ID NO: 16833 - RNA, 21 nt, Artificial Sequence
  Ebola virus siRNA sense strand
aauugcaauaucucauucgau

SEQ ID NO: 16834 - RNA, 21 nt, Artificial Sequence
  Ebola virus siRNA sense strand
auugcaauaucucauucgaua

SEQ ID NO: 16835 - RNA, 21 nt, Artificial Sequence
  Ebola virus siRNA sense strand
uugcaauaucucauucgauaa

SEQ ID NO: 16836 - RNA, 21 nt, Artificial Sequence
  Ebola virus siRNA sense strand
ugcaauaucucauucgauaau

SEQ ID NO: 16837 - RNA, 21 nt, Artificial Sequence
  Ebola virus siRNA sense strand
gcaauaucucauucgauaauc

SEQ ID NO: 16838 - RNA, 21 nt, Artificial Sequence
  Ebola virus siRNA sense strand
caauaucucauucgauaaucc

SEQ ID NO: 16839 - RNA, 21 nt, Artificial Sequence
  Ebola virus siRNA sense strand
aauaucucauucgauaaucca

SEQ ID NO: 16840 - RNA, 21 nt, Artificial Sequence
  Ebola virus siRNA sense strand
auaucucauucgauaauccau

SEQ ID NO: 16841 - RNA, 21 nt, Artificial Sequence
  Ebola virus siRNA sense strand
uaucucauucgauaauccauu

SEQ ID NO: 16842 - RNA, 21 nt, Artificial Sequence
  Ebola virus siRNA sense strand
aucucauucgauaauccauuu

SEQ ID NO: 16843 - RNA, 21 nt, Artificial Sequence
  Ebola virus siRNA sense strand
ucucauucgauaauccauuuu

SEQ ID NO: 16844 - RNA, 21 nt, Artificial Sequence
  Ebola virus siRNA sense strand
cucauucgauaauccauuuuu

SEQ ID NO: 16845 - RNA, 21 nt, Artificial Sequence
  Ebola virus siRNA sense strand
ucauucgauaauccauuuuuc

SEQ ID NO: 16846 - RNA, 21 nt, Artificial Sequence
  Ebola virus siRNA sense strand
cauucgauaauccauuuuucc

SEQ ID NO: 16847 - RNA, 21 nt, Artificial Sequence
  Ebola virus siRNA sense strand
auucgauaauccauuuuucca

SEQ ID NO: 16848 - RNA, 21 nt, Artificial Sequence
  Ebola virus siRNA sense strand
uucgauaauccauuuuuccaa

SEQ ID NO: 16849 - RNA, 21 nt, Artificial Sequence
  Ebola virus siRNA sense strand
ucgauaauccauuuuuccaag

SEQ ID NO: 16850 - RNA, 21 nt, Artificial Sequence
  Ebola virus siRNA sense strand
cgauaauccauuuuuccaagg

SEQ ID NO: 16851 - RNA, 21 nt, Artificial Sequence
  Ebola virus siRNA sense strand
gauaauccauuuuuccaaggu

SEQ ID NO: 16852 - RNA, 21 nt, Artificial Sequence
  Ebola virus siRNA sense strand
auaauccauuuuuccaaggua

SEQ ID NO: 16853 - RNA, 21 nt, Artificial Sequence
  Ebola virus siRNA sense strand
uaauccauuuuuccaagguaa

SEQ ID NO: 16854 - RNA, 21 nt, Artificial Sequence
  Ebola virus siRNA sense strand
aauccauuuuuccaagguaaa

SEQ ID NO: 16855 - RNA, 21 nt, Artificial Sequence
  Ebola virus siRNA sense strand
auccauuuuuccaagguaaac

SEQ ID NO: 16856 - RNA, 21 nt, Artificial Sequence
  Ebola virus siRNA sense strand
uccauuuuuccaagguaaacg

SEQ ID NO: 16857 - RNA, 21 nt, Artificial Sequence
  Ebola virus siRNA sense strand
ccauuuuuccaagguaaacgg

SEQ ID NO: 16858 - RNA, 21 nt, Artificial Sequence
  Ebola virus siRNA sense strand
cauuuuuccaagguaaacggc

SEQ ID NO: 16859 - RNA, 21 nt, Artificial Sequence
  Ebola virus siRNA sense strand
auuuuuccaagguaaacggcu

SEQ ID NO: 16860 - RNA, 21 nt, Artificial Sequence
  Ebola virus siRNA sense strand
uuuuuccaagguaaacggcug

SEQ ID NO: 16861 - RNA, 21 nt, Artificial Sequence
  Ebola virus siRNA sense strand
uuuuccaagguaaacggcuga

SEQ ID NO: 16862 - RNA, 21 nt, Artificial Sequence
  Ebola virus siRNA sense strand
uuuccaagguaaacggcugaa

SEQ ID NO: 16863 - RNA, 21 nt, Artificial Sequence
  Ebola virus siRNA sense strand
uuccaagguaaacggcugaac

SEQ ID NO: 16864 - RNA, 21 nt, Artificial Sequence
  Ebola virus siRNA sense strand
uccaagguaaacggcugaaca

SEQ ID NO: 16865 - RNA, 21 nt, Artificial Sequence
  Ebola virus siRNA sense strand
ccaagguaaacggcugaacau

SEQ ID NO: 16866 - RNA, 21 nt, Artificial Sequence
  Ebola virus siRNA sense strand
caagguaaacggcugaacauu

SEQ ID NO: 16867 - RNA, 21 nt, Artificial Sequence
  Ebola virus siRNA sense strand
aagguaaacggcugaacauua

SEQ ID NO: 16868 - RNA, 21 nt, Artificial Sequence
  Ebola virus siRNA sense strand
agguaaacggcugaacauuau

SEQ ID NO: 16869 - RNA, 21 nt, Artificial Sequence
  Ebola virus siRNA sense strand
gguaaacggcugaacauuaua

SEQ ID NO: 16870 - RNA, 21 nt, Artificial Sequence
  Ebola virus siRNA sense strand
guaaacggcugaacauuauag

SEQ ID NO: 16871 - RNA, 21 nt, Artificial Sequence
  Ebola virus siRNA sense strand
uaaacggcugaacauuauaga

SEQ ID NO: 16872 - RNA, 21 nt, Artificial Sequence
  Ebola virus siRNA sense strand
aaacggcugaacauuauagaa

SEQ ID NO: 16873 - RNA, 21 nt, Artificial Sequence
  Ebola virus siRNA sense strand
aacggcugaacauuauagaag

SEQ ID NO: 16874 - RNA, 21 nt, Artificial Sequence
  Ebola virus siRNA sense strand
acggcugaacauuauagaaga

SEQ ID NO: 16875 - RNA, 21 nt, Artificial Sequence
  Ebola virus siRNA sense strand
cggcugaacauuauagaagau

SEQ ID NO: 16876 - RNA, 21 nt, Artificial Sequence
  Ebola virus siRNA sense strand
ggcugaacauuauagaagaug

SEQ ID NO: 16877 - RNA, 21 nt, Artificial Sequence
  Ebola virus siRNA sense strand
gcugaacauuauagaagauga

SEQ ID NO: 16878 - RNA, 21 nt, Artificial Sequence
  Ebola virus siRNA sense strand
cugaacauuauagaagaugau

SEQ ID NO: 16879 - RNA, 21 nt, Artificial Sequence
  Ebola virus siRNA sense strand
ugaacauuauagaagaugauc

SEQ ID NO: 16880 - RNA, 21 nt, Artificial Sequence
  Ebola virus siRNA sense strand
gaacauuauagaagaugaucu

SEQ ID NO: 16881 - RNA, 21 nt, Artificial Sequence
  Ebola virus siRNA sense strand
aacauuauagaagaugaucuu

SEQ ID NO: 16882 - RNA, 21 nt, Artificial Sequence
  Ebola virus siRNA sense strand
acauuauagaagaugaucuua

SEQ ID NO: 16883 - RNA, 21 nt, Artificial Sequence
  Ebola virus siRNA sense strand
cauuauagaagaugaucuuau

SEQ ID NO: 16884 - RNA, 21 nt, Artificial Sequence
  Ebola virus siRNA sense strand
auuauagaagaugaucuuauu

SEQ ID NO: 16885 - RNA, 21 nt, Artificial Sequence
  Ebola virus siRNA sense strand
uuauagaagaugaucuuauuc

SEQ ID NO: 16886 - RNA, 21 nt, Artificial Sequence
  Ebola virus siRNA sense strand
uauagaagaugaucuuauucg

SEQ ID NO: 16887 - RNA, 21 nt, Artificial Sequence
  Ebola virus siRNA sense strand
auagaagaugaucuuauucga

SEQ ID NO: 16888 - RNA, 21 nt, Artificial Sequence
  Ebola virus siRNA sense strand
uagaagaugaucuuauucgac

SEQ ID NO: 16889 - RNA, 21 nt, Artificial Sequence
  Ebola virus siRNA sense strand
agaagaugaucuuauucgacu

SEQ ID NO: 16890 - RNA, 21 nt, Artificial Sequence
  Ebola virus siRNA sense strand
gaagaugaucuuauucgacug

SEQ ID NO: 16891 - RNA, 21 nt, Artificial Sequence
  Ebola virus siRNA sense strand
aagaugaucuuauucgacugc

SEQ ID NO: 16892 - RNA, 21 nt, Artificial Sequence
  Ebola virus siRNA sense strand
agaugaucuuauucgacugcc

SEQ ID NO: 16893 - RNA, 21 nt, Artificial Sequence
  Ebola virus siRNA sense strand
gaugaucuuauucgacugccu

SEQ ID NO: 16894 - RNA, 21 nt, Artificial Sequence
  Ebola virus siRNA sense strand
augaucuuauucgacugccuc

SEQ ID NO: 16895 - RNA, 21 nt, Artificial Sequence
  Ebola virus siRNA sense strand
ugaucuuauucgacugccuca

SEQ ID NO: 16896 - RNA, 21 nt, Artificial Sequence
  Ebola virus siRNA sense strand
gaucuuauucgacugccucac

SEQ ID NO: 16897 - RNA, 21 nt, Artificial Sequence
  Ebola virus siRNA sense strand
aucuuauucgacugccucacu

SEQ ID NO: 16898 - RNA, 21 nt, Artificial Sequence
  Ebola virus siRNA sense strand
ucuuauucgacugccucacuu

SEQ ID NO: 16899 - RNA, 21 nt, Artificial Sequence
  Ebola virus siRNA sense strand
cuuauucgacugccucacuua

SEQ ID NO: 16900 - RNA, 21 nt, Artificial Sequence
  Ebola virus siRNA sense strand
uuauucgacugccucacuuau

SEQ ID NO: 16901 - RNA, 21 nt, Artificial Sequence
  Ebola virus siRNA sense strand
uauucgacugccucacuuauc

SEQ ID NO: 16902 - RNA, 21 nt, Artificial Sequence
  Ebola virus siRNA sense strand
auucgacugccucacuuaucu

SEQ ID NO: 16903 - RNA, 21 nt, Artificial Sequence
  Ebola virus siRNA sense strand
uucgacugccucacuuaucug

SEQ ID NO: 16904 - RNA, 21 nt, Artificial Sequence
  Ebola virus siRNA sense strand
ucgacugccucacuuaucugg

SEQ ID NO: 16905 - RNA, 21 nt, Artificial Sequence
  Ebola virus siRNA sense strand
cgacugccucacuuaucugga

SEQ ID NO: 16906 - RNA, 21 nt, Artificial Sequence
  Ebola virus siRNA sense strand
gacugccucacuuaucuggau

SEQ ID NO: 16907 - RNA, 21 nt, Artificial Sequence
  Ebola virus siRNA sense strand
acugccucacuuaucuggaug

SEQ ID NO: 16908 - RNA, 21 nt, Artificial Sequence
  Ebola virus siRNA sense strand
cugccucacuuaucuggaugg

SEQ ID NO: 16909 - RNA, 21 nt, Artificial Sequence
  Ebola virus siRNA sense strand
ugccucacuuaucuggauggg

SEQ ID NO: 16910 - RNA, 21 nt, Artificial Sequence
  Ebola virus siRNA sense strand
gccucacuuaucuggauggga

SEQ ID NO: 16911 - RNA, 21 nt, Artificial Sequence
  Ebola virus siRNA sense strand
ccucacuuaucuggaugggag

SEQ ID NO: 16912 - RNA, 21 nt, Artificial Sequence
  Ebola virus siRNA sense strand
cucacuuaucuggaugggagc

SEQ ID NO: 16913 - RNA, 21 nt, Artificial Sequence
  Ebola virus siRNA sense strand
ucacuuaucuggaugggagcu

SEQ ID NO: 16914 - RNA, 21 nt, Artificial Sequence
  Ebola virus siRNA sense strand
cacuuaucuggaugggagcua

SEQ ID NO: 16915 - RNA, 21 nt, Artificial Sequence
  Ebola virus siRNA sense strand
acuuaucuggaugggagcuag

SEQ ID NO: 16916 - RNA, 21 nt, Artificial Sequence
  Ebola virus siRNA sense strand
cuuaucuggaugggagcuagc

SEQ ID NO: 16917 - RNA, 21 nt, Artificial Sequence
  Ebola virus siRNA sense strand
uuaucuggaugggagcuagcc

SEQ ID NO: 16918 - RNA, 21 nt, Artificial Sequence
  Ebola virus siRNA sense strand
uaucuggaugggagcuagcca

SEQ ID NO: 16919 - RNA, 21 nt, Artificial Sequence
  Ebola virus siRNA sense strand
aucuggaugggagcuagccaa

SEQ ID NO: 16920 - RNA, 21 nt, Artificial Sequence
  Ebola virus siRNA sense strand
ucuggaugggagcuagccaag

SEQ ID NO: 16921 - RNA, 21 nt, Artificial Sequence
  Ebola virus siRNA sense strand
cuggaugggagcuagccaaga

SEQ ID NO: 16922 - RNA, 21 nt, Artificial Sequence
  Ebola virus siRNA sense strand
uggaugggagcuagccaagac

SEQ ID NO: 16923 - RNA, 21 nt, Artificial Sequence
  Ebola virus siRNA sense strand
ggaugggagcuagccaagacc

SEQ ID NO: 16924 - RNA, 21 nt, Artificial Sequence
  Ebola virus siRNA sense strand
gaugggagcuagccaagacca

SEQ ID NO: 16925 - RNA, 21 nt, Artificial Sequence
  Ebola virus siRNA sense strand
augggagcuagccaagaccau

SEQ ID NO: 16926 - RNA, 21 nt, Artificial Sequence
  Ebola virus siRNA sense strand
ugggagcuagccaagaccauc

SEQ ID NO: 16927 - RNA, 21 nt, Artificial Sequence
  Ebola virus siRNA sense strand
gggagcuagccaagaccauca

SEQ ID NO: 16928 - RNA, 21 nt, Artificial Sequence
  Ebola virus siRNA sense strand
ggagcuagccaagaccaucau

SEQ ID NO: 16929 - RNA, 21 nt, Artificial Sequence
  Ebola virus siRNA sense strand
gagcuagccaagaccaucaug

SEQ ID NO: 16930 - RNA, 21 nt, Artificial Sequence
  Ebola virus siRNA sense strand
agcuagccaagaccaucaugc

SEQ ID NO: 16931 - RNA, 21 nt, Artificial Sequence
  Ebola virus siRNA sense strand
gcuagccaagaccaucaugca

SEQ ID NO: 16932 - RNA, 21 nt, Artificial Sequence
  Ebola virus siRNA sense strand
cuagccaagaccaucaugcaa

SEQ ID NO: 16933 - RNA, 21 nt, Artificial Sequence
  Ebola virus siRNA sense strand
uagccaagaccaucaugcaau

SEQ ID NO: 16934 - RNA, 21 nt, Artificial Sequence
  Ebola virus siRNA sense strand
agccaagaccaucaugcaauc

SEQ ID NO: 16935 - RNA, 21 nt, Artificial Sequence
  Ebola virus siRNA sense strand
gccaagaccaucaugcaauca

SEQ ID NO: 16936 - RNA, 21 nt, Artificial Sequence
  Ebola virus siRNA sense strand
ccaagaccaucaugcaaucaa

SEQ ID NO: 16937 - RNA, 21 nt, Artificial Sequence
  Ebola virus siRNA sense strand
caagaccaucaugcaaucaau

SEQ ID NO: 16938 - RNA, 21 nt, Artificial Sequence
  Ebola virus siRNA sense strand
aagaccaucaugcaaucaauu

SEQ ID NO: 16939 - RNA, 21 nt, Artificial Sequence
  Ebola virus siRNA sense strand
agaccaucaugcaaucaauua

SEQ ID NO: 16940 - RNA, 21 nt, Artificial Sequence
  Ebola virus siRNA sense strand
gaccaucaugcaaucaauuau

SEQ ID NO: 16941 - RNA, 21 nt, Artificial Sequence
  Ebola virus siRNA sense strand
accaucaugcaaucaauuauu

SEQ ID NO: 16942 - RNA, 21 nt, Artificial Sequence
  Ebola virus siRNA sense strand
ccaucaugcaaucaauuauuu

SEQ ID NO: 16943 - RNA, 21 nt, Artificial Sequence
  Ebola virus siRNA sense strand
caucaugcaaucaauuauuuc

SEQ ID NO: 16944 - RNA, 21 nt, Artificial Sequence
  Ebola virus siRNA sense strand
aucaugcaaucaauuauuuca

SEQ ID NO: 16945 - RNA, 21 nt, Artificial Sequence
  Ebola virus siRNA sense strand
ucaugcaaucaauuauuucag

SEQ ID NO: 16946 - RNA, 21 nt, Artificial Sequence
  Ebola virus siRNA sense strand
caugcaaucaauuauuucaga

SEQ ID NO: 16947 - RNA, 21 nt, Artificial Sequence
  Ebola virus siRNA sense strand
augcaaucaauuauuucagau

SEQ ID NO: 16948 - RNA, 21 nt, Artificial Sequence
  Ebola virus siRNA sense strand
ugcaaucaauuauuucagaua

SEQ ID NO: 16949 - RNA, 21 nt, Artificial Sequence
  Ebola virus siRNA sense strand
gcaaucaauuauuucagauag

SEQ ID NO: 16950 - RNA, 21 nt, Artificial Sequence
  Ebola virus siRNA sense strand
caaucaauuauuucagauagc

SEQ ID NO: 16951 - RNA, 21 nt, Artificial Sequence
  Ebola virus siRNA sense strand
aaucaauuauuucagauagca

SEQ ID NO: 16952 - RNA, 21 nt, Artificial Sequence
  Ebola virus siRNA sense strand
aucaauuauuucagauagcaa

SEQ ID NO: 16953 - RNA, 21 nt, Artificial Sequence
  Ebola virus siRNA sense strand
ucaauuauuucagauagcaac

SEQ ID NO: 16954 - RNA, 21 nt, Artificial Sequence
  Ebola virus siRNA sense strand
caauuauuucagauagcaaca

SEQ ID NO: 16955 - RNA, 21 nt, Artificial Sequence
  Ebola virus siRNA sense strand
aauuauuucagauagcaacaa

SEQ ID NO: 16956 - RNA, 21 nt, Artificial Sequence
  Ebola virus siRNA sense strand
auuauuucagauagcaacaau

SEQ ID NO: 16957 - RNA, 21 nt, Artificial Sequence
  Ebola virus siRNA sense strand
uuauuucagauagcaacaauu

SEQ ID NO: 16958 - RNA, 21 nt, Artificial Sequence
  Ebola virus siRNA sense strand
uauuucagauagcaacaauuc

SEQ ID NO: 16959 - RNA, 21 nt, Artificial Sequence
  Ebola virus siRNA sense strand
auuucagauagcaacaauuca

SEQ ID NO: 16960 - RNA, 21 nt, Artificial Sequence
  Ebola virus siRNA sense strand
uuucagauagcaacaauucau

SEQ ID NO: 16961 - RNA, 21 nt, Artificial Sequence
  Ebola virus siRNA sense strand
uucagauagcaacaauucauc

SEQ ID NO: 16962 - RNA, 21 nt, Artificial Sequence
  Ebola virus siRNA sense strand
ucagauagcaacaauucaucu

SEQ ID NO: 16963 - RNA, 21 nt, Artificial Sequence
  Ebola virus siRNA sense strand
cagauagcaacaauucaucua

SEQ ID NO: 16964 - RNA, 21 nt, Artificial Sequence
  Ebola virus siRNA sense strand
agauagcaacaauucaucuac

SEQ ID NO: 16965 - RNA, 21 nt, Artificial Sequence
  Ebola virus siRNA sense strand
gauagcaacaauucaucuaca

SEQ ID NO: 16966 - RNA, 21 nt, Artificial Sequence
  Ebola virus siRNA sense strand
auagcaacaauucaucuacag

SEQ ID NO: 16967 - RNA, 21 nt, Artificial Sequence
  Ebola virus siRNA sense strand
uagcaacaauucaucuacaga

SEQ ID NO: 16968 - RNA, 21 nt, Artificial Sequence
  Ebola virus siRNA sense strand
agcaacaauucaucuacagac

SEQ ID NO: 16969 - RNA, 21 nt, Artificial Sequence
  Ebola virus siRNA sense strand
gcaacaauucaucuacagacc

SEQ ID NO: 16970 - RNA, 21 nt, Artificial Sequence
  Ebola virus siRNA sense strand
caacaauucaucuacagaccc

SEQ ID NO: 16971 - RNA, 21 nt, Artificial Sequence
  Ebola virus siRNA sense strand
aacaauucaucuacagaccca

SEQ ID NO: 16972 - RNA, 21 nt, Artificial Sequence
  Ebola virus siRNA sense strand
acaauucaucuacagacccaa

SEQ ID NO: 16973 - RNA, 21 nt, Artificial Sequence
  Ebola virus siRNA sense strand
caauucaucuacagacccaau

SEQ ID NO: 16974 - RNA, 21 nt, Artificial Sequence
  Ebola virus siRNA sense strand
aauucaucuacagacccaauu

SEQ ID NO: 16975 - RNA, 21 nt, Artificial Sequence
  Ebola virus siRNA sense strand
auucaucuacagacccaauua

SEQ ID NO: 16976 - RNA, 21 nt, Artificial Sequence
  Ebola virus siRNA sense strand
uucaucuacagacccaauuag

SEQ ID NO: 16977 - RNA, 21 nt, Artificial Sequence
  Ebola virus siRNA sense strand
ucaucuacagacccaauuagc

SEQ ID NO: 16978 - RNA, 21 nt, Artificial Sequence
  Ebola virus siRNA sense strand
caucuacagacccaauuagca

SEQ ID NO: 16979 - RNA, 21 nt, Artificial Sequence
  Ebola virus siRNA sense strand
aucuacagacccaauuagcag

SEQ ID NO: 16980 - RNA, 21 nt, Artificial Sequence
  Ebola virus siRNA sense strand
ucuacagacccaauuagcagu

SEQ ID NO: 16981 - RNA, 21 nt, Artificial Sequence
  Ebola virus siRNA sense strand
cuacagacccaauuagcagug

SEQ ID NO: 16982 - RNA, 21 nt, Artificial Sequence
  Ebola virus siRNA sense strand
uacagacccaauuagcagugg

SEQ ID NO: 16983 - RNA, 21 nt, Artificial Sequence
  Ebola virus siRNA sense strand
acagacccaauuagcagugga

SEQ ID NO: 16984 - RNA, 21 nt, Artificial Sequence
  Ebola virus siRNA sense strand
cagacccaauuagcaguggag

SEQ ID NO: 16985 - RNA, 21 nt, Artificial Sequence
  Ebola virus siRNA sense strand
agacccaauuagcaguggaga

SEQ ID NO: 16986 - RNA, 21 nt, Artificial Sequence
  Ebola virus siRNA sense strand
gacccaauuagcaguggagaa

SEQ ID NO: 16987 - RNA, 21 nt, Artificial Sequence
  Ebola virus siRNA sense strand
acccaauuagcaguggagaaa

SEQ ID NO: 16988 - RNA, 21 nt, Artificial Sequence
  Ebola virus siRNA sense strand
cccaauuagcaguggagaaac

SEQ ID NO: 16989 - RNA, 21 nt, Artificial Sequence
  Ebola virus siRNA sense strand
ccaauuagcaguggagaaaca

SEQ ID NO: 16990 - RNA, 21 nt, Artificial Sequence
  Ebola virus siRNA sense strand
caauuagcaguggagaaacaa

SEQ ID NO: 16991 - RNA, 21 nt, Artificial Sequence
  Ebola virus siRNA sense strand
aauuagcaguggagaaacaag

SEQ ID NO: 16992 - RNA, 21 nt, Artificial Sequence
  Ebola virus siRNA sense strand
auuagcaguggagaaacaaga

SEQ ID NO: 16993 - RNA, 21 nt, Artificial Sequence
  Ebola virus siRNA sense strand
uuagcaguggagaaacaagau

SEQ ID NO: 16994 - RNA, 21 nt, Artificial Sequence
  Ebola virus siRNA sense strand
uagcaguggagaaacaagauc

SEQ ID NO: 16995 - RNA, 21 nt, Artificial Sequence
  Ebola virus siRNA sense strand
agcaguggagaaacaagauca

SEQ ID NO: 16996 - RNA, 21 nt, Artificial Sequence
  Ebola virus siRNA sense strand
gcaguggagaaacaagaucau

SEQ ID NO: 16997 - RNA, 21 nt, Artificial Sequence
  Ebola virus siRNA sense strand
caguggagaaacaagaucauu

SEQ ID NO: 16998 - RNA, 21 nt, Artificial Sequence
  Ebola virus siRNA sense strand
aguggagaaacaagaucauuc

SEQ ID NO: 16999 - RNA, 21 nt, Artificial Sequence
  Ebola virus siRNA sense strand
guggagaaacaagaucauuca

SEQ ID NO: 17000 - RNA, 21 nt, Artificial Sequence
  Ebola virus siRNA sense strand
uggagaaacaagaucauucac

SEQ ID NO: 17001 - RNA, 21 nt, Artificial Sequence
  Ebola virus siRNA sense strand
ggagaaacaagaucauucacu

SEQ ID NO: 17002 - RNA, 21 nt, Artificial Sequence
  Ebola virus siRNA sense strand
gagaaacaagaucauucacua

SEQ ID NO: 17003 - RNA, 21 nt, Artificial Sequence
  Ebola virus siRNA sense strand
agaaacaagaucauucacuac

SEQ ID NO: 17004 - RNA, 21 nt, Artificial Sequence
  Ebola virus siRNA sense strand
gaaacaagaucauucacuacc

SEQ ID NO: 17005 - RNA, 21 nt, Artificial Sequence
  Ebola virus siRNA sense strand
aaacaagaucauucacuaccc

SEQ ID NO: 17006 - RNA, 21 nt, Artificial Sequence
  Ebola virus siRNA sense strand
aacaagaucauucacuaccca

SEQ ID NO: 17007 - RNA, 21 nt, Artificial Sequence
  Ebola virus siRNA sense strand
acaagaucauucacuacccau

SEQ ID NO: 17008 - RNA, 21 nt, Artificial Sequence
  Ebola virus siRNA sense strand
caagaucauucacuacccauu

SEQ ID NO: 17009 - RNA, 21 nt, Artificial Sequence
  Ebola virus siRNA sense strand
aagaucauucacuacccauuu

SEQ ID NO: 17010 - RNA, 21 nt, Artificial Sequence
  Ebola virus siRNA sense strand
agaucauucacuacccauuuc

SEQ ID NO: 17011 - RNA, 21 nt, Artificial Sequence
  Ebola virus siRNA sense strand
gaucauucacuacccauuucu

SEQ ID NO: 17012 - RNA, 21 nt, Artificial Sequence
  Ebola virus siRNA sense strand
aucauucacuacccauuucuu

SEQ ID NO: 17013 - RNA, 21 nt, Artificial Sequence
  Ebola virus siRNA sense strand
ucauucacuacccauuucuua

SEQ ID NO: 17014 - RNA, 21 nt, Artificial Sequence
  Ebola virus siRNA sense strand
cauucacuacccauuucuuaa

SEQ ID NO: 17015 - RNA, 21 nt, Artificial Sequence
  Ebola virus siRNA sense strand
auucacuacccauuucuuaac

SEQ ID NO: 17016 - RNA, 21 nt, Artificial Sequence
  Ebola virus siRNA sense strand
uucacuacccauuucuuaacu

SEQ ID NO: 17017 - RNA, 21 nt, Artificial Sequence
  Ebola virus siRNA sense strand
ucacuacccauuucuuaacuu

SEQ ID NO: 17018 - RNA, 21 nt, Artificial Sequence
  Ebola virus siRNA sense strand
cacuacccauuucuuaacuua

SEQ ID NO: 17019 - RNA, 21 nt, Artificial Sequence
  Ebola virus siRNA sense strand
acuacccauuucuuaacuuau

SEQ ID NO: 17020 - RNA, 21 nt, Artificial Sequence
  Ebola virus siRNA sense strand
cuacccauuucuuaacuuauc

SEQ ID NO: 17021 - RNA, 21 nt, Artificial Sequence
  Ebola virus siRNA sense strand
uacccauuucuuaacuuaucc

SEQ ID NO: 17022 - RNA, 21 nt, Artificial Sequence
  Ebola virus siRNA sense strand
acccauuucuuaacuuauccc

SEQ ID NO: 17023 - RNA, 21 nt, Artificial Sequence
  Ebola virus siRNA sense strand
cccauuucuuaacuuauccca

SEQ ID NO: 17024 - RNA, 21 nt, Artificial Sequence
  Ebola virus siRNA sense strand
ccauuucuuaacuuaucccaa

SEQ ID NO: 17025 - RNA, 21 nt, Artificial Sequence
  Ebola virus siRNA sense strand
cauuucuuaacuuaucccaag

SEQ ID NO: 17026 - RNA, 21 nt, Artificial Sequence
  Ebola virus siRNA sense strand
auuucuuaacuuaucccaaga

SEQ ID NO: 17027 - RNA, 21 nt, Artificial Sequence
  Ebola virus siRNA sense strand
uuucuuaacuuaucccaagau

SEQ ID NO: 17028 - RNA, 21 nt, Artificial Sequence
  Ebola virus siRNA sense strand
uucuuaacuuaucccaagaua

SEQ ID NO: 17029 - RNA, 21 nt, Artificial Sequence
  Ebola virus siRNA sense strand
ucuuaacuuaucccaagauag

SEQ ID NO: 17030 - RNA, 21 nt, Artificial Sequence
  Ebola virus siRNA sense strand
cuuaacuuaucccaagauagg

SEQ ID NO: 17031 - RNA, 21 nt, Artificial Sequence
  Ebola virus siRNA sense strand
uuaacuuaucccaagauagga

SEQ ID NO: 17032 - RNA, 21 nt, Artificial Sequence
  Ebola virus siRNA sense strand
uaacuuaucccaagauaggac

SEQ ID NO: 17033 - RNA, 21 nt, Artificial Sequence
  Ebola virus siRNA sense strand
aacuuaucccaagauaggacu

SEQ ID NO: 17034 - RNA, 21 nt, Artificial Sequence
  Ebola virus siRNA sense strand
acuuaucccaagauaggacuu

SEQ ID NO: 17035 - RNA, 21 nt, Artificial Sequence
  Ebola virus siRNA sense strand
cuuaucccaagauaggacuuc

SEQ ID NO: 17036 - RNA, 21 nt, Artificial Sequence
  Ebola virus siRNA sense strand
uuaucccaagauaggacuucu

SEQ ID NO: 17037 - RNA, 21 nt, Artificial Sequence
  Ebola virus siRNA sense strand
uaucccaagauaggacuucug

SEQ ID NO: 17038 - RNA, 21 nt, Artificial Sequence
  Ebola virus siRNA sense strand
aucccaagauaggacuucugu

SEQ ID NO: 17039 - RNA, 21 nt, Artificial Sequence
  Ebola virus siRNA sense strand
ucccaagauaggacuucugua

SEQ ID NO: 17040 - RNA, 21 nt, Artificial Sequence
  Ebola virus siRNA sense strand
cccaagauaggacuucuguac

SEQ ID NO: 17041 - RNA, 21 nt, Artificial Sequence
  Ebola virus siRNA sense strand
ccaagauaggacuucuguaca

SEQ ID NO: 17042 - RNA, 21 nt, Artificial Sequence
  Ebola virus siRNA sense strand
caagauaggacuucuguacag

SEQ ID NO: 17043 - RNA, 21 nt, Artificial Sequence
  Ebola virus siRNA sense strand
aagauaggacuucuguacagu

SEQ ID NO: 17044 - RNA, 21 nt, Artificial Sequence
  Ebola virus siRNA sense strand
agauaggacuucuguacaguu

SEQ ID NO: 17045 - RNA, 21 nt, Artificial Sequence
  Ebola virus siRNA sense strand
gauaggacuucuguacaguuu

SEQ ID NO: 17046 - RNA, 21 nt, Artificial Sequence
  Ebola virus siRNA sense strand
auaggacuucuguacaguuuu

SEQ ID NO: 17047 - RNA, 21 nt, Artificial Sequence
  Ebola virus siRNA sense strand
uaggacuucuguacaguuuug

SEQ ID NO: 17048 - RNA, 21 nt, Artificial Sequence
  Ebola virus siRNA sense strand
aggacuucuguacaguuuugg

SEQ ID NO: 17049 - RNA, 21 nt, Artificial Sequence
  Ebola virus siRNA sense strand
ggacuucuguacaguuuuggg

SEQ ID NO: 17050 - RNA, 21 nt, Artificial Sequence
  Ebola virus siRNA sense strand
gacuucuguacaguuuugggg

SEQ ID NO: 17051 - RNA, 21 nt, Artificial Sequence
  Ebola virus siRNA sense strand
acuucuguacaguuuuggggc

SEQ ID NO: 17052 - RNA, 21 nt, Artificial Sequence
  Ebola virus siRNA sense strand
cuucuguacaguuuuggggcc

SEQ ID NO: 17053 - RNA, 21 nt, Artificial Sequence
  Ebola virus siRNA sense strand
uucuguacaguuuuggggccu

SEQ ID NO: 17054 - RNA, 21 nt, Artificial Sequence
  Ebola virus siRNA sense strand
ucuguacaguuuuggggccuu

SEQ ID NO: 17055 - RNA, 21 nt, Artificial Sequence
  Ebola virus siRNA sense strand
cuguacaguuuuggggccuuu

SEQ ID NO: 17056 - RNA, 21 nt, Artificial Sequence
  Ebola virus siRNA sense strand
uguacaguuuuggggccuuug

SEQ ID NO: 17057 - RNA, 21 nt, Artificial Sequence
  Ebola virus siRNA sense strand
guacaguuuuggggccuuugu

SEQ ID NO: 17058 - RNA, 21 nt, Artificial Sequence
  Ebola virus siRNA sense strand
uacaguuuuggggccuuugua

SEQ ID NO: 17059 - RNA, 21 nt, Artificial Sequence
  Ebola virus siRNA sense strand
acaguuuuggggccuuuguaa

SEQ ID NO: 17060 - RNA, 21 nt, Artificial Sequence
  Ebola virus siRNA sense strand
caguuuuggggccuuuguaag

SEQ ID NO: 17061 - RNA, 21 nt, Artificial Sequence
  Ebola virus siRNA sense strand
aguuuuggggccuuuguaagu

SEQ ID NO: 17062 - RNA, 21 nt, Artificial Sequence
  Ebola virus siRNA sense strand
guuuuggggccuuuguaaguu

SEQ ID NO: 17063 - RNA, 21 nt, Artificial Sequence
  Ebola virus siRNA sense strand
uuuuggggccuuuguaaguua

SEQ ID NO: 17064 - RNA, 21 nt, Artificial Sequence
  Ebola virus siRNA sense strand
uuuggggccuuuguaaguuau

SEQ ID NO: 17065 - RNA, 21 nt, Artificial Sequence
  Ebola virus siRNA sense strand
uuggggccuuuguaaguuauu

SEQ ID NO: 17066 - RNA, 21 nt, Artificial Sequence
  Ebola virus siRNA sense strand
uggggccuuuguaaguuauua

SEQ ID NO: 17067 - RNA, 21 nt, Artificial Sequence
  Ebola virus siRNA sense strand
ggggccuuuguaaguuauuau

SEQ ID NO: 17068 - RNA, 21 nt, Artificial Sequence
  Ebola virus siRNA sense strand
gggccuuuguaaguuauuauc

SEQ ID NO: 17069 - RNA, 21 nt, Artificial Sequence
  Ebola virus siRNA sense strand
ggccuuuguaaguuauuaucu

SEQ ID NO: 17070 - RNA, 21 nt, Artificial Sequence
  Ebola virus siRNA sense strand
gccuuuguaaguuauuaucuu

SEQ ID NO: 17071 - RNA, 21 nt, Artificial Sequence
  Ebola virus siRNA sense strand
ccuuuguaaguuauuaucuug

SEQ ID NO: 17072 - RNA, 21 nt, Artificial Sequence
  Ebola virus siRNA sense strand
cuuuguaaguuauuaucuugg

SEQ ID NO: 17073 - RNA, 21 nt, Artificial Sequence
  Ebola virus siRNA sense strand
uuuguaaguuauuaucuuggc

SEQ ID NO: 17074 - RNA, 21 nt, Artificial Sequence
  Ebola virus siRNA sense strand
uuguaaguuauuaucuuggca

SEQ ID NO: 17075 - RNA, 21 nt, Artificial Sequence
  Ebola virus siRNA sense strand
uguaaguuauuaucuuggcaa

SEQ ID NO: 17076 - RNA, 21 nt, Artificial Sequence
  Ebola virus siRNA sense strand
guaaguuauuaucuuggcaau

SEQ ID NO: 17077 - RNA, 21 nt, Artificial Sequence
  Ebola virus siRNA sense strand
uaaguuauuaucuuggcaaua

SEQ ID NO: 17078 - RNA, 21 nt, Artificial Sequence
  Ebola virus siRNA sense strand
aaguuauuaucuuggcaauac

SEQ ID NO: 17079 - RNA, 21 nt, Artificial Sequence
  Ebola virus siRNA sense strand
aguuauuaucuuggcaauaca

SEQ ID NO: 17080 - RNA, 21 nt, Artificial Sequence
  Ebola virus siRNA sense strand
guuauuaucuuggcaauacaa

SEQ ID NO: 17081 - RNA, 21 nt, Artificial Sequence
  Ebola virus siRNA sense strand
uuauuaucuuggcaauacaau

SEQ ID NO: 17082 - RNA, 21 nt, Artificial Sequence
  Ebola virus siRNA sense strand
uauuaucuuggcaauacaauu

SEQ ID NO: 17083 - RNA, 21 nt, Artificial Sequence
  Ebola virus siRNA sense strand
auuaucuuggcaauacaauuc

SEQ ID NO: 17084 - RNA, 21 nt, Artificial Sequence
  Ebola virus siRNA sense strand
uuaucuuggcaauacaauucu

SEQ ID NO: 17085 - RNA, 21 nt, Artificial Sequence
  Ebola virus siRNA sense strand
uaucuuggcaauacaauucuu

SEQ ID NO: 17086 - RNA, 21 nt, Artificial Sequence
  Ebola virus siRNA sense strand
aucuuggcaauacaauucuuc

SEQ ID NO: 17087 - RNA, 21 nt, Artificial Sequence
  Ebola virus siRNA sense strand
ucuuggcaauacaauucuucg

SEQ ID NO: 17088 - RNA, 21 nt, Artificial Sequence
  Ebola virus siRNA sense strand
cuuggcaauacaauucuucgg

SEQ ID NO: 17089 - RNA, 21 nt, Artificial Sequence
  Ebola virus siRNA sense strand
uuggcaauacaauucuucgga

SEQ ID NO: 17090 - RNA, 21 nt, Artificial Sequence
  Ebola virus siRNA sense strand
uggcaauacaauucuucggac

SEQ ID NO: 17091 - RNA, 21 nt, Artificial Sequence
  Ebola virus siRNA sense strand
ggcaauacaauucuucggacu

SEQ ID NO: 17092 - RNA, 21 nt, Artificial Sequence
  Ebola virus siRNA sense strand
gcaauacaauucuucggacua

SEQ ID NO: 17093 - RNA, 21 nt, Artificial Sequence
  Ebola virus siRNA sense strand
caauacaauucuucggacuaa

SEQ ID NO: 17094 - RNA, 21 nt, Artificial Sequence
  Ebola virus siRNA sense strand
aauacaauucuucggacuaag

SEQ ID NO: 17095 - RNA, 21 nt, Artificial Sequence
  Ebola virus siRNA sense strand
auacaauucuucggacuaaga

SEQ ID NO: 17096 - RNA, 21 nt, Artificial Sequence
  Ebola virus siRNA sense strand
uacaauucuucggacuaagaa

SEQ ID NO: 17097 - RNA, 21 nt, Artificial Sequence
  Ebola virus siRNA sense strand
acaauucuucggacuaagaaa

SEQ ID NO: 17098 - RNA, 21 nt, Artificial Sequence
  Ebola virus siRNA sense strand
caauucuucggacuaagaaau

SEQ ID NO: 17099 - RNA, 21 nt, Artificial Sequence
  Ebola virus siRNA sense strand
aauucuucggacuaagaaauu

SEQ ID NO: 17100 - RNA, 21 nt, Artificial Sequence
  Ebola virus siRNA sense strand
auucuucggacuaagaaauua

SEQ ID NO: 17101 - RNA, 21 nt, Artificial Sequence
  Ebola virus siRNA sense strand
uucuucggacuaagaaauuaa

SEQ ID NO: 17102 - RNA, 21 nt, Artificial Sequence
  Ebola virus siRNA sense strand
ucuucggacuaagaaauuaac

SEQ ID NO: 17103 - RNA, 21 nt, Artificial Sequence
  Ebola virus siRNA sense strand
cuucggacuaagaaauuaaca

SEQ ID NO: 17104 - RNA, 21 nt, Artificial Sequence
  Ebola virus siRNA sense strand
uucggacuaagaaauuaacac

SEQ ID NO: 17105 - RNA, 21 nt, Artificial Sequence
  Ebola virus siRNA sense strand
ucggacuaagaaauuaacacu

SEQ ID NO: 17106 - RNA, 21 nt, Artificial Sequence
  Ebola virus siRNA sense strand
cggacuaagaaauuaacacuu

SEQ ID NO: 17107 - RNA, 21 nt, Artificial Sequence
  Ebola virus siRNA sense strand
ggacuaagaaauuaacacuug

SEQ ID NO: 17108 - RNA, 21 nt, Artificial Sequence
  Ebola virus siRNA sense strand
gacuaagaaauuaacacuuga

SEQ ID NO: 17109 - RNA, 21 nt, Artificial Sequence
  Ebola virus siRNA sense strand
acuaagaaauuaacacuugac

SEQ ID NO: 17110 - RNA, 21 nt, Artificial Sequence
  Ebola virus siRNA sense strand
cuaagaaauuaacacuugaca

SEQ ID NO: 17111 - RNA, 21 nt, Artificial Sequence
  Ebola virus siRNA sense strand
uaagaaauuaacacuugacaa

SEQ ID NO: 17112 - RNA, 21 nt, Artificial Sequence
  Ebola virus siRNA sense strand
aagaaauuaacacuugacaau

SEQ ID NO: 17113 - RNA, 21 nt, Artificial Sequence
  Ebola virus siRNA sense strand
agaaauuaacacuugacaauu

SEQ ID NO: 17114 - RNA, 21 nt, Artificial Sequence
  Ebola virus siRNA sense strand
gaaauuaacacuugacaauuu

SEQ ID NO: 17115 - RNA, 21 nt, Artificial Sequence
  Ebola virus siRNA sense strand
aaauuaacacuugacaauuuu

SEQ ID NO: 17116 - RNA, 21 nt, Artificial Sequence
  Ebola virus siRNA sense strand
aauuaacacuugacaauuuuu

SEQ ID NO: 17117 - RNA, 21 nt, Artificial Sequence
  Ebola virus siRNA sense strand
auuaacacuugacaauuuuuu

SEQ ID NO: 17118 - RNA, 21 nt, Artificial Sequence
  Ebola virus siRNA sense strand
uuaacacuugacaauuuuuua

SEQ ID NO: 17119 - RNA, 21 nt, Artificial Sequence
  Ebola virus siRNA sense strand
uaacacuugacaauuuuuuau

SEQ ID NO: 17120 - RNA, 21 nt, Artificial Sequence
  Ebola virus siRNA sense strand
aacacuugacaauuuuuuaua

SEQ ID NO: 17121 - RNA, 21 nt, Artificial Sequence
  Ebola virus siRNA sense strand
acacuugacaauuuuuuauau

SEQ ID NO: 17122 - RNA, 21 nt, Artificial Sequence
  Ebola virus siRNA sense strand
cacuugacaauuuuuuauauu

SEQ ID NO: 17123 - RNA, 21 nt, Artificial Sequence
  Ebola virus siRNA sense strand
acuugacaauuuuuuauauua

SEQ ID NO: 17124 - RNA, 21 nt, Artificial Sequence
  Ebola virus siRNA sense strand
cuugacaauuuuuuauauuac

SEQ ID NO: 17125 - RNA, 21 nt, Artificial Sequence
  Ebola virus siRNA sense strand
uugacaauuuuuuauauuacu

SEQ ID NO: 17126 - RNA, 21 nt, Artificial Sequence
  Ebola virus siRNA sense strand
ugacaauuuuuuauauuacuu

SEQ ID NO: 17127 - RNA, 21 nt, Artificial Sequence
  Ebola virus siRNA sense strand
gacaauuuuuuauauuacuua

SEQ ID NO: 17128 - RNA, 21 nt, Artificial Sequence
  Ebola virus siRNA sense strand
acaauuuuuuauauuacuuaa

SEQ ID NO: 17129 - RNA, 21 nt, Artificial Sequence
  Ebola virus siRNA sense strand
caauuuuuuauauuacuuaac

SEQ ID NO: 17130 - RNA, 21 nt, Artificial Sequence
  Ebola virus siRNA sense strand
aauuuuuuauauuacuuaacu

SEQ ID NO: 17131 - RNA, 21 nt, Artificial Sequence
  Ebola virus siRNA sense strand
auuuuuuauauuacuuaacua

SEQ ID NO: 17132 - RNA, 21 nt, Artificial Sequence
  Ebola virus siRNA sense strand
uuuuuuauauuacuuaacuac

SEQ ID NO: 17133 - RNA, 21 nt, Artificial Sequence
  Ebola virus siRNA sense strand
uuuuuauauuacuuaacuacu

SEQ ID NO: 17134 - RNA, 21 nt, Artificial Sequence
  Ebola virus siRNA sense strand
uuuuauauuacuuaacuacuc

SEQ ID NO: 17135 - RNA, 21 nt, Artificial Sequence
  Ebola virus siRNA sense strand
uuuauauuacuuaacuacuca

SEQ ID NO: 17136 - RNA, 21 nt, Artificial Sequence
  Ebola virus siRNA sense strand
uuauauuacuuaacuacucaa

SEQ ID NO: 17137 - RNA, 21 nt, Artificial Sequence
  Ebola virus siRNA sense strand
uauauuacuuaacuacucaaa

SEQ ID NO: 17138 - RNA, 21 nt, Artificial Sequence
  Ebola virus siRNA sense strand
auauuacuuaacuacucaaau

SEQ ID NO: 17139 - RNA, 21 nt, Artificial Sequence
  Ebola virus siRNA sense strand
uauuacuuaacuacucaaauu

SEQ ID NO: 17140 - RNA, 21 nt, Artificial Sequence
  Ebola virus siRNA sense strand
auuacuuaacuacucaaauuc

SEQ ID NO: 17141 - RNA, 21 nt, Artificial Sequence
  Ebola virus siRNA sense strand
uuacuuaacuacucaaauuca

SEQ ID NO: 17142 - RNA, 21 nt, Artificial Sequence
  Ebola virus siRNA sense strand
uacuuaacuacucaaauucau

SEQ ID NO: 17143 - RNA, 21 nt, Artificial Sequence
  Ebola virus siRNA sense strand
acuuaacuacucaaauucaua

SEQ ID NO: 17144 - RNA, 21 nt, Artificial Sequence
  Ebola virus siRNA sense strand
cuuaacuacucaaauucauaa

SEQ ID NO: 17145 - RNA, 21 nt, Artificial Sequence
  Ebola virus siRNA sense strand
uuaacuacucaaauucauaau

SEQ ID NO: 17146 - RNA, 21 nt, Artificial Sequence
  Ebola virus siRNA sense strand
uaacuacucaaauucauaauc

SEQ ID NO: 17147 - RNA, 21 nt, Artificial Sequence
  Ebola virus siRNA sense strand
aacuacucaaauucauaaucu

SEQ ID NO: 17148 - RNA, 21 nt, Artificial Sequence
  Ebola virus siRNA sense strand
acuacucaaauucauaaucua

SEQ ID NO: 17149 - RNA, 21 nt, Artificial Sequence
  Ebola virus siRNA sense strand
cuacucaaauucauaaucuac

SEQ ID NO: 17150 - RNA, 21 nt, Artificial Sequence
  Ebola virus siRNA sense strand
uacucaaauucauaaucuacc

SEQ ID NO: 17151 - RNA, 21 nt, Artificial Sequence
  Ebola virus siRNA sense strand
acucaaauucauaaucuacca

SEQ ID NO: 17152 - RNA, 21 nt, Artificial Sequence
  Ebola virus siRNA sense strand
cucaaauucauaaucuaccac

SEQ ID NO: 17153 - RNA, 21 nt, Artificial Sequence
  Ebola virus siRNA sense strand
ucaaauucauaaucuaccaca

SEQ ID NO: 17154 - RNA, 21 nt, Artificial Sequence
  Ebola virus siRNA sense strand
caaauucauaaucuaccacau

SEQ ID NO: 17155 - RNA, 21 nt, Artificial Sequence
  Ebola virus siRNA sense strand
aaauucauaaucuaccacauc

SEQ ID NO: 17156 - RNA, 21 nt, Artificial Sequence
  Ebola virus siRNA sense strand
aauucauaaucuaccacaucg

SEQ ID NO: 17157 - RNA, 21 nt, Artificial Sequence
  Ebola virus siRNA sense strand
auucauaaucuaccacaucgc

SEQ ID NO: 17158 - RNA, 21 nt, Artificial Sequence
  Ebola virus siRNA sense strand
uucauaaucuaccacaucgcu

SEQ ID NO: 17159 - RNA, 21 nt, Artificial Sequence
  Ebola virus siRNA sense strand
ucauaaucuaccacaucgcuc

SEQ ID NO: 17160 - RNA, 21 nt, Artificial Sequence
  Ebola virus siRNA sense strand
cauaaucuaccacaucgcuca

SEQ ID NO: 17161 - RNA, 21 nt, Artificial Sequence
  Ebola virus siRNA sense strand
auaaucuaccacaucgcucau

SEQ ID NO: 17162 - RNA, 21 nt, Artificial Sequence
  Ebola virus siRNA sense strand
uaaucuaccacaucgcucauu

SEQ ID NO: 17163 - RNA, 21 nt, Artificial Sequence
  Ebola virus siRNA sense strand
aaucuaccacaucgcucauug

SEQ ID NO: 17164 - RNA, 21 nt, Artificial Sequence
  Ebola virus siRNA sense strand
aucuaccacaucgcucauugc

SEQ ID NO: 17165 - RNA, 21 nt, Artificial Sequence
  Ebola virus siRNA sense strand
ucuaccacaucgcucauugcg

SEQ ID NO: 17166 - RNA, 21 nt, Artificial Sequence
  Ebola virus siRNA sense strand
cuaccacaucgcucauugcga

SEQ ID NO: 17167 - RNA, 21 nt, Artificial Sequence
  Ebola virus siRNA sense strand
uaccacaucgcucauugcgaa

SEQ ID NO: 17168 - RNA, 21 nt, Artificial Sequence
  Ebola virus siRNA sense strand
accacaucgcucauugcgaau

SEQ ID NO: 17169 - RNA, 21 nt, Artificial Sequence
  Ebola virus siRNA sense strand
ccacaucgcucauugcgaaua

SEQ ID NO: 17170 - RNA, 21 nt, Artificial Sequence
  Ebola virus siRNA sense strand
cacaucgcucauugcgaauac

SEQ ID NO: 17171 - RNA, 21 nt, Artificial Sequence
  Ebola virus siRNA sense strand
acaucgcucauugcgaauacu

SEQ ID NO: 17172 - RNA, 21 nt, Artificial Sequence
  Ebola virus siRNA sense strand
caucgcucauugcgaauacuu

SEQ ID NO: 17173 - RNA, 21 nt, Artificial Sequence
  Ebola virus siRNA sense strand
aucgcucauugcgaauacuua

SEQ ID NO: 17174 - RNA, 21 nt, Artificial Sequence
  Ebola virus siRNA sense strand
ucgcucauugcgaauacuuaa

SEQ ID NO: 17175 - RNA, 21 nt, Artificial Sequence
  Ebola virus siRNA sense strand
cgcucauugcgaauacuuaag

SEQ ID NO: 17176 - RNA, 21 nt, Artificial Sequence
  Ebola virus siRNA sense strand
gcucauugcgaauacuuaagc

SEQ ID NO: 17177 - RNA, 21 nt, Artificial Sequence
  Ebola virus siRNA sense strand
cucauugcgaauacuuaagcc

SEQ ID NO: 17178 - RNA, 21 nt, Artificial Sequence
  Ebola virus siRNA sense strand
ucauugcgaauacuuaagcca

SEQ ID NO: 17179 - RNA, 21 nt, Artificial Sequence
  Ebola virus siRNA sense strand
cauugcgaauacuuaagccaa

SEQ ID NO: 17180 - RNA, 21 nt, Artificial Sequence
  Ebola virus siRNA sense strand
auugcgaauacuuaagccaac

SEQ ID NO: 17181 - RNA, 21 nt, Artificial Sequence
  Ebola virus siRNA sense strand
uugcgaauacuuaagccaaca

SEQ ID NO: 17182 - RNA, 21 nt, Artificial Sequence
  Ebola virus siRNA sense strand
ugcgaauacuuaagccaacau

SEQ ID NO: 17183 - RNA, 21 nt, Artificial Sequence
  Ebola virus siRNA sense strand
gcgaauacuuaagccaacauu

SEQ ID NO: 17184 - RNA, 21 nt, Artificial Sequence
  Ebola virus siRNA sense strand
cgaauacuuaagccaacauuc

SEQ ID NO: 17185 - RNA, 21 nt, Artificial Sequence
  Ebola virus siRNA sense strand
gaauacuuaagccaacauuca

SEQ ID NO: 17186 - RNA, 21 nt, Artificial Sequence
  Ebola virus siRNA sense strand
aauacuuaagccaacauucaa

SEQ ID NO: 17187 - RNA, 21 nt, Artificial Sequence
  Ebola virus siRNA sense strand
auacuuaagccaacauucaaa

SEQ ID NO: 17188 - RNA, 21 nt, Artificial Sequence
  Ebola virus siRNA sense strand
uacuuaagccaacauucaaac

SEQ ID NO: 17189 - RNA, 21 nt, Artificial Sequence
  Ebola virus siRNA sense strand
acuuaagccaacauucaaaca

SEQ ID NO: 17190 - RNA, 21 nt, Artificial Sequence
  Ebola virus siRNA sense strand
cuuaagccaacauucaaacau

SEQ ID NO: 17191 - RNA, 21 nt, Artificial Sequence
  Ebola virus siRNA sense strand
uuaagccaacauucaaacaug

SEQ ID NO: 17192 - RNA, 21 nt, Artificial Sequence
  Ebola virus siRNA sense strand
uaagccaacauucaaacaugc

SEQ ID NO: 17193 - RNA, 21 nt, Artificial Sequence
  Ebola virus siRNA sense strand
aagccaacauucaaacaugca

SEQ ID NO: 17194 - RNA, 21 nt, Artificial Sequence
  Ebola virus siRNA sense strand
agccaacauucaaacaugcaa

SEQ ID NO: 17195 - RNA, 21 nt, Artificial Sequence
  Ebola virus siRNA sense strand
gccaacauucaaacaugcaag

SEQ ID NO: 17196 - RNA, 21 nt, Artificial Sequence
  Ebola virus siRNA sense strand
ccaacauucaaacaugcaagc

SEQ ID NO: 17197 - RNA, 21 nt, Artificial Sequence
  Ebola virus siRNA sense strand
caacauucaaacaugcaagcg

SEQ ID NO: 17198 - RNA, 21 nt, Artificial Sequence
  Ebola virus siRNA sense strand
aacauucaaacaugcaagcgu

SEQ ID NO: 17199 - RNA, 21 nt, Artificial Sequence
  Ebola virus siRNA sense strand
acauucaaacaugcaagcguu

SEQ ID NO: 17200 - RNA, 21 nt, Artificial Sequence
  Ebola virus siRNA sense strand
cauucaaacaugcaagcguua

SEQ ID NO: 17201 - RNA, 21 nt, Artificial Sequence
  Ebola virus siRNA sense strand
auucaaacaugcaagcguuau

SEQ ID NO: 17202 - RNA, 21 nt, Artificial Sequence
  Ebola virus siRNA sense strand
uucaaacaugcaagcguuaug

SEQ ID NO: 17203 - RNA, 21 nt, Artificial Sequence
  Ebola virus siRNA sense strand
ucaaacaugcaagcguuaugu

SEQ ID NO: 17204 - RNA, 21 nt, Artificial Sequence
  Ebola virus siRNA sense strand
caaacaugcaagcguuauguc

SEQ ID NO: 17205 - RNA, 21 nt, Artificial Sequence
  Ebola virus siRNA sense strand
aaacaugcaagcguuauguca

SEQ ID NO: 17206 - RNA, 21 nt, Artificial Sequence
  Ebola virus siRNA sense strand
aacaugcaagcguuaugucac

SEQ ID NO: 17207 - RNA, 21 nt, Artificial Sequence
  Ebola virus siRNA sense strand
acaugcaagcguuaugucacg

SEQ ID NO: 17208 - RNA, 21 nt, Artificial Sequence
  Ebola virus siRNA sense strand
caugcaagcguuaugucacgg

SEQ ID NO: 17209 - RNA, 21 nt, Artificial Sequence
  Ebola virus siRNA sense strand
augcaagcguuaugucacggu

SEQ ID NO: 17210 - RNA, 21 nt, Artificial Sequence
  Ebola virus siRNA sense strand
ugcaagcguuaugucacgguu

SEQ ID NO: 17211 - RNA, 21 nt, Artificial Sequence
  Ebola virus siRNA sense strand
gcaagcguuaugucacgguua

SEQ ID NO: 17212 - RNA, 21 nt, Artificial Sequence
  Ebola virus siRNA sense strand
caagcguuaugucacgguuaa

SEQ ID NO: 17213 - RNA, 21 nt, Artificial Sequence
  Ebola virus siRNA sense strand
aagcguuaugucacgguuaau

SEQ ID NO: 17214 - RNA, 21 nt, Artificial Sequence
  Ebola virus siRNA sense strand
agcguuaugucacgguuaaug

SEQ ID NO: 17215 - RNA, 21 nt, Artificial Sequence
  Ebola virus siRNA sense strand
gcguuaugucacgguuaauga

SEQ ID NO: 17216 - RNA, 21 nt, Artificial Sequence
  Ebola virus siRNA sense strand
cguuaugucacgguuaaugag

SEQ ID NO: 17217 - RNA, 21 nt, Artificial Sequence
  Ebola virus siRNA sense strand
guuaugucacgguuaaugagu

SEQ ID NO: 17218 - RNA, 21 nt, Artificial Sequence
  Ebola virus siRNA sense strand
uuaugucacgguuaaugagua

SEQ ID NO: 17219 - RNA, 21 nt, Artificial Sequence
  Ebola virus siRNA sense strand
uaugucacgguuaaugaguau

SEQ ID NO: 17220 - RNA, 21 nt, Artificial Sequence
  Ebola virus siRNA sense strand
augucacgguuaaugaguauu

SEQ ID NO: 17221 - RNA, 21 nt, Artificial Sequence
  Ebola virus siRNA sense strand
ugucacgguuaaugaguauug

SEQ ID NO: 17222 - RNA, 21 nt, Artificial Sequence
  Ebola virus siRNA sense strand
gucacgguuaaugaguauuga

SEQ ID NO: 17223 - RNA, 21 nt, Artificial Sequence
  Ebola virus siRNA sense strand
ucacgguuaaugaguauugau

SEQ ID NO: 17224 - RNA, 21 nt, Artificial Sequence
  Ebola virus siRNA sense strand
cacgguuaaugaguauugauc

SEQ ID NO: 17225 - RNA, 21 nt, Artificial Sequence
  Ebola virus siRNA sense strand
acgguuaaugaguauugaucc

SEQ ID NO: 17226 - RNA, 21 nt, Artificial Sequence
  Ebola virus siRNA sense strand
cgguuaaugaguauugauccu

SEQ ID NO: 17227 - RNA, 21 nt, Artificial Sequence
  Ebola virus siRNA sense strand
gguuaaugaguauugauccuc

SEQ ID NO: 17228 - RNA, 21 nt, Artificial Sequence
  Ebola virus siRNA sense strand
guuaaugaguauugauccuca

SEQ ID NO: 17229 - RNA, 21 nt, Artificial Sequence
  Ebola virus siRNA sense strand
uuaaugaguauugauccucau

SEQ ID NO: 17230 - RNA, 21 nt, Artificial Sequence
  Ebola virus siRNA sense strand
uaaugaguauugauccucauu

SEQ ID NO: 17231 - RNA, 21 nt, Artificial Sequence
  Ebola virus siRNA sense strand
aaugaguauugauccucauuu

SEQ ID NO: 17232 - RNA, 21 nt, Artificial Sequence
  Ebola virus siRNA sense strand
augaguauugauccucauuuu

SEQ ID NO: 17233 - RNA, 21 nt, Artificial Sequence
  Ebola virus siRNA sense strand
ugaguauugauccucauuuuu

SEQ ID NO: 17234 - RNA, 21 nt, Artificial Sequence
  Ebola virus siRNA sense strand
gaguauugauccucauuuuuc

SEQ ID NO: 17235 - RNA, 21 nt, Artificial Sequence
  Ebola virus siRNA sense strand
aguauugauccucauuuuucu

SEQ ID NO: 17236 - RNA, 21 nt, Artificial Sequence
  Ebola virus siRNA sense strand
guauugauccucauuuuucua

SEQ ID NO: 17237 - RNA, 21 nt, Artificial Sequence
  Ebola virus siRNA sense strand
uauugauccucauuuuucuau

SEQ ID NO: 17238 - RNA, 21 nt, Artificial Sequence
  Ebola virus siRNA sense strand
auugauccucauuuuucuauu

SEQ ID NO: 17239 - RNA, 21 nt, Artificial Sequence
  Ebola virus siRNA sense strand
uugauccucauuuuucuauuu

SEQ ID NO: 17240 - RNA, 21 nt, Artificial Sequence
  Ebola virus siRNA sense strand
ugauccucauuuuucuauuua

SEQ ID NO: 17241 - RNA, 21 nt, Artificial Sequence
  Ebola virus siRNA sense strand
gauccucauuuuucuauuuac

SEQ ID NO: 17242 - RNA, 21 nt, Artificial Sequence
  Ebola virus siRNA sense strand
auccucauuuuucuauuuaca

SEQ ID NO: 17243 - RNA, 21 nt, Artificial Sequence
  Ebola virus siRNA sense strand
uccucauuuuucuauuuacau

SEQ ID NO: 17244 - RNA, 21 nt, Artificial Sequence
  Ebola virus siRNA sense strand
ccucauuuuucuauuuacaua

SEQ ID NO: 17245 - RNA, 21 nt, Artificial Sequence
  Ebola virus siRNA sense strand
cucauuuuucuauuuacauag

SEQ ID NO: 17246 - RNA, 21 nt, Artificial Sequence
  Ebola virus siRNA sense strand
ucauuuuucuauuuacauagg

SEQ ID NO: 17247 - RNA, 21 nt, Artificial Sequence
  Ebola virus siRNA sense strand
cauuuuucuauuuacauaggc

SEQ ID NO: 17248 - RNA, 21 nt, Artificial Sequence
  Ebola virus siRNA sense strand
auuuuucuauuuacauaggcg

SEQ ID NO: 17249 - RNA, 21 nt, Artificial Sequence
  Ebola virus siRNA sense strand
uuuuucuauuuacauaggcgg

SEQ ID NO: 17250 - RNA, 21 nt, Artificial Sequence
  Ebola virus siRNA sense strand
uuuucuauuuacauaggcggu

SEQ ID NO: 17251 - RNA, 21 nt, Artificial Sequence
  Ebola virus siRNA sense strand
uuucuauuuacauaggcggug

SEQ ID NO: 17252 - RNA, 21 nt, Artificial Sequence
  Ebola virus siRNA sense strand
uucuauuuacauaggcggugc

SEQ ID NO: 17253 - RNA, 21 nt, Artificial Sequence
  Ebola virus siRNA sense strand
ucuauuuacauaggcggugcu

SEQ ID NO: 17254 - RNA, 21 nt, Artificial Sequence
  Ebola virus siRNA sense strand
cuauuuacauaggcggugcug

SEQ ID NO: 17255 - RNA, 21 nt, Artificial Sequence
  Ebola virus siRNA sense strand
uauuuacauaggcggugcugc

SEQ ID NO: 17256 - RNA, 21 nt, Artificial Sequence
  Ebola virus siRNA sense strand
auuuacauaggcggugcugca

SEQ ID NO: 17257 - RNA, 21 nt, Artificial Sequence
  Ebola virus siRNA sense strand
uuuacauaggcggugcugcag

SEQ ID NO: 17258 - RNA, 21 nt, Artificial Sequence
  Ebola virus siRNA sense strand
uuacauaggcggugcugcagg

SEQ ID NO: 17259 - RNA, 21 nt, Artificial Sequence
  Ebola virus siRNA sense strand
uacauaggcggugcugcaggu

SEQ ID NO: 17260 - RNA, 21 nt, Artificial Sequence
  Ebola virus siRNA sense strand
acauaggcggugcugcaggug

SEQ ID NO: 17261 - RNA, 21 nt, Artificial Sequence
  Ebola virus siRNA sense strand
cauaggcggugcugcagguga

SEQ ID NO: 17262 - RNA, 21 nt, Artificial Sequence
  Ebola virus siRNA sense strand
auaggcggugcugcaggugac

SEQ ID NO: 17263 - RNA, 21 nt, Artificial Sequence
  Ebola virus siRNA sense strand
uaggcggugcugcaggugaca

SEQ ID NO: 17264 - RNA, 21 nt, Artificial Sequence
  Ebola virus siRNA sense strand
aggcggugcugcaggugacag

SEQ ID NO: 17265 - RNA, 21 nt, Artificial Sequence
  Ebola virus siRNA sense strand
ggcggugcugcaggugacaga

SEQ ID NO: 17266 - RNA, 21 nt, Artificial Sequence
  Ebola virus siRNA sense strand
gcggugcugcaggugacagag

SEQ ID NO: 17267 - RNA, 21 nt, Artificial Sequence
  Ebola virus siRNA sense strand
cggugcugcaggugacagagg

SEQ ID NO: 17268 - RNA, 21 nt, Artificial Sequence
  Ebola virus siRNA sense strand
ggugcugcaggugacagagga

SEQ ID NO: 17269 - RNA, 21 nt, Artificial Sequence
  Ebola virus siRNA sense strand
gugcugcaggugacagaggac

SEQ ID NO: 17270 - RNA, 21 nt, Artificial Sequence
  Ebola virus siRNA sense strand
ugcugcaggugacagaggacu

SEQ ID NO: 17271 - RNA, 21 nt, Artificial Sequence
  Ebola virus siRNA sense strand
gcugcaggugacagaggacuc

SEQ ID NO: 17272 - RNA, 21 nt, Artificial Sequence
  Ebola virus siRNA sense strand
cugcaggugacagaggacucu

SEQ ID NO: 17273 - RNA, 21 nt, Artificial Sequence
  Ebola virus siRNA sense strand
ugcaggugacagaggacucuc

SEQ ID NO: 17274 - RNA, 21 nt, Artificial Sequence
  Ebola virus siRNA sense strand
gcaggugacagaggacucuca

SEQ ID NO: 17275 - RNA, 21 nt, Artificial Sequence
  Ebola virus siRNA sense strand
caggugacagaggacucucag

SEQ ID NO: 17276 - RNA, 21 nt, Artificial Sequence
  Ebola virus siRNA sense strand
aggugacagaggacucucaga

SEQ ID NO: 17277 - RNA, 21 nt, Artificial Sequence
  Ebola virus siRNA sense strand
ggugacagaggacucucagau

SEQ ID NO: 17278 - RNA, 21 nt, Artificial Sequence
  Ebola virus siRNA sense strand
gugacagaggacucucagaug

SEQ ID NO: 17279 - RNA, 21 nt, Artificial Sequence
  Ebola virus siRNA sense strand
ugacagaggacucucagaugc

SEQ ID NO: 17280 - RNA, 21 nt, Artificial Sequence
  Ebola virus siRNA sense strand
gacagaggacucucagaugcg

SEQ ID NO: 17281 - RNA, 21 nt, Artificial Sequence
  Ebola virus siRNA sense strand
acagaggacucucagaugcgg

SEQ ID NO: 17282 - RNA, 21 nt, Artificial Sequence
  Ebola virus siRNA sense strand
cagaggacucucagaugcggc

SEQ ID NO: 17283 - RNA, 21 nt, Artificial Sequence
  Ebola virus siRNA sense strand
agaggacucucagaugcggcc

SEQ ID NO: 17284 - RNA, 21 nt, Artificial Sequence
  Ebola virus siRNA sense strand
gaggacucucagaugcggcca

SEQ ID NO: 17285 - RNA, 21 nt, Artificial Sequence
  Ebola virus siRNA sense strand
aggacucucagaugcggccag

SEQ ID NO: 17286 - RNA, 21 nt, Artificial Sequence
  Ebola virus siRNA sense strand
ggacucucagaugcggccagg

SEQ ID NO: 17287 - RNA, 21 nt, Artificial Sequence
  Ebola virus siRNA sense strand
gacucucagaugcggccaggu

SEQ ID NO: 17288 - RNA, 21 nt, Artificial Sequence
  Ebola virus siRNA sense strand
acucucagaugcggccagguu

SEQ ID NO: 17289 - RNA, 21 nt, Artificial Sequence
  Ebola virus siRNA sense strand
cucucagaugcggccagguua

SEQ ID NO: 17290 - RNA, 21 nt, Artificial Sequence
  Ebola virus siRNA sense strand
ucucagaugcggccagguuau

SEQ ID NO: 17291 - RNA, 21 nt, Artificial Sequence
  Ebola virus siRNA sense strand
cucagaugcggccagguuauu

SEQ ID NO: 17292 - RNA, 21 nt, Artificial Sequence
  Ebola virus siRNA sense strand
ucagaugcggccagguuauuu

SEQ ID NO: 17293 - RNA, 21 nt, Artificial Sequence
  Ebola virus siRNA sense strand
cagaugcggccagguuauuuu

SEQ ID NO: 17294 - RNA, 21 nt, Artificial Sequence
  Ebola virus siRNA sense strand
agaugcggccagguuauuuuu

SEQ ID NO: 17295 - RNA, 21 nt, Artificial Sequence
  Ebola virus siRNA sense strand
gaugcggccagguuauuuuug

SEQ ID NO: 17296 - RNA, 21 nt, Artificial Sequence
  Ebola virus siRNA sense strand
augcggccagguuauuuuuga

SEQ ID NO: 17297 - RNA, 21 nt, Artificial Sequence
  Ebola virus siRNA sense strand
ugcggccagguuauuuuugag

SEQ ID NO: 17298 - RNA, 21 nt, Artificial Sequence
  Ebola virus siRNA sense strand
gcggccagguuauuuuugaga

SEQ ID NO: 17299 - RNA, 21 nt, Artificial Sequence
  Ebola virus siRNA sense strand
cggccagguuauuuuugagaa

SEQ ID NO: 17300 - RNA, 21 nt, Artificial Sequence
  Ebola virus siRNA sense strand
ggccagguuauuuuugagaac

SEQ ID NO: 17301 - RNA, 21 nt, Artificial Sequence
  Ebola virus siRNA sense strand
gccagguuauuuuugagaacg

SEQ ID NO: 17302 - RNA, 21 nt, Artificial Sequence
  Ebola virus siRNA sense strand
ccagguuauuuuugagaacgu

SEQ ID NO: 17303 - RNA, 21 nt, Artificial Sequence
  Ebola virus siRNA sense strand
cagguuauuuuugagaacguc

SEQ ID NO: 17304 - RNA, 21 nt, Artificial Sequence
  Ebola virus siRNA sense strand
agguuauuuuugagaacgucc

SEQ ID NO: 17305 - RNA, 21 nt, Artificial Sequence
  Ebola virus siRNA sense strand
gguuauuuuugagaacgucca

SEQ ID NO: 17306 - RNA, 21 nt, Artificial Sequence
  Ebola virus siRNA sense strand
guuauuuuugagaacguccau

SEQ ID NO: 17307 - RNA, 21 nt, Artificial Sequence
  Ebola virus siRNA sense strand
uuauuuuugagaacguccauu

SEQ ID NO: 17308 - RNA, 21 nt, Artificial Sequence
  Ebola virus siRNA sense strand
uauuuuugagaacguccauuu

SEQ ID NO: 17309 - RNA, 21 nt, Artificial Sequence
  Ebola virus siRNA sense strand
auuuuugagaacguccauuuc

SEQ ID NO: 17310 - RNA, 21 nt, Artificial Sequence
  Ebola virus siRNA sense strand
uuuuugagaacguccauuuca

SEQ ID NO: 17311 - RNA, 21 nt, Artificial Sequence
  Ebola virus siRNA sense strand
uuuugagaacguccauuucau

SEQ ID NO: 17312 - RNA, 21 nt, Artificial Sequence
  Ebola virus siRNA sense strand
uuugagaacguccauuucauc

SEQ ID NO: 17313 - RNA, 21 nt, Artificial Sequence
  Ebola virus siRNA sense strand
uugagaacguccauuucaucu

SEQ ID NO: 17314 - RNA, 21 nt, Artificial Sequence
  Ebola virus siRNA sense strand
ugagaacguccauuucaucuu

SEQ ID NO: 17315 - RNA, 21 nt, Artificial Sequence
  Ebola virus siRNA sense strand
gagaacguccauuucaucuuu

SEQ ID NO: 17316 - RNA, 21 nt, Artificial Sequence
  Ebola virus siRNA sense strand
agaacguccauuucaucuuuu

SEQ ID NO: 17317 - RNA, 21 nt, Artificial Sequence
  Ebola virus siRNA sense strand
gaacguccauuucaucuuuuc

SEQ ID NO: 17318 - RNA, 21 nt, Artificial Sequence
  Ebola virus siRNA sense strand
aacguccauuucaucuuuucu

SEQ ID NO: 17319 - RNA, 21 nt, Artificial Sequence
  Ebola virus siRNA sense strand
acguccauuucaucuuuucuu

SEQ ID NO: 17320 - RNA, 21 nt, Artificial Sequence
  Ebola virus siRNA sense strand
cguccauuucaucuuuucuua

SEQ ID NO: 17321 - RNA, 21 nt, Artificial Sequence
  Ebola virus siRNA sense strand
guccauuucaucuuuucuuac

SEQ ID NO: 17322 - RNA, 21 nt, Artificial Sequence
  Ebola virus siRNA sense strand
uccauuucaucuuuucuuaca

SEQ ID NO: 17323 - RNA, 21 nt, Artificial Sequence
  Ebola virus siRNA sense strand
ccauuucaucuuuucuuacau

SEQ ID NO: 17324 - RNA, 21 nt, Artificial Sequence
  Ebola virus siRNA sense strand
cauuucaucuuuucuuacauu

SEQ ID NO: 17325 - RNA, 21 nt, Artificial Sequence
  Ebola virus siRNA sense strand
auuucaucuuuucuuacauuu

SEQ ID NO: 17326 - RNA, 21 nt, Artificial Sequence
  Ebola virus siRNA sense strand
uuucaucuuuucuuacauuug

SEQ ID NO: 17327 - RNA, 21 nt, Artificial Sequence
  Ebola virus siRNA sense strand
uucaucuuuucuuacauuugu

SEQ ID NO: 17328 - RNA, 21 nt, Artificial Sequence
  Ebola virus siRNA sense strand
ucaucuuuucuuacauuugua

SEQ ID NO: 17329 - RNA, 21 nt, Artificial Sequence
  Ebola virus siRNA sense strand
caucuuuucuuacauuuguaa

SEQ ID NO: 17330 - RNA, 21 nt, Artificial Sequence
  Ebola virus siRNA sense strand
aucuuuucuuacauuuguaaa

SEQ ID NO: 17331 - RNA, 21 nt, Artificial Sequence
  Ebola virus siRNA sense strand
ucuuuucuuacauuuguaaaa

SEQ ID NO: 17332 - RNA, 21 nt, Artificial Sequence
  Ebola virus siRNA sense strand
cuuuucuuacauuuguaaaag

SEQ ID NO: 17333 - RNA, 21 nt, Artificial Sequence
  Ebola virus siRNA sense strand
uuuucuuacauuuguaaaaga

SEQ ID NO: 17334 - RNA, 21 nt, Artificial Sequence
  Ebola virus siRNA sense strand
uuucuuacauuuguaaaagaa

SEQ ID NO: 17335 - RNA, 21 nt, Artificial Sequence
  Ebola virus siRNA sense strand
uucuuacauuuguaaaagaau

SEQ ID NO: 17336 - RNA, 21 nt, Artificial Sequence
  Ebola virus siRNA sense strand
ucuuacauuuguaaaagaaug

SEQ ID NO: 17337 - RNA, 21 nt, Artificial Sequence
  Ebola virus siRNA sense strand
cuuacauuuguaaaagaaugg

SEQ ID NO: 17338 - RNA, 21 nt, Artificial Sequence
  Ebola virus siRNA sense strand
uuacauuuguaaaagaaugga

SEQ ID NO: 17339 - RNA, 21 nt, Artificial Sequence
  Ebola virus siRNA sense strand
uacauuuguaaaagaauggau

SEQ ID NO: 17340 - RNA, 21 nt, Artificial Sequence
  Ebola virus siRNA sense strand
acauuuguaaaagaauggaua

SEQ ID NO: 17341 - RNA, 21 nt, Artificial Sequence
  Ebola virus siRNA sense strand
cauuuguaaaagaauggauaa

SEQ ID NO: 17342 - RNA, 21 nt, Artificial Sequence
  Ebola virus siRNA sense strand
auuuguaaaagaauggauaau

SEQ ID NO: 17343 - RNA, 21 nt, Artificial Sequence
  Ebola virus siRNA sense strand
uuuguaaaagaauggauaauu

SEQ ID NO: 17344 - RNA, 21 nt, Artificial Sequence
  Ebola virus siRNA sense strand
uuguaaaagaauggauaauua

SEQ ID NO: 17345 - RNA, 21 nt, Artificial Sequence
  Ebola virus siRNA sense strand
uguaaaagaauggauaauuaa

SEQ ID NO: 17346 - RNA, 21 nt, Artificial Sequence
  Ebola virus siRNA sense strand
guaaaagaauggauaauuaau

SEQ ID NO: 17347 - RNA, 21 nt, Artificial Sequence
  Ebola virus siRNA sense strand
uaaaagaauggauaauuaauc

SEQ ID NO: 17348 - RNA, 21 nt, Artificial Sequence
  Ebola virus siRNA sense strand
aaaagaauggauaauuaaucg

SEQ ID NO: 17349 - RNA, 21 nt, Artificial Sequence
  Ebola virus siRNA sense strand
aaagaauggauaauuaaucgc

SEQ ID NO: 17350 - RNA, 21 nt, Artificial Sequence
  Ebola virus siRNA sense strand
aagaauggauaauuaaucgcg

SEQ ID NO: 17351 - RNA, 21 nt, Artificial Sequence
  Ebola virus siRNA sense strand
agaauggauaauuaaucgcgg

SEQ ID NO: 17352 - RNA, 21 nt, Artificial Sequence
  Ebola virus siRNA sense strand
gaauggauaauuaaucgcgga

SEQ ID NO: 17353 - RNA, 21 nt, Artificial Sequence
  Ebola virus siRNA sense strand
aauggauaauuaaucgcggaa

SEQ ID NO: 17354 - RNA, 21 nt, Artificial Sequence
  Ebola virus siRNA sense strand
auggauaauuaaucgcggaac

SEQ ID NO: 17355 - RNA, 21 nt, Artificial Sequence
  Ebola virus siRNA sense strand
uggauaauuaaucgcggaaca

SEQ ID NO: 17356 - RNA, 21 nt, Artificial Sequence
  Ebola virus siRNA sense strand
ggauaauuaaucgcggaacaa

SEQ ID NO: 17357 - RNA, 21 nt, Artificial Sequence
  Ebola virus siRNA sense strand
gauaauuaaucgcggaacaau

SEQ ID NO: 17358 - RNA, 21 nt, Artificial Sequence
  Ebola virus siRNA sense strand
auaauuaaucgcggaacaauu

SEQ ID NO: 17359 - RNA, 21 nt, Artificial Sequence
  Ebola virus siRNA sense strand
uaauuaaucgcggaacaauug

SEQ ID NO: 17360 - RNA, 21 nt, Artificial Sequence
  Ebola virus siRNA sense strand
aauuaaucgcggaacaauugu

SEQ ID NO: 17361 - RNA, 21 nt, Artificial Sequence
  Ebola virus siRNA sense strand
auuaaucgcggaacaauuguc

SEQ ID NO: 17362 - RNA, 21 nt, Artificial Sequence
  Ebola virus siRNA sense strand
uuaaucgcggaacaauugucc

SEQ ID NO: 17363 - RNA, 21 nt, Artificial Sequence
  Ebola virus siRNA sense strand
uaaucgcggaacaauuguccc

SEQ ID NO: 17364 - RNA, 21 nt, Artificial Sequence
  Ebola virus siRNA sense strand
aaucgcggaacaauugucccu

SEQ ID NO: 17365 - RNA, 21 nt, Artificial Sequence
  Ebola virus siRNA sense strand
aucgcggaacaauugucccuu

SEQ ID NO: 17366 - RNA, 21 nt, Artificial Sequence
  Ebola virus siRNA sense strand
ucgcggaacaauugucccuuu

SEQ ID NO: 17367 - RNA, 21 nt, Artificial Sequence
  Ebola virus siRNA sense strand
cgcggaacaauugucccuuua

SEQ ID NO: 17368 - RNA, 21 nt, Artificial Sequence
  Ebola virus siRNA sense strand
gcggaacaauugucccuuuau

SEQ ID NO: 17369 - RNA, 21 nt, Artificial Sequence
  Ebola virus siRNA sense strand
cggaacaauugucccuuuaug

SEQ ID NO: 17370 - RNA, 21 nt, Artificial Sequence
  Ebola virus siRNA sense strand
ggaacaauugucccuuuaugg

SEQ ID NO: 17371 - RNA, 21 nt, Artificial Sequence
  Ebola virus siRNA sense strand
gaacaauugucccuuuaugga

SEQ ID NO: 17372 - RNA, 21 nt, Artificial Sequence
  Ebola virus siRNA sense strand
aacaauugucccuuuauggau

SEQ ID NO: 17373 - RNA, 21 nt, Artificial Sequence
  Ebola virus siRNA sense strand
acaauugucccuuuauggaua

SEQ ID NO: 17374 - RNA, 21 nt, Artificial Sequence
  Ebola virus siRNA sense strand
caauugucccuuuauggauag

SEQ ID NO: 17375 - RNA, 21 nt, Artificial Sequence
  Ebola virus siRNA sense strand
aauugucccuuuauggauagu

SEQ ID NO: 17376 - RNA, 21 nt, Artificial Sequence
  Ebola virus siRNA sense strand
auugucccuuuauggauagua

SEQ ID NO: 17377 - RNA, 21 nt, Artificial Sequence
  Ebola virus siRNA sense strand
uugucccuuuauggauaguau

SEQ ID NO: 17378 - RNA, 21 nt, Artificial Sequence
  Ebola virus siRNA sense strand
ugucccuuuauggauaguaua

SEQ ID NO: 17379 - RNA, 21 nt, Artificial Sequence
  Ebola virus siRNA sense strand
gucccuuuauggauaguauau

SEQ ID NO: 17380 - RNA, 21 nt, Artificial Sequence
  Ebola virus siRNA sense strand
ucccuuuauggauaguauauc

SEQ ID NO: 17381 - RNA, 21 nt, Artificial Sequence
  Ebola virus siRNA sense strand
cccuuuauggauaguauaucc

SEQ ID NO: 17382 - RNA, 21 nt, Artificial Sequence
  Ebola virus siRNA sense strand
ccuuuauggauaguauauccg

SEQ ID NO: 17383 - RNA, 21 nt, Artificial Sequence
  Ebola virus siRNA sense strand
cuuuauggauaguauauccgc

SEQ ID NO: 17384 - RNA, 21 nt, Artificial Sequence
  Ebola virus siRNA sense strand
uuuauggauaguauauccgcu

SEQ ID NO: 17385 - RNA, 21 nt, Artificial Sequence
  Ebola virus siRNA sense strand
uuauggauaguauauccgcua

SEQ ID NO: 17386 - RNA, 21 nt, Artificial Sequence
  Ebola virus siRNA sense strand
uauggauaguauauccgcuag

SEQ ID NO: 17387 - RNA, 21 nt, Artificial Sequence
  Ebola virus siRNA sense strand
auggauaguauauccgcuaga

SEQ ID NO: 17388 - RNA, 21 nt, Artificial Sequence
  Ebola virus siRNA sense strand
uggauaguauauccgcuagag

SEQ ID NO: 17389 - RNA, 21 nt, Artificial Sequence
  Ebola virus siRNA sense strand
ggauaguauauccgcuagagg

SEQ ID NO: 17390 - RNA, 21 nt, Artificial Sequence
  Ebola virus siRNA sense strand
gauaguauauccgcuagaggg

SEQ ID NO: 17391 - RNA, 21 nt, Artificial Sequence
  Ebola virus siRNA sense strand
auaguauauccgcuagagggu

SEQ ID NO: 17392 - RNA, 21 nt, Artificial Sequence
  Ebola virus siRNA sense strand
uaguauauccgcuagaggguc

SEQ ID NO: 17393 - RNA, 21 nt, Artificial Sequence
  Ebola virus siRNA sense strand
aguauauccgcuagaggguca

SEQ ID NO: 17394 - RNA, 21 nt, Artificial Sequence
  Ebola virus siRNA sense strand
guauauccgcuagagggucaa

SEQ ID NO: 17395 - RNA, 21 nt, Artificial Sequence
  Ebola virus siRNA sense strand
uauauccgcuagagggucaaa

SEQ ID NO: 17396 - RNA, 21 nt, Artificial Sequence
  Ebola virus siRNA sense strand
auauccgcuagagggucaaaa

SEQ ID NO: 17397 - RNA, 21 nt, Artificial Sequence
  Ebola virus siRNA sense strand
uauccgcuagagggucaaaac

SEQ ID NO: 17398 - RNA, 21 nt, Artificial Sequence
  Ebola virus siRNA sense strand
auccgcuagagggucaaaacc

SEQ ID NO: 17399 - RNA, 21 nt, Artificial Sequence
  Ebola virus siRNA sense strand
uccgcuagagggucaaaaccc

SEQ ID NO: 17400 - RNA, 21 nt, Artificial Sequence
  Ebola virus siRNA sense strand
ccgcuagagggucaaaaccca

SEQ ID NO: 17401 - RNA, 21 nt, Artificial Sequence
  Ebola virus siRNA sense strand
cgcuagagggucaaaacccaa

SEQ ID NO: 17402 - RNA, 21 nt, Artificial Sequence
  Ebola virus siRNA sense strand
gcuagagggucaaaacccaac

SEQ ID NO: 17403 - RNA, 21 nt, Artificial Sequence
  Ebola virus siRNA sense strand
cuagagggucaaaacccaaca

SEQ ID NO: 17404 - RNA, 21 nt, Artificial Sequence
  Ebola virus siRNA sense strand
uagagggucaaaacccaacac

SEQ ID NO: 17405 - RNA, 21 nt, Artificial Sequence
  Ebola virus siRNA sense strand
agagggucaaaacccaacacc

SEQ ID NO: 17406 - RNA, 21 nt, Artificial Sequence
  Ebola virus siRNA sense strand
gagggucaaaacccaacaccu

SEQ ID NO: 17407 - RNA, 21 nt, Artificial Sequence
  Ebola virus siRNA sense strand
agggucaaaacccaacaccug

SEQ ID NO: 17408 - RNA, 21 nt, Artificial Sequence
  Ebola virus siRNA sense strand
gggucaaaacccaacaccugu

SEQ ID NO: 17409 - RNA, 21 nt, Artificial Sequence
  Ebola virus siRNA sense strand
ggucaaaacccaacaccugug

SEQ ID NO: 17410 - RNA, 21 nt, Artificial Sequence
  Ebola virus siRNA sense strand
gucaaaacccaacaccuguga

SEQ ID NO: 17411 - RNA, 21 nt, Artificial Sequence
  Ebola virus siRNA sense strand
ucaaaacccaacaccugugaa

SEQ ID NO: 17412 - RNA, 21 nt, Artificial Sequence
  Ebola virus siRNA sense strand
caaaacccaacaccugugaau

SEQ ID NO: 17413 - RNA, 21 nt, Artificial Sequence
  Ebola virus siRNA sense strand
aaaacccaacaccugugaaua

SEQ ID NO: 17414 - RNA, 21 nt, Artificial Sequence
  Ebola virus siRNA sense strand
aaacccaacaccugugaauaa

SEQ ID NO: 17415 - RNA, 21 nt, Artificial Sequence
  Ebola virus siRNA sense strand
aacccaacaccugugaauaau

SEQ ID NO: 17416 - RNA, 21 nt, Artificial Sequence
  Ebola virus siRNA sense strand
acccaacaccugugaauaauu

SEQ ID NO: 17417 - RNA, 21 nt, Artificial Sequence
  Ebola virus siRNA sense strand
cccaacaccugugaauaauuu

SEQ ID NO: 17418 - RNA, 21 nt, Artificial Sequence
  Ebola virus siRNA sense strand
ccaacaccugugaauaauuuu

SEQ ID NO: 17419 - RNA, 21 nt, Artificial Sequence
  Ebola virus siRNA sense strand
caacaccugugaauaauuuuc

SEQ ID NO: 17420 - RNA, 21 nt, Artificial Sequence
  Ebola virus siRNA sense strand
aacaccugugaauaauuuucu

SEQ ID NO: 17421 - RNA, 21 nt, Artificial Sequence
  Ebola virus siRNA sense strand
acaccugugaauaauuuucuc

SEQ ID NO: 17422 - RNA, 21 nt, Artificial Sequence
  Ebola virus siRNA sense strand
caccugugaauaauuuucucu

SEQ ID NO: 17423 - RNA, 21 nt, Artificial Sequence
  Ebola virus siRNA sense strand
accugugaauaauuuucucua

SEQ ID NO: 17424 - RNA, 21 nt, Artificial Sequence
  Ebola virus siRNA sense strand
ccugugaauaauuuucucuau

SEQ ID NO: 17425 - RNA, 21 nt, Artificial Sequence
  Ebola virus siRNA sense strand
cugugaauaauuuucucuauc

SEQ ID NO: 17426 - RNA, 21 nt, Artificial Sequence
  Ebola virus siRNA sense strand
ugugaauaauuuucucuauca

SEQ ID NO: 17427 - RNA, 21 nt, Artificial Sequence
  Ebola virus siRNA sense strand
gugaauaauuuucucuaucag

SEQ ID NO: 17428 - RNA, 21 nt, Artificial Sequence
  Ebola virus siRNA sense strand
ugaauaauuuucucuaucaga

SEQ ID NO: 17429 - RNA, 21 nt, Artificial Sequence
  Ebola virus siRNA sense strand
gaauaauuuucucuaucagau

SEQ ID NO: 17430 - RNA, 21 nt, Artificial Sequence
  Ebola virus siRNA sense strand
aauaauuuucucuaucagauc

SEQ ID NO: 17431 - RNA, 21 nt, Artificial Sequence
  Ebola virus siRNA sense strand
auaauuuucucuaucagaucg

SEQ ID NO: 17432 - RNA, 21 nt, Artificial Sequence
  Ebola virus siRNA sense strand
uaauuuucucuaucagaucgu

SEQ ID NO: 17433 - RNA, 21 nt, Artificial Sequence
  Ebola virus siRNA sense strand
aauuuucucuaucagaucgua

SEQ ID NO: 17434 - RNA, 21 nt, Artificial Sequence
  Ebola virus siRNA sense strand
auuuucucuaucagaucguag

SEQ ID NO: 17435 - RNA, 21 nt, Artificial Sequence
  Ebola virus siRNA sense strand
uuuucucuaucagaucguaga

SEQ ID NO: 17436 - RNA, 21 nt, Artificial Sequence
  Ebola virus siRNA sense strand
uuucucuaucagaucguagaa

SEQ ID NO: 17437 - RNA, 21 nt, Artificial Sequence
  Ebola virus siRNA sense strand
uucucuaucagaucguagaac

SEQ ID NO: 17438 - RNA, 21 nt, Artificial Sequence
  Ebola virus siRNA sense strand
ucucuaucagaucguagaacu

SEQ ID NO: 17439 - RNA, 21 nt, Artificial Sequence
  Ebola virus siRNA sense strand
cucuaucagaucguagaacug

SEQ ID NO: 17440 - RNA, 21 nt, Artificial Sequence
  Ebola virus siRNA sense strand
ucuaucagaucguagaacugc

SEQ ID NO: 17441 - RNA, 21 nt, Artificial Sequence
  Ebola virus siRNA sense strand
cuaucagaucguagaacugcu

SEQ ID NO: 17442 - RNA, 21 nt, Artificial Sequence
  Ebola virus siRNA sense strand
uaucagaucguagaacugcug

SEQ ID NO: 17443 - RNA, 21 nt, Artificial Sequence
  Ebola virus siRNA sense strand
aucagaucguagaacugcugg

SEQ ID NO: 17444 - RNA, 21 nt, Artificial Sequence
  Ebola virus siRNA sense strand
ucagaucguagaacugcuggu

SEQ ID NO: 17445 - RNA, 21 nt, Artificial Sequence
  Ebola virus siRNA sense strand
cagaucguagaacugcuggug

SEQ ID NO: 17446 - RNA, 21 nt, Artificial Sequence
  Ebola virus siRNA sense strand
agaucguagaacugcuggugc

SEQ ID NO: 17447 - RNA, 21 nt, Artificial Sequence
  Ebola virus siRNA sense strand
gaucguagaacugcuggugca

SEQ ID NO: 17448 - RNA, 21 nt, Artificial Sequence
  Ebola virus siRNA sense strand
aucguagaacugcuggugcau

SEQ ID NO: 17449 - RNA, 21 nt, Artificial Sequence
  Ebola virus siRNA sense strand
ucguagaacugcuggugcaug

SEQ ID NO: 17450 - RNA, 21 nt, Artificial Sequence
  Ebola virus siRNA sense strand
cguagaacugcuggugcauga

SEQ ID NO: 17451 - RNA, 21 nt, Artificial Sequence
  Ebola virus siRNA sense strand
guagaacugcuggugcaugau

SEQ ID NO: 17452 - RNA, 21 nt, Artificial Sequence
  Ebola virus siRNA sense strand
uagaacugcuggugcaugauu

SEQ ID NO: 17453 - RNA, 21 nt, Artificial Sequence
  Ebola virus siRNA sense strand
agaacugcuggugcaugauuc

SEQ ID NO: 17454 - RNA, 21 nt, Artificial Sequence
  Ebola virus siRNA sense strand
gaacugcuggugcaugauuca

SEQ ID NO: 17455 - RNA, 21 nt, Artificial Sequence
  Ebola virus siRNA sense strand
aacugcuggugcaugauucau

SEQ ID NO: 17456 - RNA, 21 nt, Artificial Sequence
  Ebola virus siRNA sense strand
acugcuggugcaugauucauc

SEQ ID NO: 17457 - RNA, 21 nt, Artificial Sequence
  Ebola virus siRNA sense strand
cugcuggugcaugauucauca

SEQ ID NO: 17458 - RNA, 21 nt, Artificial Sequence
  Ebola virus siRNA sense strand
ugcuggugcaugauucaucaa

SEQ ID NO: 17459 - RNA, 21 nt, Artificial Sequence
  Ebola virus siRNA sense strand
gcuggugcaugauucaucaag

SEQ ID NO: 17460 - RNA, 21 nt, Artificial Sequence
  Ebola virus siRNA sense strand
cuggugcaugauucaucaaga

SEQ ID NO: 17461 - RNA, 21 nt, Artificial Sequence
  Ebola virus siRNA sense strand
uggugcaugauucaucaagac

SEQ ID NO: 17462 - RNA, 21 nt, Artificial Sequence
  Ebola virus siRNA sense strand
ggugcaugauucaucaagaca

SEQ ID NO: 17463 - RNA, 21 nt, Artificial Sequence
  Ebola virus siRNA sense strand
gugcaugauucaucaagacaa

SEQ ID NO: 17464 - RNA, 21 nt, Artificial Sequence
  Ebola virus siRNA sense strand
ugcaugauucaucaagacaac

SEQ ID NO: 17465 - RNA, 21 nt, Artificial Sequence
  Ebola virus siRNA sense strand
gcaugauucaucaagacaaca

SEQ ID NO: 17466 - RNA, 21 nt, Artificial Sequence
  Ebola virus siRNA sense strand
caugauucaucaagacaacag

SEQ ID NO: 17467 - RNA, 21 nt, Artificial Sequence
  Ebola virus siRNA sense strand
augauucaucaagacaacagg

SEQ ID NO: 17468 - RNA, 21 nt, Artificial Sequence
  Ebola virus siRNA sense strand
ugauucaucaagacaacaggc

SEQ ID NO: 17469 - RNA, 21 nt, Artificial Sequence
  Ebola virus siRNA sense strand
gauucaucaagacaacaggcu

SEQ ID NO: 17470 - RNA, 21 nt, Artificial Sequence
  Ebola virus siRNA sense strand
auucaucaagacaacaggcuu

SEQ ID NO: 17471 - RNA, 21 nt, Artificial Sequence
  Ebola virus siRNA sense strand
uucaucaagacaacaggcuuu

SEQ ID NO: 17472 - RNA, 21 nt, Artificial Sequence
  Ebola virus siRNA sense strand
ucaucaagacaacaggcuuuu

SEQ ID NO: 17473 - RNA, 21 nt, Artificial Sequence
  Ebola virus siRNA sense strand
caucaagacaacaggcuuuua

SEQ ID NO: 17474 - RNA, 21 nt, Artificial Sequence
  Ebola virus siRNA sense strand
aucaagacaacaggcuuuuaa

SEQ ID NO: 17475 - RNA, 21 nt, Artificial Sequence
  Ebola virus siRNA sense strand
ucaagacaacaggcuuuuaaa

SEQ ID NO: 17476 - RNA, 21 nt, Artificial Sequence
  Ebola virus siRNA sense strand
caagacaacaggcuuuuaaaa

SEQ ID NO: 17477 - RNA, 21 nt, Artificial Sequence
  Ebola virus siRNA sense strand
aagacaacaggcuuuuaaaac

SEQ ID NO: 17478 - RNA, 21 nt, Artificial Sequence
  Ebola virus siRNA sense strand
agacaacaggcuuuuaaaacu

SEQ ID NO: 17479 - RNA, 21 nt, Artificial Sequence
  Ebola virus siRNA sense strand
gacaacaggcuuuuaaaacua

SEQ ID NO: 17480 - RNA, 21 nt, Artificial Sequence
  Ebola virus siRNA sense strand
acaacaggcuuuuaaaacuac

SEQ ID NO: 17481 - RNA, 21 nt, Artificial Sequence
  Ebola virus siRNA sense strand
caacaggcuuuuaaaacuacc

SEQ ID NO: 17482 - RNA, 21 nt, Artificial Sequence
  Ebola virus siRNA sense strand
aacaggcuuuuaaaacuacca

SEQ ID NO: 17483 - RNA, 21 nt, Artificial Sequence
  Ebola virus siRNA sense strand
acaggcuuuuaaaacuaccau

SEQ ID NO: 17484 - RNA, 21 nt, Artificial Sequence
  Ebola virus siRNA sense strand
caggcuuuuaaaacuaccaua

SEQ ID NO: 17485 - RNA, 21 nt, Artificial Sequence
  Ebola virus siRNA sense strand
aggcuuuuaaaacuaccauaa

SEQ ID NO: 17486 - RNA, 21 nt, Artificial Sequence
  Ebola virus siRNA sense strand
ggcuuuuaaaacuaccauaag

SEQ ID NO: 17487 - RNA, 21 nt, Artificial Sequence
  Ebola virus siRNA sense strand
gcuuuuaaaacuaccauaagu

SEQ ID NO: 17488 - RNA, 21 nt, Artificial Sequence
  Ebola virus siRNA sense strand
cuuuuaaaacuaccauaagug

SEQ ID NO: 17489 - RNA, 21 nt, Artificial Sequence
  Ebola virus siRNA sense strand
uuuuaaaacuaccauaaguga

SEQ ID NO: 17490 - RNA, 21 nt, Artificial Sequence
  Ebola virus siRNA sense strand
uuuaaaacuaccauaagugau

SEQ ID NO: 17491 - RNA, 21 nt, Artificial Sequence
  Ebola virus siRNA sense strand
uuaaaacuaccauaagugauc

SEQ ID NO: 17492 - RNA, 21 nt, Artificial Sequence
  Ebola virus siRNA sense strand
uaaaacuaccauaagugauca

SEQ ID NO: 17493 - RNA, 21 nt, Artificial Sequence
  Ebola virus siRNA sense strand
aaaacuaccauaagugaucau

SEQ ID NO: 17494 - RNA, 21 nt, Artificial Sequence
  Ebola virus siRNA sense strand
aaacuaccauaagugaucaug

SEQ ID NO: 17495 - RNA, 21 nt, Artificial Sequence
  Ebola virus siRNA sense strand
aacuaccauaagugaucaugu

SEQ ID NO: 17496 - RNA, 21 nt, Artificial Sequence
  Ebola virus siRNA sense strand
acuaccauaagugaucaugua

SEQ ID NO: 17497 - RNA, 21 nt, Artificial Sequence
  Ebola virus siRNA sense strand
cuaccauaagugaucauguac

SEQ ID NO: 17498 - RNA, 21 nt, Artificial Sequence
  Ebola virus siRNA sense strand
uaccauaagugaucauguaca

SEQ ID NO: 17499 - RNA, 21 nt, Artificial Sequence
  Ebola virus siRNA sense strand
accauaagugaucauguacau

SEQ ID NO: 17500 - RNA, 21 nt, Artificial Sequence
  Ebola virus siRNA sense strand
ccauaagugaucauguacauc

SEQ ID NO: 17501 - RNA, 21 nt, Artificial Sequence
  Ebola virus siRNA sense strand
cauaagugaucauguacaucc

SEQ ID NO: 17502 - RNA, 21 nt, Artificial Sequence
  Ebola virus siRNA sense strand
auaagugaucauguacauccu

SEQ ID NO: 17503 - RNA, 21 nt, Artificial Sequence
  Ebola virus siRNA sense strand
uaagugaucauguacauccuc

SEQ ID NO: 17504 - RNA, 21 nt, Artificial Sequence
  Ebola virus siRNA sense strand
aagugaucauguacauccuca

SEQ ID NO: 17505 - RNA, 21 nt, Artificial Sequence
  Ebola virus siRNA sense strand
agugaucauguacauccucac

SEQ ID NO: 17506 - RNA, 21 nt, Artificial Sequence
  Ebola virus siRNA sense strand
gugaucauguacauccucacg

SEQ ID NO: 17507 - RNA, 21 nt, Artificial Sequence
  Ebola virus siRNA sense strand
ugaucauguacauccucacga

SEQ ID NO: 17508 - RNA, 21 nt, Artificial Sequence
  Ebola virus siRNA sense strand
gaucauguacauccucacgac

SEQ ID NO: 17509 - RNA, 21 nt, Artificial Sequence
  Ebola virus siRNA sense strand
aucauguacauccucacgaca

SEQ ID NO: 17510 - RNA, 21 nt, Artificial Sequence
  Ebola virus siRNA sense strand
ucauguacauccucacgacaa

SEQ ID NO: 17511 - RNA, 21 nt, Artificial Sequence
  Ebola virus siRNA sense strand
cauguacauccucacgacaau

SEQ ID NO: 17512 - RNA, 21 nt, Artificial Sequence
  Ebola virus siRNA sense strand
auguacauccucacgacaauc

SEQ ID NO: 17513 - RNA, 21 nt, Artificial Sequence
  Ebola virus siRNA sense strand
uguacauccucacgacaaucu

SEQ ID NO: 17514 - RNA, 21 nt, Artificial Sequence
  Ebola virus siRNA sense strand
guacauccucacgacaaucuu

SEQ ID NO: 17515 - RNA, 21 nt, Artificial Sequence
  Ebola virus siRNA sense strand
uacauccucacgacaaucuug

SEQ ID NO: 17516 - RNA, 21 nt, Artificial Sequence
  Ebola virus siRNA sense strand
acauccucacgacaaucuugu

SEQ ID NO: 17517 - RNA, 21 nt, Artificial Sequence
  Ebola virus siRNA sense strand
cauccucacgacaaucuuguu

SEQ ID NO: 17518 - RNA, 21 nt, Artificial Sequence
  Ebola virus siRNA sense strand
auccucacgacaaucuuguuu

SEQ ID NO: 17519 - RNA, 21 nt, Artificial Sequence
  Ebola virus siRNA sense strand
uccucacgacaaucuuguuua

SEQ ID NO: 17520 - RNA, 21 nt, Artificial Sequence
  Ebola virus siRNA sense strand
ccucacgacaaucuuguuuac

SEQ ID NO: 17521 - RNA, 21 nt, Artificial Sequence
  Ebola virus siRNA sense strand
cucacgacaaucuuguuuaca

SEQ ID NO: 17522 - RNA, 21 nt, Artificial Sequence
  Ebola virus siRNA sense strand
ucacgacaaucuuguuuacac

SEQ ID NO: 17523 - RNA, 21 nt, Artificial Sequence
  Ebola virus siRNA sense strand
cacgacaaucuuguuuacaca

SEQ ID NO: 17524 - RNA, 21 nt, Artificial Sequence
  Ebola virus siRNA sense strand
acgacaaucuuguuuacacau

SEQ ID NO: 17525 - RNA, 21 nt, Artificial Sequence
  Ebola virus siRNA sense strand
cgacaaucuuguuuacacaug

SEQ ID NO: 17526 - RNA, 21 nt, Artificial Sequence
  Ebola virus siRNA sense strand
gacaaucuuguuuacacaugu

SEQ ID NO: 17527 - RNA, 21 nt, Artificial Sequence
  Ebola virus siRNA sense strand
acaaucuuguuuacacaugua

SEQ ID NO: 17528 - RNA, 21 nt, Artificial Sequence
  Ebola virus siRNA sense strand
caaucuuguuuacacauguaa

SEQ ID NO: 17529 - RNA, 21 nt, Artificial Sequence
  Ebola virus siRNA sense strand
aaucuuguuuacacauguaag

SEQ ID NO: 17530 - RNA, 21 nt, Artificial Sequence
  Ebola virus siRNA sense strand
aucuuguuuacacauguaaga

SEQ ID NO: 17531 - RNA, 21 nt, Artificial Sequence
  Ebola virus siRNA sense strand
ucuuguuuacacauguaagag

SEQ ID NO: 17532 - RNA, 21 nt, Artificial Sequence
  Ebola virus siRNA sense strand
cuuguuuacacauguaagagu

SEQ ID NO: 17533 - RNA, 21 nt, Artificial Sequence
  Ebola virus siRNA sense strand
uuguuuacacauguaagagua

SEQ ID NO: 17534 - RNA, 21 nt, Artificial Sequence
  Ebola virus siRNA sense strand
uguuuacacauguaagaguac

SEQ ID NO: 17535 - RNA, 21 nt, Artificial Sequence
  Ebola virus siRNA sense strand
guuuacacauguaagaguaca

SEQ ID NO: 17536 - RNA, 21 nt, Artificial Sequence
  Ebola virus siRNA sense strand
uuuacacauguaagaguacag

SEQ ID NO: 17537 - RNA, 21 nt, Artificial Sequence
  Ebola virus siRNA sense strand
uuacacauguaagaguacagc

SEQ ID NO: 17538 - RNA, 21 nt, Artificial Sequence
  Ebola virus siRNA sense strand
uacacauguaagaguacagcc

SEQ ID NO: 17539 - RNA, 21 nt, Artificial Sequence
  Ebola virus siRNA sense strand
acacauguaagaguacagcca

SEQ ID NO: 17540 - RNA, 21 nt, Artificial Sequence
  Ebola virus siRNA sense strand
cacauguaagaguacagccag

SEQ ID NO: 17541 - RNA, 21 nt, Artificial Sequence
  Ebola virus siRNA sense strand
acauguaagaguacagccagc

SEQ ID NO: 17542 - RNA, 21 nt, Artificial Sequence
  Ebola virus siRNA sense strand
cauguaagaguacagccagca

SEQ ID NO: 17543 - RNA, 21 nt, Artificial Sequence
  Ebola virus siRNA sense strand
auguaagaguacagccagcaa

SEQ ID NO: 17544 - RNA, 21 nt, Artificial Sequence
  Ebola virus siRNA sense strand
uguaagaguacagccagcaau

SEQ ID NO: 17545 - RNA, 21 nt, Artificial Sequence
  Ebola virus siRNA sense strand
guaagaguacagccagcaauu

SEQ ID NO: 17546 - RNA, 21 nt, Artificial Sequence
  Ebola virus siRNA sense strand
uaagaguacagccagcaauuu

SEQ ID NO: 17547 - RNA, 21 nt, Artificial Sequence
  Ebola virus siRNA sense strand
aagaguacagccagcaauuuc

SEQ ID NO: 17548 - RNA, 21 nt, Artificial Sequence
  Ebola virus siRNA sense strand
agaguacagccagcaauuucu

SEQ ID NO: 17549 - RNA, 21 nt, Artificial Sequence
  Ebola virus siRNA sense strand
gaguacagccagcaauuucuu

SEQ ID NO: 17550 - RNA, 21 nt, Artificial Sequence
  Ebola virus siRNA sense strand
aguacagccagcaauuucuuc

SEQ ID NO: 17551 - RNA, 21 nt, Artificial Sequence
  Ebola virus siRNA sense strand
guacagccagcaauuucuucc

SEQ ID NO: 17552 - RNA, 21 nt, Artificial Sequence
  Ebola virus siRNA sense strand
uacagccagcaauuucuucca

SEQ ID NO: 17553 - RNA, 21 nt, Artificial Sequence
  Ebola virus siRNA sense strand
acagccagcaauuucuuccau

SEQ ID NO: 17554 - RNA, 21 nt, Artificial Sequence
  Ebola virus siRNA sense strand
cagccagcaauuucuuccaug

SEQ ID NO: 17555 - RNA, 21 nt, Artificial Sequence
  Ebola virus siRNA sense strand
agccagcaauuucuuccaugc

SEQ ID NO: 17556 - RNA, 21 nt, Artificial Sequence
  Ebola virus siRNA sense strand
gccagcaauuucuuccaugca

SEQ ID NO: 17557 - RNA, 21 nt, Artificial Sequence
  Ebola virus siRNA sense strand
ccagcaauuucuuccaugcau

SEQ ID NO: 17558 - RNA, 21 nt, Artificial Sequence
  Ebola virus siRNA sense strand
cagcaauuucuuccaugcauc

SEQ ID NO: 17559 - RNA, 21 nt, Artificial Sequence
  Ebola virus siRNA sense strand
agcaauuucuuccaugcauca

SEQ ID NO: 17560 - RNA, 21 nt, Artificial Sequence
  Ebola virus siRNA sense strand
gcaauuucuuccaugcaucau

SEQ ID NO: 17561 - RNA, 21 nt, Artificial Sequence
  Ebola virus siRNA sense strand
caauuucuuccaugcaucauu

SEQ ID NO: 17562 - RNA, 21 nt, Artificial Sequence
  Ebola virus siRNA sense strand
aauuucuuccaugcaucauug

SEQ ID NO: 17563 - RNA, 21 nt, Artificial Sequence
  Ebola virus siRNA sense strand
auuucuuccaugcaucauugg

SEQ ID NO: 17564 - RNA, 21 nt, Artificial Sequence
  Ebola virus siRNA sense strand
uuucuuccaugcaucauuggc

SEQ ID NO: 17565 - RNA, 21 nt, Artificial Sequence
  Ebola virus siRNA sense strand
uucuuccaugcaucauuggcg

SEQ ID NO: 17566 - RNA, 21 nt, Artificial Sequence
  Ebola virus siRNA sense strand
ucuuccaugcaucauuggcgu

SEQ ID NO: 17567 - RNA, 21 nt, Artificial Sequence
  Ebola virus siRNA sense strand
cuuccaugcaucauuggcgua

SEQ ID NO: 17568 - RNA, 21 nt, Artificial Sequence
  Ebola virus siRNA sense strand
uuccaugcaucauuggcguac

SEQ ID NO: 17569 - RNA, 21 nt, Artificial Sequence
  Ebola virus siRNA sense strand
uccaugcaucauuggcguacu

SEQ ID NO: 17570 - RNA, 21 nt, Artificial Sequence
  Ebola virus siRNA sense strand
ccaugcaucauuggcguacug

SEQ ID NO: 17571 - RNA, 21 nt, Artificial Sequence
  Ebola virus siRNA sense strand
caugcaucauuggcguacugg

SEQ ID NO: 17572 - RNA, 21 nt, Artificial Sequence
  Ebola virus siRNA sense strand
augcaucauuggcguacugga

SEQ ID NO: 17573 - RNA, 21 nt, Artificial Sequence
  Ebola virus siRNA sense strand
ugcaucauuggcguacuggag

SEQ ID NO: 17574 - RNA, 21 nt, Artificial Sequence
  Ebola virus siRNA sense strand
gcaucauuggcguacuggagg

SEQ ID NO: 17575 - RNA, 21 nt, Artificial Sequence
  Ebola virus siRNA sense strand
caucauuggcguacuggagga

SEQ ID NO: 17576 - RNA, 21 nt, Artificial Sequence
  Ebola virus siRNA sense strand
aucauuggcguacuggaggag

SEQ ID NO: 17577 - RNA, 21 nt, Artificial Sequence
  Ebola virus siRNA sense strand
ucauuggcguacuggaggagc

SEQ ID NO: 17578 - RNA, 21 nt, Artificial Sequence
  Ebola virus siRNA sense strand
cauuggcguacuggaggagca

SEQ ID NO: 17579 - RNA, 21 nt, Artificial Sequence
  Ebola virus siRNA sense strand
auuggcguacuggaggagcag

SEQ ID NO: 17580 - RNA, 21 nt, Artificial Sequence
  Ebola virus siRNA sense strand
uuggcguacuggaggagcaga

SEQ ID NO: 17581 - RNA, 21 nt, Artificial Sequence
  Ebola virus siRNA sense strand
uggcguacuggaggagcagac

SEQ ID NO: 17582 - RNA, 21 nt, Artificial Sequence
  Ebola virus siRNA sense strand
ggcguacuggaggagcagaca

SEQ ID NO: 17583 - RNA, 21 nt, Artificial Sequence
  Ebola virus siRNA sense strand
gcguacuggaggagcagacac

SEQ ID NO: 17584 - RNA, 21 nt, Artificial Sequence
  Ebola virus siRNA sense strand
cguacuggaggagcagacaca

SEQ ID NO: 17585 - RNA, 21 nt, Artificial Sequence
  Ebola virus siRNA sense strand
guacuggaggagcagacacag

SEQ ID NO: 17586 - RNA, 21 nt, Artificial Sequence
  Ebola virus siRNA sense strand
uacuggaggagcagacacaga

SEQ ID NO: 17587 - RNA, 21 nt, Artificial Sequence
  Ebola virus siRNA sense strand
acuggaggagcagacacagaa

SEQ ID NO: 17588 - RNA, 21 nt, Artificial Sequence
  Ebola virus siRNA sense strand
cuggaggagcagacacagaaa

SEQ ID NO: 17589 - RNA, 21 nt, Artificial Sequence
  Ebola virus siRNA sense strand
uggaggagcagacacagaaac

SEQ ID NO: 17590 - RNA, 21 nt, Artificial Sequence
  Ebola virus siRNA sense strand
ggaggagcagacacagaaaca

SEQ ID NO: 17591 - RNA, 21 nt, Artificial Sequence
  Ebola virus siRNA sense strand
gaggagcagacacagaaacag

SEQ ID NO: 17592 - RNA, 21 nt, Artificial Sequence
  Ebola virus siRNA sense strand
aggagcagacacagaaacagc

SEQ ID NO: 17593 - RNA, 21 nt, Artificial Sequence
  Ebola virus siRNA sense strand
ggagcagacacagaaacagca

SEQ ID NO: 17594 - RNA, 21 nt, Artificial Sequence
  Ebola virus siRNA sense strand
gagcagacacagaaacagcaa

SEQ ID NO: 17595 - RNA, 21 nt, Artificial Sequence
  Ebola virus siRNA sense strand
agcagacacagaaacagcaac

SEQ ID NO: 17596 - RNA, 21 nt, Artificial Sequence
  Ebola virus siRNA sense strand
gcagacacagaaacagcaacc

SEQ ID NO: 17597 - RNA, 21 nt, Artificial Sequence
  Ebola virus siRNA sense strand
cagacacagaaacagcaaccg

SEQ ID NO: 17598 - RNA, 21 nt, Artificial Sequence
  Ebola virus siRNA sense strand
agacacagaaacagcaaccga

SEQ ID NO: 17599 - RNA, 21 nt, Artificial Sequence
  Ebola virus siRNA sense strand
gacacagaaacagcaaccgaa

SEQ ID NO: 17600 - RNA, 21 nt, Artificial Sequence
  Ebola virus siRNA sense strand
acacagaaacagcaaccgaaa

SEQ ID NO: 17601 - RNA, 21 nt, Artificial Sequence
  Ebola virus siRNA sense strand
cacagaaacagcaaccgaaaa

SEQ ID NO: 17602 - RNA, 21 nt, Artificial Sequence
  Ebola virus siRNA sense strand
acagaaacagcaaccgaaaau

SEQ ID NO: 17603 - RNA, 21 nt, Artificial Sequence
  Ebola virus siRNA sense strand
cagaaacagcaaccgaaaaua

SEQ ID NO: 17604 - RNA, 21 nt, Artificial Sequence
  Ebola virus siRNA sense strand
agaaacagcaaccgaaaauac

SEQ ID NO: 17605 - RNA, 21 nt, Artificial Sequence
  Ebola virus siRNA sense strand
gaaacagcaaccgaaaauacu

SEQ ID NO: 17606 - RNA, 21 nt, Artificial Sequence
  Ebola virus siRNA sense strand
aaacagcaaccgaaaauacuu

SEQ ID NO: 17607 - RNA, 21 nt, Artificial Sequence
  Ebola virus siRNA sense strand
aacagcaaccgaaaauacuug

SEQ ID NO: 17608 - RNA, 21 nt, Artificial Sequence
  Ebola virus siRNA sense strand
acagcaaccgaaaauacuugg

SEQ ID NO: 17609 - RNA, 21 nt, Artificial Sequence
  Ebola virus siRNA sense strand
cagcaaccgaaaauacuuggc

SEQ ID NO: 17610 - RNA, 21 nt, Artificial Sequence
  Ebola virus siRNA sense strand
agcaaccgaaaauacuuggca

SEQ ID NO: 17611 - RNA, 21 nt, Artificial Sequence
  Ebola virus siRNA sense strand
gcaaccgaaaauacuuggcaa

SEQ ID NO: 17612 - RNA, 21 nt, Artificial Sequence
  Ebola virus siRNA sense strand
caaccgaaaauacuuggcaag

SEQ ID NO: 17613 - RNA, 21 nt, Artificial Sequence
  Ebola virus siRNA sense strand
aaccgaaaauacuuggcaaga

SEQ ID NO: 17614 - RNA, 21 nt, Artificial Sequence
  Ebola virus siRNA sense strand
accgaaaauacuuggcaagag

SEQ ID NO: 17615 - RNA, 21 nt, Artificial Sequence
  Ebola virus siRNA sense strand
ccgaaaauacuuggcaagaga

SEQ ID NO: 17616 - RNA, 21 nt, Artificial Sequence
  Ebola virus siRNA sense strand
cgaaaauacuuggcaagagac

SEQ ID NO: 17617 - RNA, 21 nt, Artificial Sequence
  Ebola virus siRNA sense strand
gaaaauacuuggcaagagacu

SEQ ID NO: 17618 - RNA, 21 nt, Artificial Sequence
  Ebola virus siRNA sense strand
aaaauacuuggcaagagacuc

SEQ ID NO: 17619 - RNA, 21 nt, Artificial Sequence
  Ebola virus siRNA sense strand
aaauacuuggcaagagacucu

SEQ ID NO: 17620 - RNA, 21 nt, Artificial Sequence
  Ebola virus siRNA sense strand
aauacuuggcaagagacucuu

SEQ ID NO: 17621 - RNA, 21 nt, Artificial Sequence
  Ebola virus siRNA sense strand
auacuuggcaagagacucuuc

SEQ ID NO: 17622 - RNA, 21 nt, Artificial Sequence
  Ebola virus siRNA sense strand
uacuuggcaagagacucuuca

SEQ ID NO: 17623 - RNA, 21 nt, Artificial Sequence
  Ebola virus siRNA sense strand
acuuggcaagagacucuucaa

SEQ ID NO: 17624 - RNA, 21 nt, Artificial Sequence
  Ebola virus siRNA sense strand
cuuggcaagagacucuucaac

SEQ ID NO: 17625 - RNA, 21 nt, Artificial Sequence
  Ebola virus siRNA sense strand
uuggcaagagacucuucaacu

SEQ ID NO: 17626 - RNA, 21 nt, Artificial Sequence
  Ebola virus siRNA sense strand
uggcaagagacucuucaacug

SEQ ID NO: 17627 - RNA, 21 nt, Artificial Sequence
  Ebola virus siRNA sense strand
ggcaagagacucuucaacugg

SEQ ID NO: 17628 - RNA, 21 nt, Artificial Sequence
  Ebola virus siRNA sense strand
gcaagagacucuucaacugga

SEQ ID NO: 17629 - RNA, 21 nt, Artificial Sequence
  Ebola virus siRNA sense strand
caagagacucuucaacuggau

SEQ ID NO: 17630 - RNA, 21 nt, Artificial Sequence
  Ebola virus siRNA sense strand
aagagacucuucaacuggauc

SEQ ID NO: 17631 - RNA, 21 nt, Artificial Sequence
  Ebola virus siRNA sense strand
agagacucuucaacuggauca

SEQ ID NO: 17632 - RNA, 21 nt, Artificial Sequence
  Ebola virus siRNA sense strand
gagacucuucaacuggaucaa

SEQ ID NO: 17633 - RNA, 21 nt, Artificial Sequence
  Ebola virus siRNA sense strand
agacucuucaacuggaucaag

SEQ ID NO: 17634 - RNA, 21 nt, Artificial Sequence
  Ebola virus siRNA sense strand
gacucuucaacuggaucaagc

SEQ ID NO: 17635 - RNA, 21 nt, Artificial Sequence
  Ebola virus siRNA sense strand
acucuucaacuggaucaagca

SEQ ID NO: 17636 - RNA, 21 nt, Artificial Sequence
  Ebola virus siRNA sense strand
cucuucaacuggaucaagcac

SEQ ID NO: 17637 - RNA, 21 nt, Artificial Sequence
  Ebola virus siRNA sense strand
ucuucaacuggaucaagcaca

SEQ ID NO: 17638 - RNA, 21 nt, Artificial Sequence
  Ebola virus siRNA sense strand
cuucaacuggaucaagcacaa

SEQ ID NO: 17639 - RNA, 21 nt, Artificial Sequence
  Ebola virus siRNA sense strand
uucaacuggaucaagcacaaa

SEQ ID NO: 17640 - RNA, 21 nt, Artificial Sequence
  Ebola virus siRNA sense strand
ucaacuggaucaagcacaaac

SEQ ID NO: 17641 - RNA, 21 nt, Artificial Sequence
  Ebola virus siRNA sense strand
caacuggaucaagcacaaaca

SEQ ID NO: 17642 - RNA, 21 nt, Artificial Sequence
  Ebola virus siRNA sense strand
aacuggaucaagcacaaacaa

SEQ ID NO: 17643 - RNA, 21 nt, Artificial Sequence
  Ebola virus siRNA sense strand
acuggaucaagcacaaacaac

SEQ ID NO: 17644 - RNA, 21 nt, Artificial Sequence
  Ebola virus siRNA sense strand
cuggaucaagcacaaacaaca

SEQ ID NO: 17645 - RNA, 21 nt, Artificial Sequence
  Ebola virus siRNA sense strand
uggaucaagcacaaacaacag

SEQ ID NO: 17646 - RNA, 21 nt, Artificial Sequence
  Ebola virus siRNA sense strand
ggaucaagcacaaacaacagu

SEQ ID NO: 17647 - RNA, 21 nt, Artificial Sequence
  Ebola virus siRNA sense strand
gaucaagcacaaacaacagug

SEQ ID NO: 17648 - RNA, 21 nt, Artificial Sequence
  Ebola virus siRNA sense strand
aucaagcacaaacaacaguga

SEQ ID NO: 17649 - RNA, 21 nt, Artificial Sequence
  Ebola virus siRNA sense strand
ucaagcacaaacaacagugau

SEQ ID NO: 17650 - RNA, 21 nt, Artificial Sequence
  Ebola virus siRNA sense strand
caagcacaaacaacagugaug

SEQ ID NO: 17651 - RNA, 21 nt, Artificial Sequence
  Ebola virus siRNA sense strand
aagcacaaacaacagugaugg

SEQ ID NO: 17652 - RNA, 21 nt, Artificial Sequence
  Ebola virus siRNA sense strand
agcacaaacaacagugauggu

SEQ ID NO: 17653 - RNA, 21 nt, Artificial Sequence
  Ebola virus siRNA sense strand
gcacaaacaacagugaugguc

SEQ ID NO: 17654 - RNA, 21 nt, Artificial Sequence
  Ebola virus siRNA sense strand
cacaaacaacagugaugguca

SEQ ID NO: 17655 - RNA, 21 nt, Artificial Sequence
  Ebola virus siRNA sense strand
acaaacaacagugauggucau

SEQ ID NO: 17656 - RNA, 21 nt, Artificial Sequence
  Ebola virus siRNA sense strand
caaacaacagugauggucaua

SEQ ID NO: 17657 - RNA, 21 nt, Artificial Sequence
  Ebola virus siRNA sense strand
aaacaacagugauggucauau

SEQ ID NO: 17658 - RNA, 21 nt, Artificial Sequence
  Ebola virus siRNA sense strand
aacaacagugauggucauauu

SEQ ID NO: 17659 - RNA, 21 nt, Artificial Sequence
  Ebola virus siRNA sense strand
acaacagugauggucauauug

SEQ ID NO: 17660 - RNA, 21 nt, Artificial Sequence
  Ebola virus siRNA sense strand
caacagugauggucauauuga

SEQ ID NO: 17661 - RNA, 21 nt, Artificial Sequence
  Ebola virus siRNA sense strand
aacagugauggucauauugag

SEQ ID NO: 17662 - RNA, 21 nt, Artificial Sequence
  Ebola virus siRNA sense strand
acagugauggucauauugaga

SEQ ID NO: 17663 - RNA, 21 nt, Artificial Sequence
  Ebola virus siRNA sense strand
cagugauggucauauugagag

SEQ ID NO: 17664 - RNA, 21 nt, Artificial Sequence
  Ebola virus siRNA sense strand
agugauggucauauugagaga

SEQ ID NO: 17665 - RNA, 21 nt, Artificial Sequence
  Ebola virus siRNA sense strand
gugauggucauauugagagaa

SEQ ID NO: 17666 - RNA, 21 nt, Artificial Sequence
  Ebola virus siRNA sense strand
ugauggucauauugagagaag

SEQ ID NO: 17667 - RNA, 21 nt, Artificial Sequence
  Ebola virus siRNA sense strand
gauggucauauugagagaagu

SEQ ID NO: 17668 - RNA, 21 nt, Artificial Sequence
  Ebola virus siRNA sense strand
auggucauauugagagaaguc

SEQ ID NO: 17669 - RNA, 21 nt, Artificial Sequence
  Ebola virus siRNA sense strand
uggucauauugagagaaguca

SEQ ID NO: 17670 - RNA, 21 nt, Artificial Sequence
  Ebola virus siRNA sense strand
ggucauauugagagaagucaa

SEQ ID NO: 17671 - RNA, 21 nt, Artificial Sequence
  Ebola virus siRNA sense strand
gucauauugagagaagucaag

SEQ ID NO: 17672 - RNA, 21 nt, Artificial Sequence
  Ebola virus siRNA sense strand
ucauauugagagaagucaaga

SEQ ID NO: 17673 - RNA, 21 nt, Artificial Sequence
  Ebola virus siRNA sense strand
cauauugagagaagucaagaa

SEQ ID NO: 17674 - RNA, 21 nt, Artificial Sequence
  Ebola virus siRNA sense strand
auauugagagaagucaagaac

SEQ ID NO: 17675 - RNA, 21 nt, Artificial Sequence
  Ebola virus siRNA sense strand
uauugagagaagucaagaaca

SEQ ID NO: 17676 - RNA, 21 nt, Artificial Sequence
  Ebola virus siRNA sense strand
auugagagaagucaagaacaa

SEQ ID NO: 17677 - RNA, 21 nt, Artificial Sequence
  Ebola virus siRNA sense strand
uugagagaagucaagaacaaa

SEQ ID NO: 17678 - RNA, 21 nt, Artificial Sequence
  Ebola virus siRNA sense strand
ugagagaagucaagaacaaac

SEQ ID NO: 17679 - RNA, 21 nt, Artificial Sequence
  Ebola virus siRNA sense strand
gagagaagucaagaacaaacc

SEQ ID NO: 17680 - RNA, 21 nt, Artificial Sequence
  Ebola virus siRNA sense strand
agagaagucaagaacaaacca

SEQ ID NO: 17681 - RNA, 21 nt, Artificial Sequence
  Ebola virus siRNA sense strand
gagaagucaagaacaaaccac

SEQ ID NO: 17682 - RNA, 21 nt, Artificial Sequence
  Ebola virus siRNA sense strand
agaagucaagaacaaaccacc

SEQ ID NO: 17683 - RNA, 21 nt, Artificial Sequence
  Ebola virus siRNA sense strand
gaagucaagaacaaaccacca

SEQ ID NO: 17684 - RNA, 21 nt, Artificial Sequence
  Ebola virus siRNA sense strand
aagucaagaacaaaccaccag

SEQ ID NO: 17685 - RNA, 21 nt, Artificial Sequence
  Ebola virus siRNA sense strand
agucaagaacaaaccaccaga

SEQ ID NO: 17686 - RNA, 21 nt, Artificial Sequence
  Ebola virus siRNA sense strand
gucaagaacaaaccaccagag

SEQ ID NO: 17687 - RNA, 21 nt, Artificial Sequence
  Ebola virus siRNA sense strand
ucaagaacaaaccaccagaga

SEQ ID NO: 17688 - RNA, 21 nt, Artificial Sequence
  Ebola virus siRNA sense strand
caagaacaaaccaccagagau

SEQ ID NO: 17689 - RNA, 21 nt, Artificial Sequence
  Ebola virus siRNA sense strand
aagaacaaaccaccagagauc

SEQ ID NO: 17690 - RNA, 21 nt, Artificial Sequence
  Ebola virus siRNA sense strand
agaacaaaccaccagagaucc

SEQ ID NO: 17691 - RNA, 21 nt, Artificial Sequence
  Ebola virus siRNA sense strand
gaacaaaccaccagagaucca

SEQ ID NO: 17692 - RNA, 21 nt, Artificial Sequence
  Ebola virus siRNA sense strand
aacaaaccaccagagauccac

SEQ ID NO: 17693 - RNA, 21 nt, Artificial Sequence
  Ebola virus siRNA sense strand
acaaaccaccagagauccaca

SEQ ID NO: 17694 - RNA, 21 nt, Artificial Sequence
  Ebola virus siRNA sense strand
caaaccaccagagauccacau

SEQ ID NO: 17695 - RNA, 21 nt, Artificial Sequence
  Ebola virus siRNA sense strand
aaaccaccagagauccacaug

SEQ ID NO: 17696 - RNA, 21 nt, Artificial Sequence
  Ebola virus siRNA sense strand
aaccaccagagauccacauga

SEQ ID NO: 17697 - RNA, 21 nt, Artificial Sequence
  Ebola virus siRNA sense strand
accaccagagauccacaugau

SEQ ID NO: 17698 - RNA, 21 nt, Artificial Sequence
  Ebola virus siRNA sense strand
ccaccagagauccacaugaug

SEQ ID NO: 17699 - RNA, 21 nt, Artificial Sequence
  Ebola virus siRNA sense strand
caccagagauccacaugaugg

SEQ ID NO: 17700 - RNA, 21 nt, Artificial Sequence
  Ebola virus siRNA sense strand
accagagauccacaugauggc

SEQ ID NO: 17701 - RNA, 21 nt, Artificial Sequence
  Ebola virus siRNA sense strand
ccagagauccacaugauggca

SEQ ID NO: 17702 - RNA, 21 nt, Artificial Sequence
  Ebola virus siRNA sense strand
cagagauccacaugauggcac

SEQ ID NO: 17703 - RNA, 21 nt, Artificial Sequence
  Ebola virus siRNA sense strand
agagauccacaugauggcacu

SEQ ID NO: 17704 - RNA, 21 nt, Artificial Sequence
  Ebola virus siRNA sense strand
gagauccacaugauggcacug

SEQ ID NO: 17705 - RNA, 21 nt, Artificial Sequence
  Ebola virus siRNA sense strand
agauccacaugauggcacuga

SEQ ID NO: 17706 - RNA, 21 nt, Artificial Sequence
  Ebola virus siRNA sense strand
gauccacaugauggcacugaa

SEQ ID NO: 17707 - RNA, 21 nt, Artificial Sequence
  Ebola virus siRNA sense strand
auccacaugauggcacugaac

SEQ ID NO: 17708 - RNA, 21 nt, Artificial Sequence
  Ebola virus siRNA sense strand
uccacaugauggcacugaacg

SEQ ID NO: 17709 - RNA, 21 nt, Artificial Sequence
  Ebola virus siRNA sense strand
ccacaugauggcacugaacgg

SEQ ID NO: 17710 - RNA, 21 nt, Artificial Sequence
  Ebola virus siRNA sense strand
cacaugauggcacugaacgga

SEQ ID NO: 17711 - RNA, 21 nt, Artificial Sequence
  Ebola virus siRNA sense strand
acaugauggcacugaacggaa

SEQ ID NO: 17712 - RNA, 21 nt, Artificial Sequence
  Ebola virus siRNA sense strand
caugauggcacugaacggaau

SEQ ID NO: 17713 - RNA, 21 nt, Artificial Sequence
  Ebola virus siRNA sense strand
augauggcacugaacggaauc

SEQ ID NO: 17714 - RNA, 21 nt, Artificial Sequence
  Ebola virus siRNA sense strand
ugauggcacugaacggaaucu

SEQ ID NO: 17715 - RNA, 21 nt, Artificial Sequence
  Ebola virus siRNA sense strand
gauggcacugaacggaaucua

SEQ ID NO: 17716 - RNA, 21 nt, Artificial Sequence
  Ebola virus siRNA sense strand
auggcacugaacggaaucuag

SEQ ID NO: 17717 - RNA, 21 nt, Artificial Sequence
  Ebola virus siRNA sense strand
uggcacugaacggaaucuagu

SEQ ID NO: 17718 - RNA, 21 nt, Artificial Sequence
  Ebola virus siRNA sense strand
ggcacugaacggaaucuaguc

SEQ ID NO: 17719 - RNA, 21 nt, Artificial Sequence
  Ebola virus siRNA sense strand
gcacugaacggaaucuagucc

SEQ ID NO: 17720 - RNA, 21 nt, Artificial Sequence
  Ebola virus siRNA sense strand
cacugaacggaaucuaguccu

SEQ ID NO: 17721 - RNA, 21 nt, Artificial Sequence
  Ebola virus siRNA sense strand
acugaacggaaucuaguccua

SEQ ID NO: 17722 - RNA, 21 nt, Artificial Sequence
  Ebola virus siRNA sense strand
cugaacggaaucuaguccuac

SEQ ID NO: 17723 - RNA, 21 nt, Artificial Sequence
  Ebola virus siRNA sense strand
ugaacggaaucuaguccuaca

SEQ ID NO: 17724 - RNA, 21 nt, Artificial Sequence
  Ebola virus siRNA sense strand
gaacggaaucuaguccuacaa

SEQ ID NO: 17725 - RNA, 21 nt, Artificial Sequence
  Ebola virus siRNA sense strand
aacggaaucuaguccuacaaa

SEQ ID NO: 17726 - RNA, 21 nt, Artificial Sequence
  Ebola virus siRNA sense strand
acggaaucuaguccuacaaau

SEQ ID NO: 17727 - RNA, 21 nt, Artificial Sequence
  Ebola virus siRNA sense strand
cggaaucuaguccuacaaaug

SEQ ID NO: 17728 - RNA, 21 nt, Artificial Sequence
  Ebola virus siRNA sense strand
ggaaucuaguccuacaaauga

SEQ ID NO: 17729 - RNA, 21 nt, Artificial Sequence
  Ebola virus siRNA sense strand
gaaucuaguccuacaaaugag

SEQ ID NO: 17730 - RNA, 21 nt, Artificial Sequence
  Ebola virus siRNA sense strand
aaucuaguccuacaaaugagc

SEQ ID NO: 17731 - RNA, 21 nt, Artificial Sequence
  Ebola virus siRNA sense strand
aucuaguccuacaaaugagcc

SEQ ID NO: 17732 - RNA, 21 nt, Artificial Sequence
  Ebola virus siRNA sense strand
ucuaguccuacaaaugagcca

SEQ ID NO: 17733 - RNA, 21 nt, Artificial Sequence
  Ebola virus siRNA sense strand
cuaguccuacaaaugagccau

SEQ ID NO: 17734 - RNA, 21 nt, Artificial Sequence
  Ebola virus siRNA sense strand
uaguccuacaaaugagccaug

SEQ ID NO: 17735 - RNA, 21 nt, Artificial Sequence
  Ebola virus siRNA sense strand
aguccuacaaaugagccauga

SEQ ID NO: 17736 - RNA, 21 nt, Artificial Sequence
  Ebola virus siRNA sense strand
guccuacaaaugagccaugaa

SEQ ID NO: 17737 - RNA, 21 nt, Artificial Sequence
  Ebola virus siRNA sense strand
uccuacaaaugagccaugaaa

SEQ ID NO: 17738 - RNA, 21 nt, Artificial Sequence
  Ebola virus siRNA sense strand
ccuacaaaugagccaugaaau

SEQ ID NO: 17739 - RNA, 21 nt, Artificial Sequence
  Ebola virus siRNA sense strand
cuacaaaugagccaugaaaua

SEQ ID NO: 17740 - RNA, 21 nt, Artificial Sequence
  Ebola virus siRNA sense strand
uacaaaugagccaugaaauaa

SEQ ID NO: 17741 - RNA, 21 nt, Artificial Sequence
  Ebola virus siRNA sense strand
acaaaugagccaugaaauaaa

SEQ ID NO: 17742 - RNA, 21 nt, Artificial Sequence
  Ebola virus siRNA sense strand
caaaugagccaugaaauaaaa

SEQ ID NO: 17743 - RNA, 21 nt, Artificial Sequence
  Ebola virus siRNA sense strand
aaaugagccaugaaauaaaaa

SEQ ID NO: 17744 - RNA, 21 nt, Artificial Sequence
  Ebola virus siRNA sense strand
aaugagccaugaaauaaaaag

SEQ ID NO: 17745 - RNA, 21 nt, Artificial Sequence
  Ebola virus siRNA sense strand
augagccaugaaauaaaaaga

SEQ ID NO: 17746 - RNA, 21 nt, Artificial Sequence
  Ebola virus siRNA sense strand
ugagccaugaaauaaaaagaa

SEQ ID NO: 17747 - RNA, 21 nt, Artificial Sequence
  Ebola virus siRNA sense strand
gagccaugaaauaaaaagaac

SEQ ID NO: 17748 - RNA, 21 nt, Artificial Sequence
  Ebola virus siRNA sense strand
agccaugaaauaaaaagaacg

SEQ ID NO: 17749 - RNA, 21 nt, Artificial Sequence
  Ebola virus siRNA sense strand
gccaugaaauaaaaagaacga

SEQ ID NO: 17750 - RNA, 21 nt, Artificial Sequence
  Ebola virus siRNA sense strand
ccaugaaauaaaaagaacgac

SEQ ID NO: 17751 - RNA, 21 nt, Artificial Sequence
  Ebola virus siRNA sense strand
caugaaauaaaaagaacgaca

SEQ ID NO: 17752 - RNA, 21 nt, Artificial Sequence
  Ebola virus siRNA sense strand
augaaauaaaaagaacgacaa

SEQ ID NO: 17753 - RNA, 21 nt, Artificial Sequence
  Ebola virus siRNA sense strand
ugaaauaaaaagaacgacaau

SEQ ID NO: 17754 - RNA, 21 nt, Artificial Sequence
  Ebola virus siRNA sense strand
gaaauaaaaagaacgacaauu

SEQ ID NO: 17755 - RNA, 21 nt, Artificial Sequence
  Ebola virus siRNA sense strand
aaauaaaaagaacgacaauuc

SEQ ID NO: 17756 - RNA, 21 nt, Artificial Sequence
  Ebola virus siRNA sense strand
aauaaaaagaacgacaauucc

SEQ ID NO: 17757 - RNA, 21 nt, Artificial Sequence
  Ebola virus siRNA sense strand
auaaaaagaacgacaauucca

SEQ ID NO: 17758 - RNA, 21 nt, Artificial Sequence
  Ebola virus siRNA sense strand
uaaaaagaacgacaauuccac

SEQ ID NO: 17759 - RNA, 21 nt, Artificial Sequence
  Ebola virus siRNA sense strand
aaaaagaacgacaauuccaca

SEQ ID NO: 17760 - RNA, 21 nt, Artificial Sequence
  Ebola virus siRNA sense strand
aaaagaacgacaauuccacaa

SEQ ID NO: 17761 - RNA, 21 nt, Artificial Sequence
  Ebola virus siRNA sense strand
aaagaacgacaauuccacaag

SEQ ID NO: 17762 - RNA, 21 nt, Artificial Sequence
  Ebola virus siRNA sense strand
aagaacgacaauuccacaaga

SEQ ID NO: 17763 - RNA, 21 nt, Artificial Sequence
  Ebola virus siRNA sense strand
agaacgacaauuccacaagaa

SEQ ID NO: 17764 - RNA, 21 nt, Artificial Sequence
  Ebola virus siRNA sense strand
gaacgacaauuccacaagaaa

SEQ ID NO: 17765 - RNA, 21 nt, Artificial Sequence
  Ebola virus siRNA sense strand
aacgacaauuccacaagaaaa

SEQ ID NO: 17766 - RNA, 21 nt, Artificial Sequence
  Ebola virus siRNA sense strand
acgacaauuccacaagaaaac

SEQ ID NO: 17767 - RNA, 21 nt, Artificial Sequence
  Ebola virus siRNA sense strand
cgacaauuccacaagaaaaca

SEQ ID NO: 17768 - RNA, 21 nt, Artificial Sequence
  Ebola virus siRNA sense strand
gacaauuccacaagaaaacac

SEQ ID NO: 17769 - RNA, 21 nt, Artificial Sequence
  Ebola virus siRNA sense strand
acaauuccacaagaaaacacg

SEQ ID NO: 17770 - RNA, 21 nt, Artificial Sequence
  Ebola virus siRNA sense strand
caauuccacaagaaaacacgc

SEQ ID NO: 17771 - RNA, 21 nt, Artificial Sequence
  Ebola virus siRNA sense strand
aauuccacaagaaaacacgca

SEQ ID NO: 17772 - RNA, 21 nt, Artificial Sequence
  Ebola virus siRNA sense strand
auuccacaagaaaacacgcac

SEQ ID NO: 17773 - RNA, 21 nt, Artificial Sequence
  Ebola virus siRNA sense strand
uuccacaagaaaacacgcacc

SEQ ID NO: 17774 - RNA, 21 nt, Artificial Sequence
  Ebola virus siRNA sense strand
uccacaagaaaacacgcacca

SEQ ID NO: 17775 - RNA, 21 nt, Artificial Sequence
  Ebola virus siRNA sense strand
ccacaagaaaacacgcaccag

SEQ ID NO: 17776 - RNA, 21 nt, Artificial Sequence
  Ebola virus siRNA sense strand
cacaagaaaacacgcaccagg

SEQ ID NO: 17777 - RNA, 21 nt, Artificial Sequence
  Ebola virus siRNA sense strand
acaagaaaacacgcaccaggg

SEQ ID NO: 17778 - RNA, 21 nt, Artificial Sequence
  Ebola virus siRNA sense strand
caagaaaacacgcaccagggu

SEQ ID NO: 17779 - RNA, 21 nt, Artificial Sequence
  Ebola virus siRNA sense strand
aagaaaacacgcaccaggguc

SEQ ID NO: 17780 - RNA, 21 nt, Artificial Sequence
  Ebola virus siRNA sense strand
agaaaacacgcaccagggucc

SEQ ID NO: 17781 - RNA, 21 nt, Artificial Sequence
  Ebola virus siRNA sense strand
gaaaacacgcaccaggguccg

SEQ ID NO: 17782 - RNA, 21 nt, Artificial Sequence
  Ebola virus siRNA sense strand
aaaacacgcaccaggguccgu

SEQ ID NO: 17783 - RNA, 21 nt, Artificial Sequence
  Ebola virus siRNA sense strand
aaacacgcaccaggguccguc

SEQ ID NO: 17784 - RNA, 21 nt, Artificial Sequence
  Ebola virus siRNA sense strand
aacacgcaccaggguccgucg

SEQ ID NO: 17785 - RNA, 21 nt, Artificial Sequence
  Ebola virus siRNA sense strand
acacgcaccaggguccgucgu

SEQ ID NO: 17786 - RNA, 21 nt, Artificial Sequence
  Ebola virus siRNA sense strand
cacgcaccaggguccgucguu

SEQ ID NO: 17787 - RNA, 21 nt, Artificial Sequence
  Ebola virus siRNA sense strand
acgcaccaggguccgucguuc

SEQ ID NO: 17788 - RNA, 21 nt, Artificial Sequence
  Ebola virus siRNA sense strand
cgcaccaggguccgucguucc

SEQ ID NO: 17789 - RNA, 21 nt, Artificial Sequence
  Ebola virus siRNA sense strand
gcaccaggguccgucguucca

SEQ ID NO: 17790 - RNA, 21 nt, Artificial Sequence
  Ebola virus siRNA sense strand
caccaggguccgucguuccag

SEQ ID NO: 17791 - RNA, 21 nt, Artificial Sequence
  Ebola virus siRNA sense strand
accaggguccgucguuccagu

SEQ ID NO: 17792 - RNA, 21 nt, Artificial Sequence
  Ebola virus siRNA sense strand
ccaggguccgucguuccaguc

SEQ ID NO: 17793 - RNA, 21 nt, Artificial Sequence
  Ebola virus siRNA sense strand
caggguccgucguuccagucc

SEQ ID NO: 17794 - RNA, 21 nt, Artificial Sequence
  Ebola virus siRNA sense strand
aggguccgucguuccaguccu

SEQ ID NO: 17795 - RNA, 21 nt, Artificial Sequence
  Ebola virus siRNA sense strand
ggguccgucguuccaguccuu

SEQ ID NO: 17796 - RNA, 21 nt, Artificial Sequence
  Ebola virus siRNA sense strand
gguccgucguuccaguccuuu

SEQ ID NO: 17797 - RNA, 21 nt, Artificial Sequence
  Ebola virus siRNA sense strand
guccgucguuccaguccuuuc

SEQ ID NO: 17798 - RNA, 21 nt, Artificial Sequence
  Ebola virus siRNA sense strand
uccgucguuccaguccuuucu

SEQ ID NO: 17799 - RNA, 21 nt, Artificial Sequence
  Ebola virus siRNA sense strand
ccgucguuccaguccuuucua

SEQ ID NO: 17800 - RNA, 21 nt, Artificial Sequence
  Ebola virus siRNA sense strand
cgucguuccaguccuuucuaa

SEQ ID NO: 17801 - RNA, 21 nt, Artificial Sequence
  Ebola virus siRNA sense strand
gucguuccaguccuuucuaag

SEQ ID NO: 17802 - RNA, 21 nt, Artificial Sequence
  Ebola virus siRNA sense strand
ucguuccaguccuuucuaagu

SEQ ID NO: 17803 - RNA, 21 nt, Artificial Sequence
  Ebola virus siRNA sense strand
cguuccaguccuuucuaagug

SEQ ID NO: 17804 - RNA, 21 nt, Artificial Sequence
  Ebola virus siRNA sense strand
guuccaguccuuucuaaguga

SEQ ID NO: 17805 - RNA, 21 nt, Artificial Sequence
  Ebola virus siRNA sense strand
uuccaguccuuucuaagugac

SEQ ID NO: 17806 - RNA, 21 nt, Artificial Sequence
  Ebola virus siRNA sense strand
uccaguccuuucuaagugacu

SEQ ID NO: 17807 - RNA, 21 nt, Artificial Sequence
  Ebola virus siRNA sense strand
ccaguccuuucuaagugacuc

SEQ ID NO: 17808 - RNA, 21 nt, Artificial Sequence
  Ebola virus siRNA sense strand
caguccuuucuaagugacucu

SEQ ID NO: 17809 - RNA, 21 nt, Artificial Sequence
  Ebola virus siRNA sense strand
aguccuuucuaagugacucug

SEQ ID NO: 17810 - RNA, 21 nt, Artificial Sequence
  Ebola virus siRNA sense strand
guccuuucuaagugacucugc

SEQ ID NO: 17811 - RNA, 21 nt, Artificial Sequence
  Ebola virus siRNA sense strand
uccuuucuaagugacucugcu

SEQ ID NO: 17812 - RNA, 21 nt, Artificial Sequence
  Ebola virus siRNA sense strand
ccuuucuaagugacucugcuu

SEQ ID NO: 17813 - RNA, 21 nt, Artificial Sequence
  Ebola virus siRNA sense strand
cuuucuaagugacucugcuug

SEQ ID NO: 17814 - RNA, 21 nt, Artificial Sequence
  Ebola virus siRNA sense strand
uuucuaagugacucugcuugu

SEQ ID NO: 17815 - RNA, 21 nt, Artificial Sequence
  Ebola virus siRNA sense strand
uucuaagugacucugcuugug

SEQ ID NO: 17816 - RNA, 21 nt, Artificial Sequence
  Ebola virus siRNA sense strand
ucuaagugacucugcuugugg

SEQ ID NO: 17817 - RNA, 21 nt, Artificial Sequence
  Ebola virus siRNA sense strand
cuaagugacucugcuuguggu

SEQ ID NO: 17818 - RNA, 21 nt, Artificial Sequence
  Ebola virus siRNA sense strand
uaagugacucugcuuguggua

SEQ ID NO: 17819 - RNA, 21 nt, Artificial Sequence
  Ebola virus siRNA sense strand
aagugacucugcuugugguac

SEQ ID NO: 17820 - RNA, 21 nt, Artificial Sequence
  Ebola virus siRNA sense strand
agugacucugcuugugguaca

SEQ ID NO: 17821 - RNA, 21 nt, Artificial Sequence
  Ebola virus siRNA sense strand
gugacucugcuugugguacag

SEQ ID NO: 17822 - RNA, 21 nt, Artificial Sequence
  Ebola virus siRNA sense strand
ugacucugcuugugguacagc

SEQ ID NO: 17823 - RNA, 21 nt, Artificial Sequence
  Ebola virus siRNA sense strand
gacucugcuugugguacagca

SEQ ID NO: 17824 - RNA, 21 nt, Artificial Sequence
  Ebola virus siRNA sense strand
acucugcuugugguacagcaa

SEQ ID NO: 17825 - RNA, 21 nt, Artificial Sequence
  Ebola virus siRNA sense strand
cucugcuugugguacagcaaa

SEQ ID NO: 17826 - RNA, 21 nt, Artificial Sequence
  Ebola virus siRNA sense strand
ucugcuugugguacagcaaau

SEQ ID NO: 17827 - RNA, 21 nt, Artificial Sequence
  Ebola virus siRNA sense strand
cugcuugugguacagcaaauc

SEQ ID NO: 17828 - RNA, 21 nt, Artificial Sequence
  Ebola virus siRNA sense strand
ugcuugugguacagcaaaucc

SEQ ID NO: 17829 - RNA, 21 nt, Artificial Sequence
  Ebola virus siRNA sense strand
gcuugugguacagcaaaucca

SEQ ID NO: 17830 - RNA, 21 nt, Artificial Sequence
  Ebola virus siRNA sense strand
cuugugguacagcaaauccaa

SEQ ID NO: 17831 - RNA, 21 nt, Artificial Sequence
  Ebola virus siRNA sense strand
uugugguacagcaaauccaaa

SEQ ID NO: 17832 - RNA, 21 nt, Artificial Sequence
  Ebola virus siRNA sense strand
ugugguacagcaaauccaaaa

SEQ ID NO: 17833 - RNA, 21 nt, Artificial Sequence
  Ebola virus siRNA sense strand
gugguacagcaaauccaaaac

SEQ ID NO: 17834 - RNA, 21 nt, Artificial Sequence
  Ebola virus siRNA sense strand
ugguacagcaaauccaaaacu

SEQ ID NO: 17835 - RNA, 21 nt, Artificial Sequence
  Ebola virus siRNA sense strand
gguacagcaaauccaaaacua

SEQ ID NO: 17836 - RNA, 21 nt, Artificial Sequence
  Ebola virus siRNA sense strand
guacagcaaauccaaaacuaa

SEQ ID NO: 17837 - RNA, 21 nt, Artificial Sequence
  Ebola virus siRNA sense strand
uacagcaaauccaaaacuaaa

SEQ ID NO: 17838 - RNA, 21 nt, Artificial Sequence
  Ebola virus siRNA sense strand
acagcaaauccaaaacuaaau

SEQ ID NO: 17839 - RNA, 21 nt, Artificial Sequence
  Ebola virus siRNA sense strand
cagcaaauccaaaacuaaauu

SEQ ID NO: 17840 - RNA, 21 nt, Artificial Sequence
  Ebola virus siRNA sense strand
agcaaauccaaaacuaaauuu

SEQ ID NO: 17841 - RNA, 21 nt, Artificial Sequence
  Ebola virus siRNA sense strand
gcaaauccaaaacuaaauuuc

SEQ ID NO: 17842 - RNA, 21 nt, Artificial Sequence
  Ebola virus siRNA sense strand
caaauccaaaacuaaauuucg

SEQ ID NO: 17843 - RNA, 21 nt, Artificial Sequence
  Ebola virus siRNA sense strand
aaauccaaaacuaaauuucga

SEQ ID NO: 17844 - RNA, 21 nt, Artificial Sequence
  Ebola virus siRNA sense strand
aauccaaaacuaaauuucgau

SEQ ID NO: 17845 - RNA, 21 nt, Artificial Sequence
  Ebola virus siRNA sense strand
auccaaaacuaaauuucgauc

SEQ ID NO: 17846 - RNA, 21 nt, Artificial Sequence
  Ebola virus siRNA sense strand
uccaaaacuaaauuucgaucg

SEQ ID NO: 17847 - RNA, 21 nt, Artificial Sequence
  Ebola virus siRNA sense strand
ccaaaacuaaauuucgaucga

SEQ ID NO: 17848 - RNA, 21 nt, Artificial Sequence
  Ebola virus siRNA sense strand
caaaacuaaauuucgaucgau

SEQ ID NO: 17849 - RNA, 21 nt, Artificial Sequence
  Ebola virus siRNA sense strand
aaaacuaaauuucgaucgauc

SEQ ID NO: 17850 - RNA, 21 nt, Artificial Sequence
  Ebola virus siRNA sense strand
aaacuaaauuucgaucgaucg

SEQ ID NO: 17851 - RNA, 21 nt, Artificial Sequence
  Ebola virus siRNA sense strand
aacuaaauuucgaucgaucga

SEQ ID NO: 17852 - RNA, 21 nt, Artificial Sequence
  Ebola virus siRNA sense strand
acuaaauuucgaucgaucgag

SEQ ID NO: 17853 - RNA, 21 nt, Artificial Sequence
  Ebola virus siRNA sense strand
cuaaauuucgaucgaucgaga

SEQ ID NO: 17854 - RNA, 21 nt, Artificial Sequence
  Ebola virus siRNA sense strand
uaaauuucgaucgaucgagac

SEQ ID NO: 17855 - RNA, 21 nt, Artificial Sequence
  Ebola virus siRNA sense strand
aaauuucgaucgaucgagaca

SEQ ID NO: 17856 - RNA, 21 nt, Artificial Sequence
  Ebola virus siRNA sense strand
aauuucgaucgaucgagacac

SEQ ID NO: 17857 - RNA, 21 nt, Artificial Sequence
  Ebola virus siRNA sense strand
auuucgaucgaucgagacaca

SEQ ID NO: 17858 - RNA, 21 nt, Artificial Sequence
  Ebola virus siRNA sense strand
uuucgaucgaucgagacacaa

SEQ ID NO: 17859 - RNA, 21 nt, Artificial Sequence
  Ebola virus siRNA sense strand
uucgaucgaucgagacacaau

SEQ ID NO: 17860 - RNA, 21 nt, Artificial Sequence
  Ebola virus siRNA sense strand
ucgaucgaucgagacacaaug

SEQ ID NO: 17861 - RNA, 21 nt, Artificial Sequence
  Ebola virus siRNA sense strand
cgaucgaucgagacacaaugu

SEQ ID NO: 17862 - RNA, 21 nt, Artificial Sequence
  Ebola virus siRNA sense strand
gaucgaucgagacacaaugug

SEQ ID NO: 17863 - RNA, 21 nt, Artificial Sequence
  Ebola virus siRNA sense strand
aucgaucgagacacaauguga

SEQ ID NO: 17864 - RNA, 21 nt, Artificial Sequence
  Ebola virus siRNA sense strand
ucgaucgagacacaaugugaa

SEQ ID NO: 17865 - RNA, 21 nt, Artificial Sequence
  Ebola virus siRNA sense strand
cgaucgagacacaaugugaaa

SEQ ID NO: 17866 - RNA, 21 nt, Artificial Sequence
  Ebola virus siRNA sense strand
gaucgagacacaaugugaaau

SEQ ID NO: 17867 - RNA, 21 nt, Artificial Sequence
  Ebola virus siRNA sense strand
aucgagacacaaugugaaauu

SEQ ID NO: 17868 - RNA, 21 nt, Artificial Sequence
  Ebola virus siRNA sense strand
ucgagacacaaugugaaauuu

SEQ ID NO: 17869 - RNA, 21 nt, Artificial Sequence
  Ebola virus siRNA sense strand
cgagacacaaugugaaauuuc

SEQ ID NO: 17870 - RNA, 21 nt, Artificial Sequence
  Ebola virus siRNA sense strand
gagacacaaugugaaauuuca

SEQ ID NO: 17871 - RNA, 21 nt, Artificial Sequence
  Ebola virus siRNA sense strand
agacacaaugugaaauuucag

SEQ ID NO: 17872 - RNA, 21 nt, Artificial Sequence
  Ebola virus siRNA sense strand
gacacaaugugaaauuucagg

SEQ ID NO: 17873 - RNA, 21 nt, Artificial Sequence
  Ebola virus siRNA sense strand
acacaaugugaaauuucagga

SEQ ID NO: 17874 - RNA, 21 nt, Artificial Sequence
  Ebola virus siRNA sense strand
cacaaugugaaauuucaggau

SEQ ID NO: 17875 - RNA, 21 nt, Artificial Sequence
  Ebola virus siRNA sense strand
acaaugugaaauuucaggauc

SEQ ID NO: 17876 - RNA, 21 nt, Artificial Sequence
  Ebola virus siRNA sense strand
caaugugaaauuucaggauca

SEQ ID NO: 17877 - RNA, 21 nt, Artificial Sequence
  Ebola virus siRNA sense strand
aaugugaaauuucaggaucau

SEQ ID NO: 17878 - RNA, 21 nt, Artificial Sequence
  Ebola virus siRNA sense strand
augugaaauuucaggaucaua

SEQ ID NO: 17879 - RNA, 21 nt, Artificial Sequence
  Ebola virus siRNA sense strand
ugugaaauuucaggaucauaa

SEQ ID NO: 17880 - RNA, 21 nt, Artificial Sequence
  Ebola virus siRNA sense strand
gugaaauuucaggaucauaac

SEQ ID NO: 17881 - RNA, 21 nt, Artificial Sequence
  Ebola virus siRNA sense strand
ugaaauuucaggaucauaacu

SEQ ID NO: 17882 - RNA, 21 nt, Artificial Sequence
  Ebola virus siRNA sense strand
gaaauuucaggaucauaacuc

SEQ ID NO: 17883 - RNA, 21 nt, Artificial Sequence
  Ebola virus siRNA sense strand
aaauuucaggaucauaacucg

SEQ ID NO: 17884 - RNA, 21 nt, Artificial Sequence
  Ebola virus siRNA sense strand
aauuucaggaucauaacucgg

SEQ ID NO: 17885 - RNA, 21 nt, Artificial Sequence
  Ebola virus siRNA sense strand
auuucaggaucauaacucggc

SEQ ID NO: 17886 - RNA, 21 nt, Artificial Sequence
  Ebola virus siRNA sense strand
uuucaggaucauaacucggca

SEQ ID NO: 17887 - RNA, 21 nt, Artificial Sequence
  Ebola virus siRNA sense strand
uucaggaucauaacucggcau

SEQ ID NO: 17888 - RNA, 21 nt, Artificial Sequence
  Ebola virus siRNA sense strand
ucaggaucauaacucggcauc

SEQ ID NO: 17889 - RNA, 21 nt, Artificial Sequence
  Ebola virus siRNA sense strand
caggaucauaacucggcaucc

SEQ ID NO: 17890 - RNA, 21 nt, Artificial Sequence
  Ebola virus siRNA sense strand
aggaucauaacucggcaucca

SEQ ID NO: 17891 - RNA, 21 nt, Artificial Sequence
  Ebola virus siRNA sense strand
ggaucauaacucggcauccaa

SEQ ID NO: 17892 - RNA, 21 nt, Artificial Sequence
  Ebola virus siRNA sense strand
gaucauaacucggcauccaag

SEQ ID NO: 17893 - RNA, 21 nt, Artificial Sequence
  Ebola virus siRNA sense strand
aucauaacucggcauccaaga

SEQ ID NO: 17894 - RNA, 21 nt, Artificial Sequence
  Ebola virus siRNA sense strand
ucauaacucggcauccaagag

SEQ ID NO: 17895 - RNA, 21 nt, Artificial Sequence
  Ebola virus siRNA sense strand
cauaacucggcauccaagagg

SEQ ID NO: 17896 - RNA, 21 nt, Artificial Sequence
  Ebola virus siRNA sense strand
auaacucggcauccaagaggg

SEQ ID NO: 17897 - RNA, 21 nt, Artificial Sequence
  Ebola virus siRNA sense strand
uaacucggcauccaagaggga

SEQ ID NO: 17898 - RNA, 21 nt, Artificial Sequence
  Ebola virus siRNA sense strand
aacucggcauccaagagggaa

SEQ ID NO: 17899 - RNA, 21 nt, Artificial Sequence
  Ebola virus siRNA sense strand
acucggcauccaagagggaag

SEQ ID NO: 17900 - RNA, 21 nt, Artificial Sequence
  Ebola virus siRNA sense strand
cucggcauccaagagggaagg

SEQ ID NO: 17901 - RNA, 21 nt, Artificial Sequence
  Ebola virus siRNA sense strand
ucggcauccaagagggaaggu

SEQ ID NO: 17902 - RNA, 21 nt, Artificial Sequence
  Ebola virus siRNA sense strand
cggcauccaagagggaagguc

SEQ ID NO: 17903 - RNA, 21 nt, Artificial Sequence
  Ebola virus siRNA sense strand
ggcauccaagagggaagguca

SEQ ID NO: 17904 - RNA, 21 nt, Artificial Sequence
  Ebola virus siRNA sense strand
gcauccaagagggaaggucau

SEQ ID NO: 17905 - RNA, 21 nt, Artificial Sequence
  Ebola virus siRNA sense strand
cauccaagagggaaggucauc

SEQ ID NO: 17906 - RNA, 21 nt, Artificial Sequence
  Ebola virus siRNA sense strand
auccaagagggaaggucauca

SEQ ID NO: 17907 - RNA, 21 nt, Artificial Sequence
  Ebola virus siRNA sense strand
uccaagagggaaggucaucaa

SEQ ID NO: 17908 - RNA, 21 nt, Artificial Sequence
  Ebola virus siRNA sense strand
ccaagagggaaggucaucaaa

SEQ ID NO: 17909 - RNA, 21 nt, Artificial Sequence
  Ebola virus siRNA sense strand
caagagggaaggucaucaaau

SEQ ID NO: 17910 - RNA, 21 nt, Artificial Sequence
  Ebola virus siRNA sense strand
aagagggaaggucaucaaaua

SEQ ID NO: 17911 - RNA, 21 nt, Artificial Sequence
  Ebola virus siRNA sense strand
agagggaaggucaucaaauaa

SEQ ID NO: 17912 - RNA, 21 nt, Artificial Sequence
  Ebola virus siRNA sense strand
gagggaaggucaucaaauaau

SEQ ID NO: 17913 - RNA, 21 nt, Artificial Sequence
  Ebola virus siRNA sense strand
agggaaggucaucaaauaauc

SEQ ID NO: 17914 - RNA, 21 nt, Artificial Sequence
  Ebola virus siRNA sense strand
gggaaggucaucaaauaaucu

SEQ ID NO: 17915 - RNA, 21 nt, Artificial Sequence
  Ebola virus siRNA sense strand
ggaaggucaucaaauaaucuc

SEQ ID NO: 17916 - RNA, 21 nt, Artificial Sequence
  Ebola virus siRNA sense strand
gaaggucaucaaauaaucuca

SEQ ID NO: 17917 - RNA, 21 nt, Artificial Sequence
  Ebola virus siRNA sense strand
aaggucaucaaauaaucucac

SEQ ID NO: 17918 - RNA, 21 nt, Artificial Sequence
  Ebola virus siRNA sense strand
aggucaucaaauaaucucaca

SEQ ID NO: 17919 - RNA, 21 nt, Artificial Sequence
  Ebola virus siRNA sense strand
ggucaucaaauaaucucacac

SEQ ID NO: 17920 - RNA, 21 nt, Artificial Sequence
  Ebola virus siRNA sense strand
gucaucaaauaaucucacacc

SEQ ID NO: 17921 - RNA, 21 nt, Artificial Sequence
  Ebola virus siRNA sense strand
ucaucaaauaaucucacaccg

SEQ ID NO: 17922 - RNA, 21 nt, Artificial Sequence
  Ebola virus siRNA sense strand
caucaaauaaucucacaccgu

SEQ ID NO: 17923 - RNA, 21 nt, Artificial Sequence
  Ebola virus siRNA sense strand
aucaaauaaucucacaccguc

SEQ ID NO: 17924 - RNA, 21 nt, Artificial Sequence
  Ebola virus siRNA sense strand
ucaaauaaucucacaccgucu

SEQ ID NO: 17925 - RNA, 21 nt, Artificial Sequence
  Ebola virus siRNA sense strand
caaauaaucucacaccgucua

SEQ ID NO: 17926 - RNA, 21 nt, Artificial Sequence
  Ebola virus siRNA sense strand
aaauaaucucacaccgucuag

SEQ ID NO: 17927 - RNA, 21 nt, Artificial Sequence
  Ebola virus siRNA sense strand
aauaaucucacaccgucuagu

SEQ ID NO: 17928 - RNA, 21 nt, Artificial Sequence
  Ebola virus siRNA sense strand
auaaucucacaccgucuaguc

SEQ ID NO: 17929 - RNA, 21 nt, Artificial Sequence
  Ebola virus siRNA sense strand
uaaucucacaccgucuagucc

SEQ ID NO: 17930 - RNA, 21 nt, Artificial Sequence
  Ebola virus siRNA sense strand
aaucucacaccgucuaguccu

SEQ ID NO: 17931 - RNA, 21 nt, Artificial Sequence
  Ebola virus siRNA sense strand
aucucacaccgucuaguccua

SEQ ID NO: 17932 - RNA, 21 nt, Artificial Sequence
  Ebola virus siRNA sense strand
ucucacaccgucuaguccuac

SEQ ID NO: 17933 - RNA, 21 nt, Artificial Sequence
  Ebola virus siRNA sense strand
cucacaccgucuaguccuacc

SEQ ID NO: 17934 - RNA, 21 nt, Artificial Sequence
  Ebola virus siRNA sense strand
ucacaccgucuaguccuaccu

SEQ ID NO: 17935 - RNA, 21 nt, Artificial Sequence
  Ebola virus siRNA sense strand
cacaccgucuaguccuaccuu

SEQ ID NO: 17936 - RNA, 21 nt, Artificial Sequence
  Ebola virus siRNA sense strand
acaccgucuaguccuaccuuu

SEQ ID NO: 17937 - RNA, 21 nt, Artificial Sequence
  Ebola virus siRNA sense strand
caccgucuaguccuaccuuuc

SEQ ID NO: 17938 - RNA, 21 nt, Artificial Sequence
  Ebola virus siRNA sense strand
accgucuaguccuaccuuucu

SEQ ID NO: 17939 - RNA, 21 nt, Artificial Sequence
  Ebola virus siRNA sense strand
ccgucuaguccuaccuuucuu

SEQ ID NO: 17940 - RNA, 21 nt, Artificial Sequence
  Ebola virus siRNA sense strand
cgucuaguccuaccuuucuuu

SEQ ID NO: 17941 - RNA, 21 nt, Artificial Sequence
  Ebola virus siRNA sense strand
gucuaguccuaccuuucuuua

SEQ ID NO: 17942 - RNA, 21 nt, Artificial Sequence
  Ebola virus siRNA sense strand
ucuaguccuaccuuucuuuac

SEQ ID NO: 17943 - RNA, 21 nt, Artificial Sequence
  Ebola virus siRNA sense strand
cuaguccuaccuuucuuuaca

SEQ ID NO: 17944 - RNA, 21 nt, Artificial Sequence
  Ebola virus siRNA sense strand
uaguccuaccuuucuuuacau

SEQ ID NO: 17945 - RNA, 21 nt, Artificial Sequence
  Ebola virus siRNA sense strand
aguccuaccuuucuuuacauu

SEQ ID NO: 17946 - RNA, 21 nt, Artificial Sequence
  Ebola virus siRNA sense strand
guccuaccuuucuuuacauua

SEQ ID NO: 17947 - RNA, 21 nt, Artificial Sequence
  Ebola virus siRNA sense strand
uccuaccuuucuuuacauuau

SEQ ID NO: 17948 - RNA, 21 nt, Artificial Sequence
  Ebola virus siRNA sense strand
ccuaccuuucuuuacauuauc

SEQ ID NO: 17949 - RNA, 21 nt, Artificial Sequence
  Ebola virus siRNA sense strand
cuaccuuucuuuacauuaucu

SEQ ID NO: 17950 - RNA, 21 nt, Artificial Sequence
  Ebola virus siRNA sense strand
uaccuuucuuuacauuaucuc

SEQ ID NO: 17951 - RNA, 21 nt, Artificial Sequence
  Ebola virus siRNA sense strand
accuuucuuuacauuaucuca

SEQ ID NO: 17952 - RNA, 21 nt, Artificial Sequence
  Ebola virus siRNA sense strand
ccuuucuuuacauuaucucaa

SEQ ID NO: 17953 - RNA, 21 nt, Artificial Sequence
  Ebola virus siRNA sense strand
cuuucuuuacauuaucucaag

SEQ ID NO: 17954 - RNA, 21 nt, Artificial Sequence
  Ebola virus siRNA sense strand
uuucuuuacauuaucucaagg

SEQ ID NO: 17955 - RNA, 21 nt, Artificial Sequence
  Ebola virus siRNA sense strand
uucuuuacauuaucucaaggg

SEQ ID NO: 17956 - RNA, 21 nt, Artificial Sequence
  Ebola virus siRNA sense strand
ucuuuacauuaucucaaggga

SEQ ID NO: 17957 - RNA, 21 nt, Artificial Sequence
  Ebola virus siRNA sense strand
cuuuacauuaucucaagggac

SEQ ID NO: 17958 - RNA, 21 nt, Artificial Sequence
  Ebola virus siRNA sense strand
uuuacauuaucucaagggaca

SEQ ID NO: 17959 - RNA, 21 nt, Artificial Sequence
  Ebola virus siRNA sense strand
uuacauuaucucaagggacac

SEQ ID NO: 17960 - RNA, 21 nt, Artificial Sequence
  Ebola virus siRNA sense strand
uacauuaucucaagggacacg

SEQ ID NO: 17961 - RNA, 21 nt, Artificial Sequence
  Ebola virus siRNA sense strand
acauuaucucaagggacacgc

SEQ ID NO: 17962 - RNA, 21 nt, Artificial Sequence
  Ebola virus siRNA sense strand
cauuaucucaagggacacgcc

SEQ ID NO: 17963 - RNA, 21 nt, Artificial Sequence
  Ebola virus siRNA sense strand
auuaucucaagggacacgcca

SEQ ID NO: 17964 - RNA, 21 nt, Artificial Sequence
  Ebola virus siRNA sense strand
uuaucucaagggacacgccaa

SEQ ID NO: 17965 - RNA, 21 nt, Artificial Sequence
  Ebola virus siRNA sense strand
uaucucaagggacacgccaau

SEQ ID NO: 17966 - RNA, 21 nt, Artificial Sequence
  Ebola virus siRNA sense strand
aucucaagggacacgccaauu

SEQ ID NO: 17967 - RNA, 21 nt, Artificial Sequence
  Ebola virus siRNA sense strand
ucucaagggacacgccaauua

SEQ ID NO: 17968 - RNA, 21 nt, Artificial Sequence
  Ebola virus siRNA sense strand
cucaagggacacgccaauuaa

SEQ ID NO: 17969 - RNA, 21 nt, Artificial Sequence
  Ebola virus siRNA sense strand
ucaagggacacgccaauuaac

SEQ ID NO: 17970 - RNA, 21 nt, Artificial Sequence
  Ebola virus siRNA sense strand
caagggacacgccaauuaacg

SEQ ID NO: 17971 - RNA, 21 nt, Artificial Sequence
  Ebola virus siRNA sense strand
aagggacacgccaauuaacgu

SEQ ID NO: 17972 - RNA, 21 nt, Artificial Sequence
  Ebola virus siRNA sense strand
agggacacgccaauuaacguc

SEQ ID NO: 17973 - RNA, 21 nt, Artificial Sequence
  Ebola virus siRNA sense strand
gggacacgccaauuaacguca

SEQ ID NO: 17974 - RNA, 21 nt, Artificial Sequence
  Ebola virus siRNA sense strand
ggacacgccaauuaacgucau

SEQ ID NO: 17975 - RNA, 21 nt, Artificial Sequence
  Ebola virus siRNA sense strand
gacacgccaauuaacgucauc

SEQ ID NO: 17976 - RNA, 21 nt, Artificial Sequence
  Ebola virus siRNA sense strand
acacgccaauuaacgucaucc

SEQ ID NO: 17977 - RNA, 21 nt, Artificial Sequence
  Ebola virus siRNA sense strand
cacgccaauuaacgucaucca

SEQ ID NO: 17978 - RNA, 21 nt, Artificial Sequence
  Ebola virus siRNA sense strand
acgccaauuaacgucauccaa

SEQ ID NO: 17979 - RNA, 21 nt, Artificial Sequence
  Ebola virus siRNA sense strand
cgccaauuaacgucauccaau

SEQ ID NO: 17980 - RNA, 21 nt, Artificial Sequence
  Ebola virus siRNA sense strand
gccaauuaacgucauccaaug

SEQ ID NO: 17981 - RNA, 21 nt, Artificial Sequence
  Ebola virus siRNA sense strand
ccaauuaacgucauccaauga

SEQ ID NO: 17982 - RNA, 21 nt, Artificial Sequence
  Ebola virus siRNA sense strand
caauuaacgucauccaaugag

SEQ ID NO: 17983 - RNA, 21 nt, Artificial Sequence
  Ebola virus siRNA sense strand
aauuaacgucauccaaugagu

SEQ ID NO: 17984 - RNA, 21 nt, Artificial Sequence
  Ebola virus siRNA sense strand
auuaacgucauccaaugaguc

SEQ ID NO: 17985 - RNA, 21 nt, Artificial Sequence
  Ebola virus siRNA sense strand
uuaacgucauccaaugaguca

SEQ ID NO: 17986 - RNA, 21 nt, Artificial Sequence
  Ebola virus siRNA sense strand
uaacgucauccaaugagucac

SEQ ID NO: 17987 - RNA, 21 nt, Artificial Sequence
  Ebola virus siRNA sense strand
aacgucauccaaugagucaca

SEQ ID NO: 17988 - RNA, 21 nt, Artificial Sequence
  Ebola virus siRNA sense strand
acgucauccaaugagucacaa

SEQ ID NO: 17989 - RNA, 21 nt, Artificial Sequence
  Ebola virus siRNA sense strand
cgucauccaaugagucacaaa

SEQ ID NO: 17990 - RNA, 21 nt, Artificial Sequence
  Ebola virus siRNA sense strand
gucauccaaugagucacaaac

SEQ ID NO: 17991 - RNA, 21 nt, Artificial Sequence
  Ebola virus siRNA sense strand
ucauccaaugagucacaaacc

SEQ ID NO: 17992 - RNA, 21 nt, Artificial Sequence
  Ebola virus siRNA sense strand
cauccaaugagucacaaaccc

SEQ ID NO: 17993 - RNA, 21 nt, Artificial Sequence
  Ebola virus siRNA sense strand
auccaaugagucacaaaccca

SEQ ID NO: 17994 - RNA, 21 nt, Artificial Sequence
  Ebola virus siRNA sense strand
uccaaugagucacaaacccaa

SEQ ID NO: 17995 - RNA, 21 nt, Artificial Sequence
  Ebola virus siRNA sense strand
ccaaugagucacaaacccaag

SEQ ID NO: 17996 - RNA, 21 nt, Artificial Sequence
  Ebola virus siRNA sense strand
caaugagucacaaacccaaga

SEQ ID NO: 17997 - RNA, 21 nt, Artificial Sequence
  Ebola virus siRNA sense strand
aaugagucacaaacccaagac

SEQ ID NO: 17998 - RNA, 21 nt, Artificial Sequence
  Ebola virus siRNA sense strand
augagucacaaacccaagacg

SEQ ID NO: 17999 - RNA, 21 nt, Artificial Sequence
  Ebola virus siRNA sense strand
ugagucacaaacccaagacga

SEQ ID NO: 18000 - RNA, 21 nt, Artificial Sequence
  Ebola virus siRNA sense strand
gagucacaaacccaagacgag

SEQ ID NO: 18001 - RNA, 21 nt, Artificial Sequence
  Ebola virus siRNA sense strand
agucacaaacccaagacgaga

SEQ ID NO: 18002 - RNA, 21 nt, Artificial Sequence
  Ebola virus siRNA sense strand
gucacaaacccaagacgagau

SEQ ID NO: 18003 - RNA, 21 nt, Artificial Sequence
  Ebola virus siRNA sense strand
ucacaaacccaagacgagaua

SEQ ID NO: 18004 - RNA, 21 nt, Artificial Sequence
  Ebola virus siRNA sense strand
cacaaacccaagacgagauau

SEQ ID NO: 18005 - RNA, 21 nt, Artificial Sequence
  Ebola virus siRNA sense strand
acaaacccaagacgagauauc

SEQ ID NO: 18006 - RNA, 21 nt, Artificial Sequence
  Ebola virus siRNA sense strand
caaacccaagacgagauauca

SEQ ID NO: 18007 - RNA, 21 nt, Artificial Sequence
  Ebola virus siRNA sense strand
aaacccaagacgagauaucaa

SEQ ID NO: 18008 - RNA, 21 nt, Artificial Sequence
  Ebola virus siRNA sense strand
aacccaagacgagauaucaaa

SEQ ID NO: 18009 - RNA, 21 nt, Artificial Sequence
  Ebola virus siRNA sense strand
acccaagacgagauaucaaag

SEQ ID NO: 18010 - RNA, 21 nt, Artificial Sequence
  Ebola virus siRNA sense strand
cccaagacgagauaucaaagu

SEQ ID NO: 18011 - RNA, 21 nt, Artificial Sequence
  Ebola virus siRNA sense strand
ccaagacgagauaucaaagua

SEQ ID NO: 18012 - RNA, 21 nt, Artificial Sequence
  Ebola virus siRNA sense strand
caagacgagauaucaaaguac

SEQ ID NO: 18013 - RNA, 21 nt, Artificial Sequence
  Ebola virus siRNA sense strand
aagacgagauaucaaaguacu

SEQ ID NO: 18014 - RNA, 21 nt, Artificial Sequence
  Ebola virus siRNA sense strand
agacgagauaucaaaguacuu

SEQ ID NO: 18015 - RNA, 21 nt, Artificial Sequence
  Ebola virus siRNA sense strand
gacgagauaucaaaguacuua

SEQ ID NO: 18016 - RNA, 21 nt, Artificial Sequence
  Ebola virus siRNA sense strand
acgagauaucaaaguacuuac

SEQ ID NO: 18017 - RNA, 21 nt, Artificial Sequence
  Ebola virus siRNA sense strand
cgagauaucaaaguacuuacg

SEQ ID NO: 18018 - RNA, 21 nt, Artificial Sequence
  Ebola virus siRNA sense strand
gagauaucaaaguacuuacgg

SEQ ID NO: 18019 - RNA, 21 nt, Artificial Sequence
  Ebola virus siRNA sense strand
agauaucaaaguacuuacggc

SEQ ID NO: 18020 - RNA, 21 nt, Artificial Sequence
  Ebola virus siRNA sense strand
gauaucaaaguacuuacggca

SEQ ID NO: 18021 - RNA, 21 nt, Artificial Sequence
  Ebola virus siRNA sense strand
auaucaaaguacuuacggcaa

SEQ ID NO: 18022 - RNA, 21 nt, Artificial Sequence
  Ebola virus siRNA sense strand
uaucaaaguacuuacggcaau

SEQ ID NO: 18023 - RNA, 21 nt, Artificial Sequence
  Ebola virus siRNA sense strand
aucaaaguacuuacggcaauu

SEQ ID NO: 18024 - RNA, 21 nt, Artificial Sequence
  Ebola virus siRNA sense strand
ucaaaguacuuacggcaauug

SEQ ID NO: 18025 - RNA, 21 nt, Artificial Sequence
  Ebola virus siRNA sense strand
caaaguacuuacggcaauuga

SEQ ID NO: 18026 - RNA, 21 nt, Artificial Sequence
  Ebola virus siRNA sense strand
aaaguacuuacggcaauugag

SEQ ID NO: 18027 - RNA, 21 nt, Artificial Sequence
  Ebola virus siRNA sense strand
aaguacuuacggcaauugaga

SEQ ID NO: 18028 - RNA, 21 nt, Artificial Sequence
  Ebola virus siRNA sense strand
aguacuuacggcaauugagau

SEQ ID NO: 18029 - RNA, 21 nt, Artificial Sequence
  Ebola virus siRNA sense strand
guacuuacggcaauugagauc

SEQ ID NO: 18030 - RNA, 21 nt, Artificial Sequence
  Ebola virus siRNA sense strand
uacuuacggcaauugagaucc

SEQ ID NO: 18031 - RNA, 21 nt, Artificial Sequence
  Ebola virus siRNA sense strand
acuuacggcaauugagauccg

SEQ ID NO: 18032 - RNA, 21 nt, Artificial Sequence
  Ebola virus siRNA sense strand
cuuacggcaauugagauccgu

SEQ ID NO: 18033 - RNA, 21 nt, Artificial Sequence
  Ebola virus siRNA sense strand
uuacggcaauugagauccguc

SEQ ID NO: 18034 - RNA, 21 nt, Artificial Sequence
  Ebola virus siRNA sense strand
uacggcaauugagauccguca

SEQ ID NO: 18035 - RNA, 21 nt, Artificial Sequence
  Ebola virus siRNA sense strand
acggcaauugagauccgucau

SEQ ID NO: 18036 - RNA, 21 nt, Artificial Sequence
  Ebola virus siRNA sense strand
cggcaauugagauccgucauu

SEQ ID NO: 18037 - RNA, 21 nt, Artificial Sequence
  Ebola virus siRNA sense strand
ggcaauugagauccgucauug

SEQ ID NO: 18038 - RNA, 21 nt, Artificial Sequence
  Ebola virus siRNA sense strand
gcaauugagauccgucauuga

SEQ ID NO: 18039 - RNA, 21 nt, Artificial Sequence
  Ebola virus siRNA sense strand
caauugagauccgucauugau

SEQ ID NO: 18040 - RNA, 21 nt, Artificial Sequence
  Ebola virus siRNA sense strand
aauugagauccgucauugaua

SEQ ID NO: 18041 - RNA, 21 nt, Artificial Sequence
  Ebola virus siRNA sense strand
auugagauccgucauugauac

SEQ ID NO: 18042 - RNA, 21 nt, Artificial Sequence
  Ebola virus siRNA sense strand
uugagauccgucauugauacc

SEQ ID NO: 18043 - RNA, 21 nt, Artificial Sequence
  Ebola virus siRNA sense strand
ugagauccgucauugauacca

SEQ ID NO: 18044 - RNA, 21 nt, Artificial Sequence
  Ebola virus siRNA sense strand
gagauccgucauugauaccac

SEQ ID NO: 18045 - RNA, 21 nt, Artificial Sequence
  Ebola virus siRNA sense strand
agauccgucauugauaccaca

SEQ ID NO: 18046 - RNA, 21 nt, Artificial Sequence
  Ebola virus siRNA sense strand
gauccgucauugauaccacag

SEQ ID NO: 18047 - RNA, 21 nt, Artificial Sequence
  Ebola virus siRNA sense strand
auccgucauugauaccacagu

SEQ ID NO: 18048 - RNA, 21 nt, Artificial Sequence
  Ebola virus siRNA sense strand
uccgucauugauaccacaguu

SEQ ID NO: 18049 - RNA, 21 nt, Artificial Sequence
  Ebola virus siRNA sense strand
ccgucauugauaccacaguuu

SEQ ID NO: 18050 - RNA, 21 nt, Artificial Sequence
  Ebola virus siRNA sense strand
cgucauugauaccacaguuua

SEQ ID NO: 18051 - RNA, 21 nt, Artificial Sequence
  Ebola virus siRNA sense strand
gucauugauaccacaguuuau

SEQ ID NO: 18052 - RNA, 21 nt, Artificial Sequence
  Ebola virus siRNA sense strand
ucauugauaccacaguuuauu

SEQ ID NO: 18053 - RNA, 21 nt, Artificial Sequence
  Ebola virus siRNA sense strand
cauugauaccacaguuuauug

SEQ ID NO: 18054 - RNA, 21 nt, Artificial Sequence
  Ebola virus siRNA sense strand
auugauaccacaguuuauugu

SEQ ID NO: 18055 - RNA, 21 nt, Artificial Sequence
  Ebola virus siRNA sense strand
uugauaccacaguuuauugua

SEQ ID NO: 18056 - RNA, 21 nt, Artificial Sequence
  Ebola virus siRNA sense strand
ugauaccacaguuuauuguag

SEQ ID NO: 18057 - RNA, 21 nt, Artificial Sequence
  Ebola virus siRNA sense strand
gauaccacaguuuauuguaga

SEQ ID NO: 18058 - RNA, 21 nt, Artificial Sequence
  Ebola virus siRNA sense strand
auaccacaguuuauuguagau

SEQ ID NO: 18059 - RNA, 21 nt, Artificial Sequence
  Ebola virus siRNA sense strand
uaccacaguuuauuguagauu

SEQ ID NO: 18060 - RNA, 21 nt, Artificial Sequence
  Ebola virus siRNA sense strand
accacaguuuauuguagauuu

SEQ ID NO: 18061 - RNA, 21 nt, Artificial Sequence
  Ebola virus siRNA sense strand
ccacaguuuauuguagauuua

SEQ ID NO: 18062 - RNA, 21 nt, Artificial Sequence
  Ebola virus siRNA sense strand
cacaguuuauuguagauuuac

SEQ ID NO: 18063 - RNA, 21 nt, Artificial Sequence
  Ebola virus siRNA sense strand
acaguuuauuguagauuuacc

SEQ ID NO: 18064 - RNA, 21 nt, Artificial Sequence
  Ebola virus siRNA sense strand
caguuuauuguagauuuaccg

SEQ ID NO: 18065 - RNA, 21 nt, Artificial Sequence
  Ebola virus siRNA sense strand
aguuuauuguagauuuaccgg

SEQ ID NO: 18066 - RNA, 21 nt, Artificial Sequence
  Ebola virus siRNA sense strand
guuuauuguagauuuaccggu

SEQ ID NO: 18067 - RNA, 21 nt, Artificial Sequence
  Ebola virus siRNA sense strand
uuuauuguagauuuaccggua

SEQ ID NO: 18068 - RNA, 21 nt, Artificial Sequence
  Ebola virus siRNA sense strand
uuauuguagauuuaccgguau

SEQ ID NO: 18069 - RNA, 21 nt, Artificial Sequence
  Ebola virus siRNA sense strand
uauuguagauuuaccgguaua

SEQ ID NO: 18070 - RNA, 21 nt, Artificial Sequence
  Ebola virus siRNA sense strand
auuguagauuuaccgguauag

SEQ ID NO: 18071 - RNA, 21 nt, Artificial Sequence
  Ebola virus siRNA sense strand
uuguagauuuaccgguauagu

SEQ ID NO: 18072 - RNA, 21 nt, Artificial Sequence
  Ebola virus siRNA sense strand
uguagauuuaccgguauaguc

SEQ ID NO: 18073 - RNA, 21 nt, Artificial Sequence
  Ebola virus siRNA sense strand
guagauuuaccgguauagucu

SEQ ID NO: 18074 - RNA, 21 nt, Artificial Sequence
  Ebola virus siRNA sense strand
uagauuuaccgguauagucuc

SEQ ID NO: 18075 - RNA, 21 nt, Artificial Sequence
  Ebola virus siRNA sense strand
agauuuaccgguauagucucg

SEQ ID NO: 18076 - RNA, 21 nt, Artificial Sequence
  Ebola virus siRNA sense strand
gauuuaccgguauagucucgu

SEQ ID NO: 18077 - RNA, 21 nt, Artificial Sequence
  Ebola virus siRNA sense strand
auuuaccgguauagucucguc

SEQ ID NO: 18078 - RNA, 21 nt, Artificial Sequence
  Ebola virus siRNA sense strand
uuuaccgguauagucucgucc

SEQ ID NO: 18079 - RNA, 21 nt, Artificial Sequence
  Ebola virus siRNA sense strand
uuaccgguauagucucgucca

SEQ ID NO: 18080 - RNA, 21 nt, Artificial Sequence
  Ebola virus siRNA sense strand
uaccgguauagucucguccau

SEQ ID NO: 18081 - RNA, 21 nt, Artificial Sequence
  Ebola virus siRNA sense strand
accgguauagucucguccaug

SEQ ID NO: 18082 - RNA, 21 nt, Artificial Sequence
  Ebola virus siRNA sense strand
ccgguauagucucguccaugc

SEQ ID NO: 18083 - RNA, 21 nt, Artificial Sequence
  Ebola virus siRNA sense strand
cgguauagucucguccaugca

SEQ ID NO: 18084 - RNA, 21 nt, Artificial Sequence
  Ebola virus siRNA sense strand
gguauagucucguccaugcau

SEQ ID NO: 18085 - RNA, 21 nt, Artificial Sequence
  Ebola virus siRNA sense strand
guauagucucguccaugcauu

SEQ ID NO: 18086 - RNA, 21 nt, Artificial Sequence
  Ebola virus siRNA sense strand
uauagucucguccaugcauua

SEQ ID NO: 18087 - RNA, 21 nt, Artificial Sequence
  Ebola virus siRNA sense strand
auagucucguccaugcauuac

SEQ ID NO: 18088 - RNA, 21 nt, Artificial Sequence
  Ebola virus siRNA sense strand
uagucucguccaugcauuaca

SEQ ID NO: 18089 - RNA, 21 nt, Artificial Sequence
  Ebola virus siRNA sense strand
agucucguccaugcauuacaa

SEQ ID NO: 18090 - RNA, 21 nt, Artificial Sequence
  Ebola virus siRNA sense strand
gucucguccaugcauuacaaa

SEQ ID NO: 18091 - RNA, 21 nt, Artificial Sequence
  Ebola virus siRNA sense strand
ucucguccaugcauuacaaac

SEQ ID NO: 18092 - RNA, 21 nt, Artificial Sequence
  Ebola virus siRNA sense strand
cucguccaugcauuacaaacu

SEQ ID NO: 18093 - RNA, 21 nt, Artificial Sequence
  Ebola virus siRNA sense strand
ucguccaugcauuacaaacuu

SEQ ID NO: 18094 - RNA, 21 nt, Artificial Sequence
  Ebola virus siRNA sense strand
cguccaugcauuacaaacuug

SEQ ID NO: 18095 - RNA, 21 nt, Artificial Sequence
  Ebola virus siRNA sense strand
guccaugcauuacaaacuuga

SEQ ID NO: 18096 - RNA, 21 nt, Artificial Sequence
  Ebola virus siRNA sense strand
uccaugcauuacaaacuugau

SEQ ID NO: 18097 - RNA, 21 nt, Artificial Sequence
  Ebola virus siRNA sense strand
ccaugcauuacaaacuugaug

SEQ ID NO: 18098 - RNA, 21 nt, Artificial Sequence
  Ebola virus siRNA sense strand
caugcauuacaaacuugauga

SEQ ID NO: 18099 - RNA, 21 nt, Artificial Sequence
  Ebola virus siRNA sense strand
augcauuacaaacuugaugag

SEQ ID NO: 18100 - RNA, 21 nt, Artificial Sequence
  Ebola virus siRNA sense strand
ugcauuacaaacuugaugagg

SEQ ID NO: 18101 - RNA, 21 nt, Artificial Sequence
  Ebola virus siRNA sense strand
gcauuacaaacuugaugaggu

SEQ ID NO: 18102 - RNA, 21 nt, Artificial Sequence
  Ebola virus siRNA sense strand
cauuacaaacuugaugagguc

SEQ ID NO: 18103 - RNA, 21 nt, Artificial Sequence
  Ebola virus siRNA sense strand
auuacaaacuugaugaggucc

SEQ ID NO: 18104 - RNA, 21 nt, Artificial Sequence
  Ebola virus siRNA sense strand
uuacaaacuugaugagguccu

SEQ ID NO: 18105 - RNA, 21 nt, Artificial Sequence
  Ebola virus siRNA sense strand
uacaaacuugaugagguccuu

SEQ ID NO: 18106 - RNA, 21 nt, Artificial Sequence
  Ebola virus siRNA sense strand
acaaacuugaugagguccuuu

SEQ ID NO: 18107 - RNA, 21 nt, Artificial Sequence
  Ebola virus siRNA sense strand
caaacuugaugagguccuuug

SEQ ID NO: 18108 - RNA, 21 nt, Artificial Sequence
  Ebola virus siRNA sense strand
aaacuugaugagguccuuugg

SEQ ID NO: 18109 - RNA, 21 nt, Artificial Sequence
  Ebola virus siRNA sense strand
aacuugaugagguccuuuggg

SEQ ID NO: 18110 - RNA, 21 nt, Artificial Sequence
  Ebola virus siRNA sense strand
acuugaugagguccuuuggga

SEQ ID NO: 18111 - RNA, 21 nt, Artificial Sequence
  Ebola virus siRNA sense strand
cuugaugagguccuuugggaa

SEQ ID NO: 18112 - RNA, 21 nt, Artificial Sequence
  Ebola virus siRNA sense strand
uugaugagguccuuugggaaa

SEQ ID NO: 18113 - RNA, 21 nt, Artificial Sequence
  Ebola virus siRNA sense strand
ugaugagguccuuugggaaau

SEQ ID NO: 18114 - RNA, 21 nt, Artificial Sequence
  Ebola virus siRNA sense strand
gaugagguccuuugggaaaua

SEQ ID NO: 18115 - RNA, 21 nt, Artificial Sequence
  Ebola virus siRNA sense strand
augagguccuuugggaaauag

SEQ ID NO: 18116 - RNA, 21 nt, Artificial Sequence
  Ebola virus siRNA sense strand
ugagguccuuugggaaauaga

SEQ ID NO: 18117 - RNA, 21 nt, Artificial Sequence
  Ebola virus siRNA sense strand
gagguccuuugggaaauagag

SEQ ID NO: 18118 - RNA, 21 nt, Artificial Sequence
  Ebola virus siRNA sense strand
agguccuuugggaaauagaga

SEQ ID NO: 18119 - RNA, 21 nt, Artificial Sequence
  Ebola virus siRNA sense strand
gguccuuugggaaauagagag

SEQ ID NO: 18120 - RNA, 21 nt, Artificial Sequence
  Ebola virus siRNA sense strand
guccuuugggaaauagagagu

SEQ ID NO: 18121 - RNA, 21 nt, Artificial Sequence
  Ebola virus siRNA sense strand
uccuuugggaaauagagaguu

SEQ ID NO: 18122 - RNA, 21 nt, Artificial Sequence
  Ebola virus siRNA sense strand
ccuuugggaaauagagaguuu

SEQ ID NO: 18123 - RNA, 21 nt, Artificial Sequence
  Ebola virus siRNA sense strand
cuuugggaaauagagaguuuc

SEQ ID NO: 18124 - RNA, 21 nt, Artificial Sequence
  Ebola virus siRNA sense strand
uuugggaaauagagaguuuca

SEQ ID NO: 18125 - RNA, 21 nt, Artificial Sequence
  Ebola virus siRNA sense strand
uugggaaauagagaguuucaa

SEQ ID NO: 18126 - RNA, 21 nt, Artificial Sequence
  Ebola virus siRNA sense strand
ugggaaauagagaguuucaag

SEQ ID NO: 18127 - RNA, 21 nt, Artificial Sequence
  Ebola virus siRNA sense strand
gggaaauagagaguuucaagu

SEQ ID NO: 18128 - RNA, 21 nt, Artificial Sequence
  Ebola virus siRNA sense strand
ggaaauagagaguuucaaguc

SEQ ID NO: 18129 - RNA, 21 nt, Artificial Sequence
  Ebola virus siRNA sense strand
gaaauagagaguuucaagucg

SEQ ID NO: 18130 - RNA, 21 nt, Artificial Sequence
  Ebola virus siRNA sense strand
aaauagagaguuucaagucgg

SEQ ID NO: 18131 - RNA, 21 nt, Artificial Sequence
  Ebola virus siRNA sense strand
aauagagaguuucaagucggc

SEQ ID NO: 18132 - RNA, 21 nt, Artificial Sequence
  Ebola virus siRNA sense strand
auagagaguuucaagucggcu

SEQ ID NO: 18133 - RNA, 21 nt, Artificial Sequence
  Ebola virus siRNA sense strand
uagagaguuucaagucggcug

SEQ ID NO: 18134 - RNA, 21 nt, Artificial Sequence
  Ebola virus siRNA sense strand
agagaguuucaagucggcugu

SEQ ID NO: 18135 - RNA, 21 nt, Artificial Sequence
  Ebola virus siRNA sense strand
gagaguuucaagucggcugug

SEQ ID NO: 18136 - RNA, 21 nt, Artificial Sequence
  Ebola virus siRNA sense strand
agaguuucaagucggcuguga

SEQ ID NO: 18137 - RNA, 21 nt, Artificial Sequence
  Ebola virus siRNA sense strand
gaguuucaagucggcugugac

SEQ ID NO: 18138 - RNA, 21 nt, Artificial Sequence
  Ebola virus siRNA sense strand
aguuucaagucggcugugacg

SEQ ID NO: 18139 - RNA, 21 nt, Artificial Sequence
  Ebola virus siRNA sense strand
guuucaagucggcugugacgc

SEQ ID NO: 18140 - RNA, 21 nt, Artificial Sequence
  Ebola virus siRNA sense strand
uuucaagucggcugugacgcu

SEQ ID NO: 18141 - RNA, 21 nt, Artificial Sequence
  Ebola virus siRNA sense strand
uucaagucggcugugacgcua

SEQ ID NO: 18142 - RNA, 21 nt, Artificial Sequence
  Ebola virus siRNA sense strand
ucaagucggcugugacgcuag

SEQ ID NO: 18143 - RNA, 21 nt, Artificial Sequence
  Ebola virus siRNA sense strand
caagucggcugugacgcuagc

SEQ ID NO: 18144 - RNA, 21 nt, Artificial Sequence
  Ebola virus siRNA sense strand
aagucggcugugacgcuagca

SEQ ID NO: 18145 - RNA, 21 nt, Artificial Sequence
  Ebola virus siRNA sense strand
agucggcugugacgcuagcag

SEQ ID NO: 18146 - RNA, 21 nt, Artificial Sequence
  Ebola virus siRNA sense strand
gucggcugugacgcuagcaga

SEQ ID NO: 18147 - RNA, 21 nt, Artificial Sequence
  Ebola virus siRNA sense strand
ucggcugugacgcuagcagag

SEQ ID NO: 18148 - RNA, 21 nt, Artificial Sequence
  Ebola virus siRNA sense strand
cggcugugacgcuagcagagg

SEQ ID NO: 18149 - RNA, 21 nt, Artificial Sequence
  Ebola virus siRNA sense strand
ggcugugacgcuagcagaggg

SEQ ID NO: 18150 - RNA, 21 nt, Artificial Sequence
  Ebola virus siRNA sense strand
gcugugacgcuagcagaggga

SEQ ID NO: 18151 - RNA, 21 nt, Artificial Sequence
  Ebola virus siRNA sense strand
cugugacgcuagcagagggag

SEQ ID NO: 18152 - RNA, 21 nt, Artificial Sequence
  Ebola virus siRNA sense strand
ugugacgcuagcagagggaga

SEQ ID NO: 18153 - RNA, 21 nt, Artificial Sequence
  Ebola virus siRNA sense strand
gugacgcuagcagagggagaa

SEQ ID NO: 18154 - RNA, 21 nt, Artificial Sequence
  Ebola virus siRNA sense strand
ugacgcuagcagagggagaag

SEQ ID NO: 18155 - RNA, 21 nt, Artificial Sequence
  Ebola virus siRNA sense strand
gacgcuagcagagggagaagg

SEQ ID NO: 18156 - RNA, 21 nt, Artificial Sequence
  Ebola virus siRNA sense strand
acgcuagcagagggagaaggu

SEQ ID NO: 18157 - RNA, 21 nt, Artificial Sequence
  Ebola virus siRNA sense strand
cgcuagcagagggagaaggug

SEQ ID NO: 18158 - RNA, 21 nt, Artificial Sequence
  Ebola virus siRNA sense strand
gcuagcagagggagaaggugc

SEQ ID NO: 18159 - RNA, 21 nt, Artificial Sequence
  Ebola virus siRNA sense strand
cuagcagagggagaaggugcu

SEQ ID NO: 18160 - RNA, 21 nt, Artificial Sequence
  Ebola virus siRNA sense strand
uagcagagggagaaggugcug

SEQ ID NO: 18161 - RNA, 21 nt, Artificial Sequence
  Ebola virus siRNA sense strand
agcagagggagaaggugcugg

SEQ ID NO: 18162 - RNA, 21 nt, Artificial Sequence
  Ebola virus siRNA sense strand
gcagagggagaaggugcuggu

SEQ ID NO: 18163 - RNA, 21 nt, Artificial Sequence
  Ebola virus siRNA sense strand
cagagggagaaggugcuggug

SEQ ID NO: 18164 - RNA, 21 nt, Artificial Sequence
  Ebola virus siRNA sense strand
agagggagaaggugcuggugc

SEQ ID NO: 18165 - RNA, 21 nt, Artificial Sequence
  Ebola virus siRNA sense strand
gagggagaaggugcuggugcc

SEQ ID NO: 18166 - RNA, 21 nt, Artificial Sequence
  Ebola virus siRNA sense strand
agggagaaggugcuggugccu

SEQ ID NO: 18167 - RNA, 21 nt, Artificial Sequence
  Ebola virus siRNA sense strand
gggagaaggugcuggugccuu

SEQ ID NO: 18168 - RNA, 21 nt, Artificial Sequence
  Ebola virus siRNA sense strand
ggagaaggugcuggugccuua

SEQ ID NO: 18169 - RNA, 21 nt, Artificial Sequence
  Ebola virus siRNA sense strand
gagaaggugcuggugccuuac

SEQ ID NO: 18170 - RNA, 21 nt, Artificial Sequence
  Ebola virus siRNA sense strand
agaaggugcuggugccuuacu

SEQ ID NO: 18171 - RNA, 21 nt, Artificial Sequence
  Ebola virus siRNA sense strand
gaaggugcuggugccuuacua

SEQ ID NO: 18172 - RNA, 21 nt, Artificial Sequence
  Ebola virus siRNA sense strand
aaggugcuggugccuuacuau

SEQ ID NO: 18173 - RNA, 21 nt, Artificial Sequence
  Ebola virus siRNA sense strand
aggugcuggugccuuacuauu

SEQ ID NO: 18174 - RNA, 21 nt, Artificial Sequence
  Ebola virus siRNA sense strand
ggugcuggugccuuacuauug

SEQ ID NO: 18175 - RNA, 21 nt, Artificial Sequence
  Ebola virus siRNA sense strand
gugcuggugccuuacuauuga

SEQ ID NO: 18176 - RNA, 21 nt, Artificial Sequence
  Ebola virus siRNA sense strand
ugcuggugccuuacuauugau

SEQ ID NO: 18177 - RNA, 21 nt, Artificial Sequence
  Ebola virus siRNA sense strand
gcuggugccuuacuauugauu

SEQ ID NO: 18178 - RNA, 21 nt, Artificial Sequence
  Ebola virus siRNA sense strand
cuggugccuuacuauugauuc

SEQ ID NO: 18179 - RNA, 21 nt, Artificial Sequence
  Ebola virus siRNA sense strand
uggugccuuacuauugauuca

SEQ ID NO: 18180 - RNA, 21 nt, Artificial Sequence
  Ebola virus siRNA sense strand
ggugccuuacuauugauucag

SEQ ID NO: 18181 - RNA, 21 nt, Artificial Sequence
  Ebola virus siRNA sense strand
gugccuuacuauugauucaga

SEQ ID NO: 18182 - RNA, 21 nt, Artificial Sequence
  Ebola virus siRNA sense strand
ugccuuacuauugauucagaa

SEQ ID NO: 18183 - RNA, 21 nt, Artificial Sequence
  Ebola virus siRNA sense strand
gccuuacuauugauucagaaa

SEQ ID NO: 18184 - RNA, 21 nt, Artificial Sequence
  Ebola virus siRNA sense strand
ccuuacuauugauucagaaau

SEQ ID NO: 18185 - RNA, 21 nt, Artificial Sequence
  Ebola virus siRNA sense strand
cuuacuauugauucagaaaua

SEQ ID NO: 18186 - RNA, 21 nt, Artificial Sequence
  Ebola virus siRNA sense strand
uuacuauugauucagaaauac

SEQ ID NO: 18187 - RNA, 21 nt, Artificial Sequence
  Ebola virus siRNA sense strand
uacuauugauucagaaauacc

SEQ ID NO: 18188 - RNA, 21 nt, Artificial Sequence
  Ebola virus siRNA sense strand
acuauugauucagaaauacca

SEQ ID NO: 18189 - RNA, 21 nt, Artificial Sequence
  Ebola virus siRNA sense strand
cuauugauucagaaauaccaa

SEQ ID NO: 18190 - RNA, 21 nt, Artificial Sequence
  Ebola virus siRNA sense strand
uauugauucagaaauaccaag

SEQ ID NO: 18191 - RNA, 21 nt, Artificial Sequence
  Ebola virus siRNA sense strand
auugauucagaaauaccaagu

SEQ ID NO: 18192 - RNA, 21 nt, Artificial Sequence
  Ebola virus siRNA sense strand
uugauucagaaauaccaaguu

SEQ ID NO: 18193 - RNA, 21 nt, Artificial Sequence
  Ebola virus siRNA sense strand
ugauucagaaauaccaaguua

SEQ ID NO: 18194 - RNA, 21 nt, Artificial Sequence
  Ebola virus siRNA sense strand
gauucagaaauaccaaguuaa

SEQ ID NO: 18195 - RNA, 21 nt, Artificial Sequence
  Ebola virus siRNA sense strand
auucagaaauaccaaguuaag

SEQ ID NO: 18196 - RNA, 21 nt, Artificial Sequence
  Ebola virus siRNA sense strand
uucagaaauaccaaguuaaga

SEQ ID NO: 18197 - RNA, 21 nt, Artificial Sequence
  Ebola virus siRNA sense strand
ucagaaauaccaaguuaagac

SEQ ID NO: 18198 - RNA, 21 nt, Artificial Sequence
  Ebola virus siRNA sense strand
cagaaauaccaaguuaagacc

SEQ ID NO: 18199 - RNA, 21 nt, Artificial Sequence
  Ebola virus siRNA sense strand
agaaauaccaaguuaagaccu

SEQ ID NO: 18200 - RNA, 21 nt, Artificial Sequence
  Ebola virus siRNA sense strand
gaaauaccaaguuaagaccuu

SEQ ID NO: 18201 - RNA, 21 nt, Artificial Sequence
  Ebola virus siRNA sense strand
aaauaccaaguuaagaccuua

SEQ ID NO: 18202 - RNA, 21 nt, Artificial Sequence
  Ebola virus siRNA sense strand
aauaccaaguuaagaccuuau

SEQ ID NO: 18203 - RNA, 21 nt, Artificial Sequence
  Ebola virus siRNA sense strand
auaccaaguuaagaccuuauu

SEQ ID NO: 18204 - RNA, 21 nt, Artificial Sequence
  Ebola virus siRNA sense strand
uaccaaguuaagaccuuauuu

SEQ ID NO: 18205 - RNA, 21 nt, Artificial Sequence
  Ebola virus siRNA sense strand
accaaguuaagaccuuauuuu

SEQ ID NO: 18206 - RNA, 21 nt, Artificial Sequence
  Ebola virus siRNA sense strand
ccaaguuaagaccuuauuuuu

SEQ ID NO: 18207 - RNA, 21 nt, Artificial Sequence
  Ebola virus siRNA sense strand
caaguuaagaccuuauuuuuc

SEQ ID NO: 18208 - RNA, 21 nt, Artificial Sequence
  Ebola virus siRNA sense strand
aaguuaagaccuuauuuuuca

SEQ ID NO: 18209 - RNA, 21 nt, Artificial Sequence
  Ebola virus siRNA sense strand
aguuaagaccuuauuuuucaa

SEQ ID NO: 18210 - RNA, 21 nt, Artificial Sequence
  Ebola virus siRNA sense strand
guuaagaccuuauuuuucaac

SEQ ID NO: 18211 - RNA, 21 nt, Artificial Sequence
  Ebola virus siRNA sense strand
uuaagaccuuauuuuucaaca

SEQ ID NO: 18212 - RNA, 21 nt, Artificial Sequence
  Ebola virus siRNA sense strand
uaagaccuuauuuuucaacac

SEQ ID NO: 18213 - RNA, 21 nt, Artificial Sequence
  Ebola virus siRNA sense strand
aagaccuuauuuuucaacacg

SEQ ID NO: 18214 - RNA, 21 nt, Artificial Sequence
  Ebola virus siRNA sense strand
agaccuuauuuuucaacacgc

SEQ ID NO: 18215 - RNA, 21 nt, Artificial Sequence
  Ebola virus siRNA sense strand
gaccuuauuuuucaacacgcu

SEQ ID NO: 18216 - RNA, 21 nt, Artificial Sequence
  Ebola virus siRNA sense strand
accuuauuuuucaacacgcua

SEQ ID NO: 18217 - RNA, 21 nt, Artificial Sequence
  Ebola virus siRNA sense strand
ccuuauuuuucaacacgcuag

SEQ ID NO: 18218 - RNA, 21 nt, Artificial Sequence
  Ebola virus siRNA sense strand
cuuauuuuucaacacgcuagc

SEQ ID NO: 18219 - RNA, 21 nt, Artificial Sequence
  Ebola virus siRNA sense strand
uuauuuuucaacacgcuagcu

SEQ ID NO: 18220 - RNA, 21 nt, Artificial Sequence
  Ebola virus siRNA sense strand
uauuuuucaacacgcuagcua

SEQ ID NO: 18221 - RNA, 21 nt, Artificial Sequence
  Ebola virus siRNA sense strand
auuuuucaacacgcuagcuac

SEQ ID NO: 18222 - RNA, 21 nt, Artificial Sequence
  Ebola virus siRNA sense strand
uuuuucaacacgcuagcuacu

SEQ ID NO: 18223 - RNA, 21 nt, Artificial Sequence
  Ebola virus siRNA sense strand
uuuucaacacgcuagcuacug

SEQ ID NO: 18224 - RNA, 21 nt, Artificial Sequence
  Ebola virus siRNA sense strand
uuucaacacgcuagcuacuga

SEQ ID NO: 18225 - RNA, 21 nt, Artificial Sequence
  Ebola virus siRNA sense strand
uucaacacgcuagcuacugag

SEQ ID NO: 18226 - RNA, 21 nt, Artificial Sequence
  Ebola virus siRNA sense strand
ucaacacgcuagcuacugagu

SEQ ID NO: 18227 - RNA, 21 nt, Artificial Sequence
  Ebola virus siRNA sense strand
caacacgcuagcuacugaguc

SEQ ID NO: 18228 - RNA, 21 nt, Artificial Sequence
  Ebola virus siRNA sense strand
aacacgcuagcuacugagucc

SEQ ID NO: 18229 - RNA, 21 nt, Artificial Sequence
  Ebola virus siRNA sense strand
acacgcuagcuacugagucca

SEQ ID NO: 18230 - RNA, 21 nt, Artificial Sequence
  Ebola virus siRNA sense strand
cacgcuagcuacugaguccag

SEQ ID NO: 18231 - RNA, 21 nt, Artificial Sequence
  Ebola virus siRNA sense strand
acgcuagcuacugaguccagu

SEQ ID NO: 18232 - RNA, 21 nt, Artificial Sequence
  Ebola virus siRNA sense strand
cgcuagcuacugaguccagua

SEQ ID NO: 18233 - RNA, 21 nt, Artificial Sequence
  Ebola virus siRNA sense strand
gcuagcuacugaguccaguau

SEQ ID NO: 18234 - RNA, 21 nt, Artificial Sequence
  Ebola virus siRNA sense strand
cuagcuacugaguccaguaua

SEQ ID NO: 18235 - RNA, 21 nt, Artificial Sequence
  Ebola virus siRNA sense strand
uagcuacugaguccaguauag

SEQ ID NO: 18236 - RNA, 21 nt, Artificial Sequence
  Ebola virus siRNA sense strand
agcuacugaguccaguauaga

SEQ ID NO: 18237 - RNA, 21 nt, Artificial Sequence
  Ebola virus siRNA sense strand
gcuacugaguccaguauagag

SEQ ID NO: 18238 - RNA, 21 nt, Artificial Sequence
  Ebola virus siRNA sense strand
cuacugaguccaguauagagu

SEQ ID NO: 18239 - RNA, 21 nt, Artificial Sequence
  Ebola virus siRNA sense strand
uacugaguccaguauagaguc

SEQ ID NO: 18240 - RNA, 21 nt, Artificial Sequence
  Ebola virus siRNA sense strand
acugaguccaguauagaguca

SEQ ID NO: 18241 - RNA, 21 nt, Artificial Sequence
  Ebola virus siRNA sense strand
cugaguccaguauagagucag

SEQ ID NO: 18242 - RNA, 21 nt, Artificial Sequence
  Ebola virus siRNA sense strand
ugaguccaguauagagucaga

SEQ ID NO: 18243 - RNA, 21 nt, Artificial Sequence
  Ebola virus siRNA sense strand
gaguccaguauagagucagaa

SEQ ID NO: 18244 - RNA, 21 nt, Artificial Sequence
  Ebola virus siRNA sense strand
aguccaguauagagucagaaa

SEQ ID NO: 18245 - RNA, 21 nt, Artificial Sequence
  Ebola virus siRNA sense strand
guccaguauagagucagaaau

SEQ ID NO: 18246 - RNA, 21 nt, Artificial Sequence
  Ebola virus siRNA sense strand
uccaguauagagucagaaaua

SEQ ID NO: 18247 - RNA, 21 nt, Artificial Sequence
  Ebola virus siRNA sense strand
ccaguauagagucagaaauag

SEQ ID NO: 18248 - RNA, 21 nt, Artificial Sequence
  Ebola virus siRNA sense strand
caguauagagucagaaauagu

SEQ ID NO: 18249 - RNA, 21 nt, Artificial Sequence
  Ebola virus siRNA sense strand
aguauagagucagaaauagua

SEQ ID NO: 18250 - RNA, 21 nt, Artificial Sequence
  Ebola virus siRNA sense strand
guauagagucagaaauaguau

SEQ ID NO: 18251 - RNA, 21 nt, Artificial Sequence
  Ebola virus siRNA sense strand
uauagagucagaaauaguauc

SEQ ID NO: 18252 - RNA, 21 nt, Artificial Sequence
  Ebola virus siRNA sense strand
auagagucagaaauaguauca

SEQ ID NO: 18253 - RNA, 21 nt, Artificial Sequence
  Ebola virus siRNA sense strand
uagagucagaaauaguaucag

SEQ ID NO: 18254 - RNA, 21 nt, Artificial Sequence
  Ebola virus siRNA sense strand
agagucagaaauaguaucagg

SEQ ID NO: 18255 - RNA, 21 nt, Artificial Sequence
  Ebola virus siRNA sense strand
gagucagaaauaguaucagga

SEQ ID NO: 18256 - RNA, 21 nt, Artificial Sequence
  Ebola virus siRNA sense strand
agucagaaauaguaucaggaa

SEQ ID NO: 18257 - RNA, 21 nt, Artificial Sequence
  Ebola virus siRNA sense strand
gucagaaauaguaucaggaau

SEQ ID NO: 18258 - RNA, 21 nt, Artificial Sequence
  Ebola virus siRNA sense strand
ucagaaauaguaucaggaaug

SEQ ID NO: 18259 - RNA, 21 nt, Artificial Sequence
  Ebola virus siRNA sense strand
cagaaauaguaucaggaauga

SEQ ID NO: 18260 - RNA, 21 nt, Artificial Sequence
  Ebola virus siRNA sense strand
agaaauaguaucaggaaugac

SEQ ID NO: 18261 - RNA, 21 nt, Artificial Sequence
  Ebola virus siRNA sense strand
gaaauaguaucaggaaugacu

SEQ ID NO: 18262 - RNA, 21 nt, Artificial Sequence
  Ebola virus siRNA sense strand
aaauaguaucaggaaugacua

SEQ ID NO: 18263 - RNA, 21 nt, Artificial Sequence
  Ebola virus siRNA sense strand
aauaguaucaggaaugacuac

SEQ ID NO: 18264 - RNA, 21 nt, Artificial Sequence
  Ebola virus siRNA sense strand
auaguaucaggaaugacuacu

SEQ ID NO: 18265 - RNA, 21 nt, Artificial Sequence
  Ebola virus siRNA sense strand
uaguaucaggaaugacuacuc

SEQ ID NO: 18266 - RNA, 21 nt, Artificial Sequence
  Ebola virus siRNA sense strand
aguaucaggaaugacuacucc

SEQ ID NO: 18267 - RNA, 21 nt, Artificial Sequence
  Ebola virus siRNA sense strand
guaucaggaaugacuacuccu

SEQ ID NO: 18268 - RNA, 21 nt, Artificial Sequence
  Ebola virus siRNA sense strand
uaucaggaaugacuacuccua

SEQ ID NO: 18269 - RNA, 21 nt, Artificial Sequence
  Ebola virus siRNA sense strand
aucaggaaugacuacuccuag

SEQ ID NO: 18270 - RNA, 21 nt, Artificial Sequence
  Ebola virus siRNA sense strand
ucaggaaugacuacuccuagg

SEQ ID NO: 18271 - RNA, 21 nt, Artificial Sequence
  Ebola virus siRNA sense strand
caggaaugacuacuccuagga

SEQ ID NO: 18272 - RNA, 21 nt, Artificial Sequence
  Ebola virus siRNA sense strand
aggaaugacuacuccuaggau

SEQ ID NO: 18273 - RNA, 21 nt, Artificial Sequence
  Ebola virus siRNA sense strand
ggaaugacuacuccuaggaug

SEQ ID NO: 18274 - RNA, 21 nt, Artificial Sequence
  Ebola virus siRNA sense strand
gaaugacuacuccuaggaugc

SEQ ID NO: 18275 - RNA, 21 nt, Artificial Sequence
  Ebola virus siRNA sense strand
aaugacuacuccuaggaugcu

SEQ ID NO: 18276 - RNA, 21 nt, Artificial Sequence
  Ebola virus siRNA sense strand
augacuacuccuaggaugcuu

SEQ ID NO: 18277 - RNA, 21 nt, Artificial Sequence
  Ebola virus siRNA sense strand
ugacuacuccuaggaugcuuc

SEQ ID NO: 18278 - RNA, 21 nt, Artificial Sequence
  Ebola virus siRNA sense strand
gacuacuccuaggaugcuucu

SEQ ID NO: 18279 - RNA, 21 nt, Artificial Sequence
  Ebola virus siRNA sense strand
acuacuccuaggaugcuucua

SEQ ID NO: 18280 - RNA, 21 nt, Artificial Sequence
  Ebola virus siRNA sense strand
cuacuccuaggaugcuucuac

SEQ ID NO: 18281 - RNA, 21 nt, Artificial Sequence
  Ebola virus siRNA sense strand
uacuccuaggaugcuucuacc

SEQ ID NO: 18282 - RNA, 21 nt, Artificial Sequence
  Ebola virus siRNA sense strand
acuccuaggaugcuucuaccu

SEQ ID NO: 18283 - RNA, 21 nt, Artificial Sequence
  Ebola virus siRNA sense strand
cuccuaggaugcuucuaccug

SEQ ID NO: 18284 - RNA, 21 nt, Artificial Sequence
  Ebola virus siRNA sense strand
uccuaggaugcuucuaccugu

SEQ ID NO: 18285 - RNA, 21 nt, Artificial Sequence
  Ebola virus siRNA sense strand
ccuaggaugcuucuaccuguu

SEQ ID NO: 18286 - RNA, 21 nt, Artificial Sequence
  Ebola virus siRNA sense strand
cuaggaugcuucuaccuguua

SEQ ID NO: 18287 - RNA, 21 nt, Artificial Sequence
  Ebola virus siRNA sense strand
uaggaugcuucuaccuguuau

SEQ ID NO: 18288 - RNA, 21 nt, Artificial Sequence
  Ebola virus siRNA sense strand
aggaugcuucuaccuguuaug

SEQ ID NO: 18289 - RNA, 21 nt, Artificial Sequence
  Ebola virus siRNA sense strand
ggaugcuucuaccuguuaugu

SEQ ID NO: 18290 - RNA, 21 nt, Artificial Sequence
  Ebola virus siRNA sense strand
gaugcuucuaccuguuauguc

SEQ ID NO: 18291 - RNA, 21 nt, Artificial Sequence
  Ebola virus siRNA sense strand
augcuucuaccuguuauguca

SEQ ID NO: 18292 - RNA, 21 nt, Artificial Sequence
  Ebola virus siRNA sense strand
ugcuucuaccuguuaugucaa

SEQ ID NO: 18293 - RNA, 21 nt, Artificial Sequence
  Ebola virus siRNA sense strand
gcuucuaccuguuaugucaaa

SEQ ID NO: 18294 - RNA, 21 nt, Artificial Sequence
  Ebola virus siRNA sense strand
cuucuaccuguuaugucaaaa

SEQ ID NO: 18295 - RNA, 21 nt, Artificial Sequence
  Ebola virus siRNA sense strand
uucuaccuguuaugucaaaau

SEQ ID NO: 18296 - RNA, 21 nt, Artificial Sequence
  Ebola virus siRNA sense strand
ucuaccuguuaugucaaaauu

SEQ ID NO: 18297 - RNA, 21 nt, Artificial Sequence
  Ebola virus siRNA sense strand
cuaccuguuaugucaaaauuc

SEQ ID NO: 18298 - RNA, 21 nt, Artificial Sequence
  Ebola virus siRNA sense strand
uaccuguuaugucaaaauucc

SEQ ID NO: 18299 - RNA, 21 nt, Artificial Sequence
  Ebola virus siRNA sense strand
accuguuaugucaaaauucca

SEQ ID NO: 18300 - RNA, 21 nt, Artificial Sequence
  Ebola virus siRNA sense strand
ccuguuaugucaaaauuccau

SEQ ID NO: 18301 - RNA, 21 nt, Artificial Sequence
  Ebola virus siRNA sense strand
cuguuaugucaaaauuccaua

SEQ ID NO: 18302 - RNA, 21 nt, Artificial Sequence
  Ebola virus siRNA sense strand
uguuaugucaaaauuccauaa

SEQ ID NO: 18303 - RNA, 21 nt, Artificial Sequence
  Ebola virus siRNA sense strand
guuaugucaaaauuccauaau

SEQ ID NO: 18304 - RNA, 21 nt, Artificial Sequence
  Ebola virus siRNA sense strand
uuaugucaaaauuccauaaug

SEQ ID NO: 18305 - RNA, 21 nt, Artificial Sequence
  Ebola virus siRNA sense strand
uaugucaaaauuccauaauga

SEQ ID NO: 18306 - RNA, 21 nt, Artificial Sequence
  Ebola virus siRNA sense strand
augucaaaauuccauaaugac

SEQ ID NO: 18307 - RNA, 21 nt, Artificial Sequence
  Ebola virus siRNA sense strand
ugucaaaauuccauaaugacc

SEQ ID NO: 18308 - RNA, 21 nt, Artificial Sequence
  Ebola virus siRNA sense strand
gucaaaauuccauaaugacca

SEQ ID NO: 18309 - RNA, 21 nt, Artificial Sequence
  Ebola virus siRNA sense strand
ucaaaauuccauaaugaccaa

SEQ ID NO: 18310 - RNA, 21 nt, Artificial Sequence
  Ebola virus siRNA sense strand
caaaauuccauaaugaccaaa

SEQ ID NO: 18311 - RNA, 21 nt, Artificial Sequence
  Ebola virus siRNA sense strand
aaaauuccauaaugaccaaau

SEQ ID NO: 18312 - RNA, 21 nt, Artificial Sequence
  Ebola virus siRNA sense strand
aaauuccauaaugaccaaauu

SEQ ID NO: 18313 - RNA, 21 nt, Artificial Sequence
  Ebola virus siRNA sense strand
aauuccauaaugaccaaauug

SEQ ID NO: 18314 - RNA, 21 nt, Artificial Sequence
  Ebola virus siRNA sense strand
auuccauaaugaccaaauuga

SEQ ID NO: 18315 - RNA, 21 nt, Artificial Sequence
  Ebola virus siRNA sense strand
uuccauaaugaccaaauugag

SEQ ID NO: 18316 - RNA, 21 nt, Artificial Sequence
  Ebola virus siRNA sense strand
uccauaaugaccaaauugaga

SEQ ID NO: 18317 - RNA, 21 nt, Artificial Sequence
  Ebola virus siRNA sense strand
ccauaaugaccaaauugagau

SEQ ID NO: 18318 - RNA, 21 nt, Artificial Sequence
  Ebola virus siRNA sense strand
cauaaugaccaaauugagauu

SEQ ID NO: 18319 - RNA, 21 nt, Artificial Sequence
  Ebola virus siRNA sense strand
auaaugaccaaauugagauua

SEQ ID NO: 18320 - RNA, 21 nt, Artificial Sequence
  Ebola virus siRNA sense strand
uaaugaccaaauugagauuau

SEQ ID NO: 18321 - RNA, 21 nt, Artificial Sequence
  Ebola virus siRNA sense strand
aaugaccaaauugagauuauu

SEQ ID NO: 18322 - RNA, 21 nt, Artificial Sequence
  Ebola virus siRNA sense strand
augaccaaauugagauuauuc

SEQ ID NO: 18323 - RNA, 21 nt, Artificial Sequence
  Ebola virus siRNA sense strand
ugaccaaauugagauuauucu

SEQ ID NO: 18324 - RNA, 21 nt, Artificial Sequence
  Ebola virus siRNA sense strand
gaccaaauugagauuauucuu

SEQ ID NO: 18325 - RNA, 21 nt, Artificial Sequence
  Ebola virus siRNA sense strand
accaaauugagauuauucuua

SEQ ID NO: 18326 - RNA, 21 nt, Artificial Sequence
  Ebola virus siRNA sense strand
ccaaauugagauuauucuuaa

SEQ ID NO: 18327 - RNA, 21 nt, Artificial Sequence
  Ebola virus siRNA sense strand
caaauugagauuauucuuaac

SEQ ID NO: 18328 - RNA, 21 nt, Artificial Sequence
  Ebola virus siRNA sense strand
aaauugagauuauucuuaaca

SEQ ID NO: 18329 - RNA, 21 nt, Artificial Sequence
  Ebola virus siRNA sense strand
aauugagauuauucuuaacaa

SEQ ID NO: 18330 - RNA, 21 nt, Artificial Sequence
  Ebola virus siRNA sense strand
auugagauuauucuuaacaac

SEQ ID NO: 18331 - RNA, 21 nt, Artificial Sequence
  Ebola virus siRNA sense strand
uugagauuauucuuaacaacu

SEQ ID NO: 18332 - RNA, 21 nt, Artificial Sequence
  Ebola virus siRNA sense strand
ugagauuauucuuaacaacuc

SEQ ID NO: 18333 - RNA, 21 nt, Artificial Sequence
  Ebola virus siRNA sense strand
gagauuauucuuaacaacuca

SEQ ID NO: 18334 - RNA, 21 nt, Artificial Sequence
  Ebola virus siRNA sense strand
agauuauucuuaacaacucag

SEQ ID NO: 18335 - RNA, 21 nt, Artificial Sequence
  Ebola virus siRNA sense strand
gauuauucuuaacaacucagc

SEQ ID NO: 18336 - RNA, 21 nt, Artificial Sequence
  Ebola virus siRNA sense strand
auuauucuuaacaacucagca

SEQ ID NO: 18337 - RNA, 21 nt, Artificial Sequence
  Ebola virus siRNA sense strand
uuauucuuaacaacucagcaa

SEQ ID NO: 18338 - RNA, 21 nt, Artificial Sequence
  Ebola virus siRNA sense strand
uauucuuaacaacucagcaag

SEQ ID NO: 18339 - RNA, 21 nt, Artificial Sequence
  Ebola virus siRNA sense strand
auucuuaacaacucagcaagc

SEQ ID NO: 18340 - RNA, 21 nt, Artificial Sequence
  Ebola virus siRNA sense strand
uucuuaacaacucagcaagcc

SEQ ID NO: 18341 - RNA, 21 nt, Artificial Sequence
  Ebola virus siRNA sense strand
ucuuaacaacucagcaagcca

SEQ ID NO: 18342 - RNA, 21 nt, Artificial Sequence
  Ebola virus siRNA sense strand
cuuaacaacucagcaagccaa

SEQ ID NO: 18343 - RNA, 21 nt, Artificial Sequence
  Ebola virus siRNA sense strand
uuaacaacucagcaagccaaa

SEQ ID NO: 18344 - RNA, 21 nt, Artificial Sequence
  Ebola virus siRNA sense strand
uaacaacucagcaagccaaau

SEQ ID NO: 18345 - RNA, 21 nt, Artificial Sequence
  Ebola virus siRNA sense strand
aacaacucagcaagccaaaua

SEQ ID NO: 18346 - RNA, 21 nt, Artificial Sequence
  Ebola virus siRNA sense strand
acaacucagcaagccaaauaa

SEQ ID NO: 18347 - RNA, 21 nt, Artificial Sequence
  Ebola virus siRNA sense strand
caacucagcaagccaaauaac

SEQ ID NO: 18348 - RNA, 21 nt, Artificial Sequence
  Ebola virus siRNA sense strand
aacucagcaagccaaauaaca

SEQ ID NO: 18349 - RNA, 21 nt, Artificial Sequence
  Ebola virus siRNA sense strand
acucagcaagccaaauaacag

SEQ ID NO: 18350 - RNA, 21 nt, Artificial Sequence
  Ebola virus siRNA sense strand
cucagcaagccaaauaacaga

SEQ ID NO: 18351 - RNA, 21 nt, Artificial Sequence
  Ebola virus siRNA sense strand
ucagcaagccaaauaacagac

SEQ ID NO: 18352 - RNA, 21 nt, Artificial Sequence
  Ebola virus siRNA sense strand
cagcaagccaaauaacagaca

SEQ ID NO: 18353 - RNA, 21 nt, Artificial Sequence
  Ebola virus siRNA sense strand
agcaagccaaauaacagacau

SEQ ID NO: 18354 - RNA, 21 nt, Artificial Sequence
  Ebola virus siRNA sense strand
gcaagccaaauaacagacaua

SEQ ID NO: 18355 - RNA, 21 nt, Artificial Sequence
  Ebola virus siRNA sense strand
caagccaaauaacagacauaa

SEQ ID NO: 18356 - RNA, 21 nt, Artificial Sequence
  Ebola virus siRNA sense strand
aagccaaauaacagacauaac

SEQ ID NO: 18357 - RNA, 21 nt, Artificial Sequence
  Ebola virus siRNA sense strand
agccaaauaacagacauaaca

SEQ ID NO: 18358 - RNA, 21 nt, Artificial Sequence
  Ebola virus siRNA sense strand
gccaaauaacagacauaacaa

SEQ ID NO: 18359 - RNA, 21 nt, Artificial Sequence
  Ebola virus siRNA sense strand
ccaaauaacagacauaacaaa

SEQ ID NO: 18360 - RNA, 21 nt, Artificial Sequence
  Ebola virus siRNA sense strand
caaauaacagacauaacaaau

SEQ ID NO: 18361 - RNA, 21 nt, Artificial Sequence
  Ebola virus siRNA sense strand
aaauaacagacauaacaaauc

SEQ ID NO: 18362 - RNA, 21 nt, Artificial Sequence
  Ebola virus siRNA sense strand
aauaacagacauaacaaaucc

SEQ ID NO: 18363 - RNA, 21 nt, Artificial Sequence
  Ebola virus siRNA sense strand
auaacagacauaacaaauccu

SEQ ID NO: 18364 - RNA, 21 nt, Artificial Sequence
  Ebola virus siRNA sense strand
uaacagacauaacaaauccua

SEQ ID NO: 18365 - RNA, 21 nt, Artificial Sequence
  Ebola virus siRNA sense strand
aacagacauaacaaauccuac

SEQ ID NO: 18366 - RNA, 21 nt, Artificial Sequence
  Ebola virus siRNA sense strand
acagacauaacaaauccuacu

SEQ ID NO: 18367 - RNA, 21 nt, Artificial Sequence
  Ebola virus siRNA sense strand
cagacauaacaaauccuacuu

SEQ ID NO: 18368 - RNA, 21 nt, Artificial Sequence
  Ebola virus siRNA sense strand
agacauaacaaauccuacuug

SEQ ID NO: 18369 - RNA, 21 nt, Artificial Sequence
  Ebola virus siRNA sense strand
gacauaacaaauccuacuugg

SEQ ID NO: 18370 - RNA, 21 nt, Artificial Sequence
  Ebola virus siRNA sense strand
acauaacaaauccuacuuggu

SEQ ID NO: 18371 - RNA, 21 nt, Artificial Sequence
  Ebola virus siRNA sense strand
cauaacaaauccuacuugguu

SEQ ID NO: 18372 - RNA, 21 nt, Artificial Sequence
  Ebola virus siRNA sense strand
auaacaaauccuacuugguuu

SEQ ID NO: 18373 - RNA, 21 nt, Artificial Sequence
  Ebola virus siRNA sense strand
uaacaaauccuacuugguuua

SEQ ID NO: 18374 - RNA, 21 nt, Artificial Sequence
  Ebola virus siRNA sense strand
aacaaauccuacuugguuuaa

SEQ ID NO: 18375 - RNA, 21 nt, Artificial Sequence
  Ebola virus siRNA sense strand
acaaauccuacuugguuuaaa

SEQ ID NO: 18376 - RNA, 21 nt, Artificial Sequence
  Ebola virus siRNA sense strand
caaauccuacuugguuuaaag

SEQ ID NO: 18377 - RNA, 21 nt, Artificial Sequence
  Ebola virus siRNA sense strand
aaauccuacuugguuuaaaga

SEQ ID NO: 18378 - RNA, 21 nt, Artificial Sequence
  Ebola virus siRNA sense strand
aauccuacuugguuuaaagac

SEQ ID NO: 18379 - RNA, 21 nt, Artificial Sequence
  Ebola virus siRNA sense strand
auccuacuugguuuaaagacc

SEQ ID NO: 18380 - RNA, 21 nt, Artificial Sequence
  Ebola virus siRNA sense strand
uccuacuugguuuaaagacca

SEQ ID NO: 18381 - RNA, 21 nt, Artificial Sequence
  Ebola virus siRNA sense strand
ccuacuugguuuaaagaccaa

SEQ ID NO: 18382 - RNA, 21 nt, Artificial Sequence
  Ebola virus siRNA sense strand
cuacuugguuuaaagaccaaa

SEQ ID NO: 18383 - RNA, 21 nt, Artificial Sequence
  Ebola virus siRNA sense strand
uacuugguuuaaagaccaaag

SEQ ID NO: 18384 - RNA, 21 nt, Artificial Sequence
  Ebola virus siRNA sense strand
acuugguuuaaagaccaaaga

SEQ ID NO: 18385 - RNA, 21 nt, Artificial Sequence
  Ebola virus siRNA sense strand
cuugguuuaaagaccaaagag

SEQ ID NO: 18386 - RNA, 21 nt, Artificial Sequence
  Ebola virus siRNA sense strand
uugguuuaaagaccaaagagc

SEQ ID NO: 18387 - RNA, 21 nt, Artificial Sequence
  Ebola virus siRNA sense strand
ugguuuaaagaccaaagagca

SEQ ID NO: 18388 - RNA, 21 nt, Artificial Sequence
  Ebola virus siRNA sense strand
gguuuaaagaccaaagagcaa

SEQ ID NO: 18389 - RNA, 21 nt, Artificial Sequence
  Ebola virus siRNA sense strand
guuuaaagaccaaagagcaag

SEQ ID NO: 18390 - RNA, 21 nt, Artificial Sequence
  Ebola virus siRNA sense strand
uuuaaagaccaaagagcaagg

SEQ ID NO: 18391 - RNA, 21 nt, Artificial Sequence
  Ebola virus siRNA sense strand
uuaaagaccaaagagcaaggc

SEQ ID NO: 18392 - RNA, 21 nt, Artificial Sequence
  Ebola virus siRNA sense strand
uaaagaccaaagagcaaggcu

SEQ ID NO: 18393 - RNA, 21 nt, Artificial Sequence
  Ebola virus siRNA sense strand
aaagaccaaagagcaaggcua

SEQ ID NO: 18394 - RNA, 21 nt, Artificial Sequence
  Ebola virus siRNA sense strand
aagaccaaagagcaaggcuac

SEQ ID NO: 18395 - RNA, 21 nt, Artificial Sequence
  Ebola virus siRNA sense strand
agaccaaagagcaaggcuacc

SEQ ID NO: 18396 - RNA, 21 nt, Artificial Sequence
  Ebola virus siRNA sense strand
gaccaaagagcaaggcuaccu

SEQ ID NO: 18397 - RNA, 21 nt, Artificial Sequence
  Ebola virus siRNA sense strand
accaaagagcaaggcuaccua

SEQ ID NO: 18398 - RNA, 21 nt, Artificial Sequence
  Ebola virus siRNA sense strand
ccaaagagcaaggcuaccuaa

SEQ ID NO: 18399 - RNA, 21 nt, Artificial Sequence
  Ebola virus siRNA sense strand
caaagagcaaggcuaccuaag

SEQ ID NO: 18400 - RNA, 21 nt, Artificial Sequence
  Ebola virus siRNA sense strand
aaagagcaaggcuaccuaagc

SEQ ID NO: 18401 - RNA, 21 nt, Artificial Sequence
  Ebola virus siRNA sense strand
aagagcaaggcuaccuaagca

SEQ ID NO: 18402 - RNA, 21 nt, Artificial Sequence
  Ebola virus siRNA sense strand
agagcaaggcuaccuaagcaa

SEQ ID NO: 18403 - RNA, 21 nt, Artificial Sequence
  Ebola virus siRNA sense strand
gagcaaggcuaccuaagcaag

SEQ ID NO: 18404 - RNA, 21 nt, Artificial Sequence
  Ebola virus siRNA sense strand
agcaaggcuaccuaagcaagu

SEQ ID NO: 18405 - RNA, 21 nt, Artificial Sequence
  Ebola virus siRNA sense strand
gcaaggcuaccuaagcaaguc

SEQ ID NO: 18406 - RNA, 21 nt, Artificial Sequence
  Ebola virus siRNA sense strand
caaggcuaccuaagcaagucg

SEQ ID NO: 18407 - RNA, 21 nt, Artificial Sequence
  Ebola virus siRNA sense strand
aaggcuaccuaagcaagucga

SEQ ID NO: 18408 - RNA, 21 nt, Artificial Sequence
  Ebola virus siRNA sense strand
aggcuaccuaagcaagucgag

SEQ ID NO: 18409 - RNA, 21 nt, Artificial Sequence
  Ebola virus siRNA sense strand
ggcuaccuaagcaagucgagg

SEQ ID NO: 18410 - RNA, 21 nt, Artificial Sequence
  Ebola virus siRNA sense strand
gcuaccuaagcaagucgaggu

SEQ ID NO: 18411 - RNA, 21 nt, Artificial Sequence
  Ebola virus siRNA sense strand
cuaccuaagcaagucgagguu

SEQ ID NO: 18412 - RNA, 21 nt, Artificial Sequence
  Ebola virus siRNA sense strand
uaccuaagcaagucgagguua

SEQ ID NO: 18413 - RNA, 21 nt, Artificial Sequence
  Ebola virus siRNA sense strand
accuaagcaagucgagguuau

SEQ ID NO: 18414 - RNA, 21 nt, Artificial Sequence
  Ebola virus siRNA sense strand
ccuaagcaagucgagguuaua

SEQ ID NO: 18415 - RNA, 21 nt, Artificial Sequence
  Ebola virus siRNA sense strand
cuaagcaagucgagguuauaa

SEQ ID NO: 18416 - RNA, 21 nt, Artificial Sequence
  Ebola virus siRNA sense strand
uaagcaagucgagguuauaac

SEQ ID NO: 18417 - RNA, 21 nt, Artificial Sequence
  Ebola virus siRNA sense strand
aagcaagucgagguuauaacc

SEQ ID NO: 18418 - RNA, 21 nt, Artificial Sequence
  Ebola virus siRNA sense strand
agcaagucgagguuauaacca

SEQ ID NO: 18419 - RNA, 21 nt, Artificial Sequence
  Ebola virus siRNA sense strand
gcaagucgagguuauaaccau

SEQ ID NO: 18420 - RNA, 21 nt, Artificial Sequence
  Ebola virus siRNA sense strand
caagucgagguuauaaccaug

SEQ ID NO: 18421 - RNA, 21 nt, Artificial Sequence
  Ebola virus siRNA sense strand
aagucgagguuauaaccaugg

SEQ ID NO: 18422 - RNA, 21 nt, Artificial Sequence
  Ebola virus siRNA sense strand
agucgagguuauaaccaugga

SEQ ID NO: 18423 - RNA, 21 nt, Artificial Sequence
  Ebola virus siRNA sense strand
gucgagguuauaaccauggau

SEQ ID NO: 18424 - RNA, 21 nt, Artificial Sequence
  Ebola virus siRNA sense strand
ucgagguuauaaccauggaug

SEQ ID NO: 18425 - RNA, 21 nt, Artificial Sequence
  Ebola virus siRNA sense strand
cgagguuauaaccauggaugc

SEQ ID NO: 18426 - RNA, 21 nt, Artificial Sequence
  Ebola virus siRNA sense strand
gagguuauaaccauggaugca

SEQ ID NO: 18427 - RNA, 21 nt, Artificial Sequence
  Ebola virus siRNA sense strand
agguuauaaccauggaugcag

SEQ ID NO: 18428 - RNA, 21 nt, Artificial Sequence
  Ebola virus siRNA sense strand
gguuauaaccauggaugcaga

SEQ ID NO: 18429 - RNA, 21 nt, Artificial Sequence
  Ebola virus siRNA sense strand
guuauaaccauggaugcagag

SEQ ID NO: 18430 - RNA, 21 nt, Artificial Sequence
  Ebola virus siRNA sense strand
uuauaaccauggaugcagaga

SEQ ID NO: 18431 - RNA, 21 nt, Artificial Sequence
  Ebola virus siRNA sense strand
uauaaccauggaugcagagac

SEQ ID NO: 18432 - RNA, 21 nt, Artificial Sequence
  Ebola virus siRNA sense strand
auaaccauggaugcagagaca

SEQ ID NO: 18433 - RNA, 21 nt, Artificial Sequence
  Ebola virus siRNA sense strand
uaaccauggaugcagagacaa

SEQ ID NO: 18434 - RNA, 21 nt, Artificial Sequence
  Ebola virus siRNA sense strand
aaccauggaugcagagacaac

SEQ ID NO: 18435 - RNA, 21 nt, Artificial Sequence
  Ebola virus siRNA sense strand
accauggaugcagagacaaca

SEQ ID NO: 18436 - RNA, 21 nt, Artificial Sequence
  Ebola virus siRNA sense strand
ccauggaugcagagacaacag

SEQ ID NO: 18437 - RNA, 21 nt, Artificial Sequence
  Ebola virus siRNA sense strand
cauggaugcagagacaacaga

SEQ ID NO: 18438 - RNA, 21 nt, Artificial Sequence
  Ebola virus siRNA sense strand
auggaugcagagacaacagag

SEQ ID NO: 18439 - RNA, 21 nt, Artificial Sequence
  Ebola virus siRNA sense strand
uggaugcagagacaacagaga

SEQ ID NO: 18440 - RNA, 21 nt, Artificial Sequence
  Ebola virus siRNA sense strand
ggaugcagagacaacagagaa

SEQ ID NO: 18441 - RNA, 21 nt, Artificial Sequence
  Ebola virus siRNA sense strand
gaugcagagacaacagagaau

SEQ ID NO: 18442 - RNA, 21 nt, Artificial Sequence
  Ebola virus siRNA sense strand
augcagagacaacagagaaua

SEQ ID NO: 18443 - RNA, 21 nt, Artificial Sequence
  Ebola virus siRNA sense strand
ugcagagacaacagagaauau

SEQ ID NO: 18444 - RNA, 21 nt, Artificial Sequence
  Ebola virus siRNA sense strand
gcagagacaacagagaauaua

SEQ ID NO: 18445 - RNA, 21 nt, Artificial Sequence
  Ebola virus siRNA sense strand
cagagacaacagagaauauaa

SEQ ID NO: 18446 - RNA, 21 nt, Artificial Sequence
  Ebola virus siRNA sense strand
agagacaacagagaauauaaa

SEQ ID NO: 18447 - RNA, 21 nt, Artificial Sequence
  Ebola virus siRNA sense strand
gagacaacagagaauauaaac

SEQ ID NO: 18448 - RNA, 21 nt, Artificial Sequence
  Ebola virus siRNA sense strand
agacaacagagaauauaaaca

SEQ ID NO: 18449 - RNA, 21 nt, Artificial Sequence
  Ebola virus siRNA sense strand
gacaacagagaauauaaacag

SEQ ID NO: 18450 - RNA, 21 nt, Artificial Sequence
  Ebola virus siRNA sense strand
acaacagagaauauaaacaga

SEQ ID NO: 18451 - RNA, 21 nt, Artificial Sequence
  Ebola virus siRNA sense strand
caacagagaauauaaacagau

SEQ ID NO: 18452 - RNA, 21 nt, Artificial Sequence
  Ebola virus siRNA sense strand
aacagagaauauaaacagauc

SEQ ID NO: 18453 - RNA, 21 nt, Artificial Sequence
  Ebola virus siRNA sense strand
acagagaauauaaacagaucg

SEQ ID NO: 18454 - RNA, 21 nt, Artificial Sequence
  Ebola virus siRNA sense strand
cagagaauauaaacagaucga

SEQ ID NO: 18455 - RNA, 21 nt, Artificial Sequence
  Ebola virus siRNA sense strand
agagaauauaaacagaucgaa

SEQ ID NO: 18456 - RNA, 21 nt, Artificial Sequence
  Ebola virus siRNA sense strand
gagaauauaaacagaucgaaa

SEQ ID NO: 18457 - RNA, 21 nt, Artificial Sequence
  Ebola virus siRNA sense strand
agaauauaaacagaucgaaau

SEQ ID NO: 18458 - RNA, 21 nt, Artificial Sequence
  Ebola virus siRNA sense strand
gaauauaaacagaucgaaauu

SEQ ID NO: 18459 - RNA, 21 nt, Artificial Sequence
  Ebola virus siRNA sense strand
aauauaaacagaucgaaauug

SEQ ID NO: 18460 - RNA, 21 nt, Artificial Sequence
  Ebola virus siRNA sense strand
auauaaacagaucgaaauugu

SEQ ID NO: 18461 - RNA, 21 nt, Artificial Sequence
  Ebola virus siRNA sense strand
uauaaacagaucgaaauugua

SEQ ID NO: 18462 - RNA, 21 nt, Artificial Sequence
  Ebola virus siRNA sense strand
auaaacagaucgaaauuguac

SEQ ID NO: 18463 - RNA, 21 nt, Artificial Sequence
  Ebola virus siRNA sense strand
uaaacagaucgaaauuguacg

SEQ ID NO: 18464 - RNA, 21 nt, Artificial Sequence
  Ebola virus siRNA sense strand
aaacagaucgaaauuguacga

SEQ ID NO: 18465 - RNA, 21 nt, Artificial Sequence
  Ebola virus siRNA sense strand
aacagaucgaaauuguacgaa

SEQ ID NO: 18466 - RNA, 21 nt, Artificial Sequence
  Ebola virus siRNA sense strand
acagaucgaaauuguacgaag

SEQ ID NO: 18467 - RNA, 21 nt, Artificial Sequence
  Ebola virus siRNA sense strand
cagaucgaaauuguacgaagc

SEQ ID NO: 18468 - RNA, 21 nt, Artificial Sequence
  Ebola virus siRNA sense strand
agaucgaaauuguacgaagcu

SEQ ID NO: 18469 - RNA, 21 nt, Artificial Sequence
  Ebola virus siRNA sense strand
gaucgaaauuguacgaagcug

SEQ ID NO: 18470 - RNA, 21 nt, Artificial Sequence
  Ebola virus siRNA sense strand
aucgaaauuguacgaagcugu

SEQ ID NO: 18471 - RNA, 21 nt, Artificial Sequence
  Ebola virus siRNA sense strand
ucgaaauuguacgaagcugua

SEQ ID NO: 18472 - RNA, 21 nt, Artificial Sequence
  Ebola virus siRNA sense strand
cgaaauuguacgaagcuguau

SEQ ID NO: 18473 - RNA, 21 nt, Artificial Sequence
  Ebola virus siRNA sense strand
gaaauuguacgaagcuguaua

SEQ ID NO: 18474 - RNA, 21 nt, Artificial Sequence
  Ebola virus siRNA sense strand
aaauuguacgaagcuguauau

SEQ ID NO: 18475 - RNA, 21 nt, Artificial Sequence
  Ebola virus siRNA sense strand
aauuguacgaagcuguauaua

SEQ ID NO: 18476 - RNA, 21 nt, Artificial Sequence
  Ebola virus siRNA sense strand
auuguacgaagcuguauauaa

SEQ ID NO: 18477 - RNA, 21 nt, Artificial Sequence
  Ebola virus siRNA sense strand
uuguacgaagcuguauauaaa

SEQ ID NO: 18478 - RNA, 21 nt, Artificial Sequence
  Ebola virus siRNA sense strand
uguacgaagcuguauauaaau

SEQ ID NO: 18479 - RNA, 21 nt, Artificial Sequence
  Ebola virus siRNA sense strand
guacgaagcuguauauaaauu

SEQ ID NO: 18480 - RNA, 21 nt, Artificial Sequence
  Ebola virus siRNA sense strand
uacgaagcuguauauaaauug

SEQ ID NO: 18481 - RNA, 21 nt, Artificial Sequence
  Ebola virus siRNA sense strand
acgaagcuguauauaaauuga

SEQ ID NO: 18482 - RNA, 21 nt, Artificial Sequence
  Ebola virus siRNA sense strand
cgaagcuguauauaaauugau

SEQ ID NO: 18483 - RNA, 21 nt, Artificial Sequence
  Ebola virus siRNA sense strand
gaagcuguauauaaauugauc

SEQ ID NO: 18484 - RNA, 21 nt, Artificial Sequence
  Ebola virus siRNA sense strand
aagcuguauauaaauugaucu

SEQ ID NO: 18485 - RNA, 21 nt, Artificial Sequence
  Ebola virus siRNA sense strand
agcuguauauaaauugaucuu

SEQ ID NO: 18486 - RNA, 21 nt, Artificial Sequence
  Ebola virus siRNA sense strand
gcuguauauaaauugaucuua

SEQ ID NO: 18487 - RNA, 21 nt, Artificial Sequence
  Ebola virus siRNA sense strand
cuguauauaaauugaucuuac

SEQ ID NO: 18488 - RNA, 21 nt, Artificial Sequence
  Ebola virus siRNA sense strand
uguauauaaauugaucuuaca

SEQ ID NO: 18489 - RNA, 21 nt, Artificial Sequence
  Ebola virus siRNA sense strand
guauauaaauugaucuuacac

SEQ ID NO: 18490 - RNA, 21 nt, Artificial Sequence
  Ebola virus siRNA sense strand
uauauaaauugaucuuacacc

SEQ ID NO: 18491 - RNA, 21 nt, Artificial Sequence
  Ebola virus siRNA sense strand
auauaaauugaucuuacacca

SEQ ID NO: 18492 - RNA, 21 nt, Artificial Sequence
  Ebola virus siRNA sense strand
uauaaauugaucuuacaccau

SEQ ID NO: 18493 - RNA, 21 nt, Artificial Sequence
  Ebola virus siRNA sense strand
auaaauugaucuuacaccaua

SEQ ID NO: 18494 - RNA, 21 nt, Artificial Sequence
  Ebola virus siRNA sense strand
uaaauugaucuuacaccauau

SEQ ID NO: 18495 - RNA, 21 nt, Artificial Sequence
  Ebola virus siRNA sense strand
aaauugaucuuacaccauauu

SEQ ID NO: 18496 - RNA, 21 nt, Artificial Sequence
  Ebola virus siRNA sense strand
aauugaucuuacaccauauug

SEQ ID NO: 18497 - RNA, 21 nt, Artificial Sequence
  Ebola virus siRNA sense strand
auugaucuuacaccauauuga

SEQ ID NO: 18498 - RNA, 21 nt, Artificial Sequence
  Ebola virus siRNA sense strand
uugaucuuacaccauauugau

SEQ ID NO: 18499 - RNA, 21 nt, Artificial Sequence
  Ebola virus siRNA sense strand
ugaucuuacaccauauugauc

SEQ ID NO: 18500 - RNA, 21 nt, Artificial Sequence
  Ebola virus siRNA sense strand
gaucuuacaccauauugaucc

SEQ ID NO: 18501 - RNA, 21 nt, Artificial Sequence
  Ebola virus siRNA sense strand
aucuuacaccauauugauccu

SEQ ID NO: 18502 - RNA, 21 nt, Artificial Sequence
  Ebola virus siRNA sense strand
ucuuacaccauauugauccua

SEQ ID NO: 18503 - RNA, 21 nt, Artificial Sequence
  Ebola virus siRNA sense strand
cuuacaccauauugauccuag

SEQ ID NO: 18504 - RNA, 21 nt, Artificial Sequence
  Ebola virus siRNA sense strand
uuacaccauauugauccuagc

SEQ ID NO: 18505 - RNA, 21 nt, Artificial Sequence
  Ebola virus siRNA sense strand
uacaccauauugauccuagcg

SEQ ID NO: 18506 - RNA, 21 nt, Artificial Sequence
  Ebola virus siRNA sense strand
acaccauauugauccuagcgu

SEQ ID NO: 18507 - RNA, 21 nt, Artificial Sequence
  Ebola virus siRNA sense strand
caccauauugauccuagcgua

SEQ ID NO: 18508 - RNA, 21 nt, Artificial Sequence
  Ebola virus siRNA sense strand
accauauugauccuagcguau

SEQ ID NO: 18509 - RNA, 21 nt, Artificial Sequence
  Ebola virus siRNA sense strand
ccauauugauccuagcguauu

SEQ ID NO: 18510 - RNA, 21 nt, Artificial Sequence
  Ebola virus siRNA sense strand
cauauugauccuagcguauug

SEQ ID NO: 18511 - RNA, 21 nt, Artificial Sequence
  Ebola virus siRNA sense strand
auauugauccuagcguauuga

SEQ ID NO: 18512 - RNA, 21 nt, Artificial Sequence
  Ebola virus siRNA sense strand
uauugauccuagcguauugaa

SEQ ID NO: 18513 - RNA, 21 nt, Artificial Sequence
  Ebola virus siRNA sense strand
auugauccuagcguauugaaa

SEQ ID NO: 18514 - RNA, 21 nt, Artificial Sequence
  Ebola virus siRNA sense strand
uugauccuagcguauugaaag

SEQ ID NO: 18515 - RNA, 21 nt, Artificial Sequence
  Ebola virus siRNA sense strand
ugauccuagcguauugaaagc

SEQ ID NO: 18516 - RNA, 21 nt, Artificial Sequence
  Ebola virus siRNA sense strand
gauccuagcguauugaaagca

SEQ ID NO: 18517 - RNA, 21 nt, Artificial Sequence
  Ebola virus siRNA sense strand
auccuagcguauugaaagcag

SEQ ID NO: 18518 - RNA, 21 nt, Artificial Sequence
  Ebola virus siRNA sense strand
uccuagcguauugaaagcagu

SEQ ID NO: 18519 - RNA, 21 nt, Artificial Sequence
  Ebola virus siRNA sense strand
ccuagcguauugaaagcagug

SEQ ID NO: 18520 - RNA, 21 nt, Artificial Sequence
  Ebola virus siRNA sense strand
cuagcguauugaaagcagugg

SEQ ID NO: 18521 - RNA, 21 nt, Artificial Sequence
  Ebola virus siRNA sense strand
uagcguauugaaagcaguggu

SEQ ID NO: 18522 - RNA, 21 nt, Artificial Sequence
  Ebola virus siRNA sense strand
agcguauugaaagcagugguc

SEQ ID NO: 18523 - RNA, 21 nt, Artificial Sequence
  Ebola virus siRNA sense strand
gcguauugaaagcaguggucc

SEQ ID NO: 18524 - RNA, 21 nt, Artificial Sequence
  Ebola virus siRNA sense strand
cguauugaaagcagugguccu

SEQ ID NO: 18525 - RNA, 21 nt, Artificial Sequence
  Ebola virus siRNA sense strand
guauugaaagcagugguccuu

SEQ ID NO: 18526 - RNA, 21 nt, Artificial Sequence
  Ebola virus siRNA sense strand
uauugaaagcagugguccuua

SEQ ID NO: 18527 - RNA, 21 nt, Artificial Sequence
  Ebola virus siRNA sense strand
auugaaagcagugguccuuaa

SEQ ID NO: 18528 - RNA, 21 nt, Artificial Sequence
  Ebola virus siRNA sense strand
uugaaagcagugguccuuaaa

SEQ ID NO: 18529 - RNA, 21 nt, Artificial Sequence
  Ebola virus siRNA sense strand
ugaaagcagugguccuuaaag

SEQ ID NO: 18530 - RNA, 21 nt, Artificial Sequence
  Ebola virus siRNA sense strand
gaaagcagugguccuuaaagu

SEQ ID NO: 18531 - RNA, 21 nt, Artificial Sequence
  Ebola virus siRNA sense strand
aaagcagugguccuuaaaguc

SEQ ID NO: 18532 - RNA, 21 nt, Artificial Sequence
  Ebola virus siRNA sense strand
aagcagugguccuuaaagucu

SEQ ID NO: 18533 - RNA, 21 nt, Artificial Sequence
  Ebola virus siRNA sense strand
agcagugguccuuaaagucuu

SEQ ID NO: 18534 - RNA, 21 nt, Artificial Sequence
  Ebola virus siRNA sense strand
gcagugguccuuaaagucuuu

SEQ ID NO: 18535 - RNA, 21 nt, Artificial Sequence
  Ebola virus siRNA sense strand
cagugguccuuaaagucuuuc

SEQ ID NO: 18536 - RNA, 21 nt, Artificial Sequence
  Ebola virus siRNA sense strand
agugguccuuaaagucuuucu

SEQ ID NO: 18537 - RNA, 21 nt, Artificial Sequence
  Ebola virus siRNA sense strand
gugguccuuaaagucuuucua

SEQ ID NO: 18538 - RNA, 21 nt, Artificial Sequence
  Ebola virus siRNA sense strand
ugguccuuaaagucuuucuaa

SEQ ID NO: 18539 - RNA, 21 nt, Artificial Sequence
  Ebola virus siRNA sense strand
gguccuuaaagucuuucuaag

SEQ ID NO: 18540 - RNA, 21 nt, Artificial Sequence
  Ebola virus siRNA sense strand
guccuuaaagucuuucuaagu

SEQ ID NO: 18541 - RNA, 21 nt, Artificial Sequence
  Ebola virus siRNA sense strand
uccuuaaagucuuucuaagug

SEQ ID NO: 18542 - RNA, 21 nt, Artificial Sequence
  Ebola virus siRNA sense strand
ccuuaaagucuuucuaaguga

SEQ ID NO: 18543 - RNA, 21 nt, Artificial Sequence
  Ebola virus siRNA sense strand
cuuaaagucuuucuaagugau

SEQ ID NO: 18544 - RNA, 21 nt, Artificial Sequence
  Ebola virus siRNA sense strand
uuaaagucuuucuaagugaua

SEQ ID NO: 18545 - RNA, 21 nt, Artificial Sequence
  Ebola virus siRNA sense strand
uaaagucuuucuaagugauac

SEQ ID NO: 18546 - RNA, 21 nt, Artificial Sequence
  Ebola virus siRNA sense strand
aaagucuuucuaagugauacu

SEQ ID NO: 18547 - RNA, 21 nt, Artificial Sequence
  Ebola virus siRNA sense strand
aagucuuucuaagugauacug

SEQ ID NO: 18548 - RNA, 21 nt, Artificial Sequence
  Ebola virus siRNA sense strand
agucuuucuaagugauacuga

SEQ ID NO: 18549 - RNA, 21 nt, Artificial Sequence
  Ebola virus siRNA sense strand
gucuuucuaagugauacugag

SEQ ID NO: 18550 - RNA, 21 nt, Artificial Sequence
  Ebola virus siRNA sense strand
ucuuucuaagugauacugagg

SEQ ID NO: 18551 - RNA, 21 nt, Artificial Sequence
  Ebola virus siRNA sense strand
cuuucuaagugauacugaggg

SEQ ID NO: 18552 - RNA, 21 nt, Artificial Sequence
  Ebola virus siRNA sense strand
uuucuaagugauacugagggu

SEQ ID NO: 18553 - RNA, 21 nt, Artificial Sequence
  Ebola virus siRNA sense strand
uucuaagugauacugagggua

SEQ ID NO: 18554 - RNA, 21 nt, Artificial Sequence
  Ebola virus siRNA sense strand
ucuaagugauacugaggguau

SEQ ID NO: 18555 - RNA, 21 nt, Artificial Sequence
  Ebola virus siRNA sense strand
cuaagugauacugaggguaug

SEQ ID NO: 18556 - RNA, 21 nt, Artificial Sequence
  Ebola virus siRNA sense strand
uaagugauacugaggguaugu

SEQ ID NO: 18557 - RNA, 21 nt, Artificial Sequence
  Ebola virus siRNA sense strand
aagugauacugaggguauguu

SEQ ID NO: 18558 - RNA, 21 nt, Artificial Sequence
  Ebola virus siRNA sense strand
agugauacugaggguauguua

SEQ ID NO: 18559 - RNA, 21 nt, Artificial Sequence
  Ebola virus siRNA sense strand
gugauacugaggguauguuau

SEQ ID NO: 18560 - RNA, 21 nt, Artificial Sequence
  Ebola virus siRNA sense strand
ugauacugaggguauguuaug

SEQ ID NO: 18561 - RNA, 21 nt, Artificial Sequence
  Ebola virus siRNA sense strand
gauacugaggguauguuaugg

SEQ ID NO: 18562 - RNA, 21 nt, Artificial Sequence
  Ebola virus siRNA sense strand
auacugaggguauguuauggc

SEQ ID NO: 18563 - RNA, 21 nt, Artificial Sequence
  Ebola virus siRNA sense strand
uacugaggguauguuauggcu

SEQ ID NO: 18564 - RNA, 21 nt, Artificial Sequence
  Ebola virus siRNA sense strand
acugaggguauguuauggcua

SEQ ID NO: 18565 - RNA, 21 nt, Artificial Sequence
  Ebola virus siRNA sense strand
cugaggguauguuauggcuaa

SEQ ID NO: 18566 - RNA, 21 nt, Artificial Sequence
  Ebola virus siRNA sense strand
ugaggguauguuauggcuaaa

SEQ ID NO: 18567 - RNA, 21 nt, Artificial Sequence
  Ebola virus siRNA sense strand
gaggguauguuauggcuaaau

SEQ ID NO: 18568 - RNA, 21 nt, Artificial Sequence
  Ebola virus siRNA sense strand
aggguauguuauggcuaaaug

SEQ ID NO: 18569 - RNA, 21 nt, Artificial Sequence
  Ebola virus siRNA sense strand
ggguauguuauggcuaaauga

SEQ ID NO: 18570 - RNA, 21 nt, Artificial Sequence
  Ebola virus siRNA sense strand
gguauguuauggcuaaaugau

SEQ ID NO: 18571 - RNA, 21 nt, Artificial Sequence
  Ebola virus siRNA sense strand
guauguuauggcuaaaugaua

SEQ ID NO: 18572 - RNA, 21 nt, Artificial Sequence
  Ebola virus siRNA sense strand
uauguuauggcuaaaugauaa

SEQ ID NO: 18573 - RNA, 21 nt, Artificial Sequence
  Ebola virus siRNA sense strand
auguuauggcuaaaugauaau

SEQ ID NO: 18574 - RNA, 21 nt, Artificial Sequence
  Ebola virus siRNA sense strand
uguuauggcuaaaugauaauu

SEQ ID NO: 18575 - RNA, 21 nt, Artificial Sequence
  Ebola virus siRNA sense strand
guuauggcuaaaugauaauuu

SEQ ID NO: 18576 - RNA, 21 nt, Artificial Sequence
  Ebola virus siRNA sense strand
uuauggcuaaaugauaauuua

SEQ ID NO: 18577 - RNA, 21 nt, Artificial Sequence
  Ebola virus siRNA sense strand
uauggcuaaaugauaauuuag

SEQ ID NO: 18578 - RNA, 21 nt, Artificial Sequence
  Ebola virus siRNA sense strand
auggcuaaaugauaauuuagc

SEQ ID NO: 18579 - RNA, 21 nt, Artificial Sequence
  Ebola virus siRNA sense strand
uggcuaaaugauaauuuagcc

SEQ ID NO: 18580 - RNA, 21 nt, Artificial Sequence
  Ebola virus siRNA sense strand
ggcuaaaugauaauuuagccc

SEQ ID NO: 18581 - RNA, 21 nt, Artificial Sequence
  Ebola virus siRNA sense strand
gcuaaaugauaauuuagcccc

SEQ ID NO: 18582 - RNA, 21 nt, Artificial Sequence
  Ebola virus siRNA sense strand
cuaaaugauaauuuagccccg

SEQ ID NO: 18583 - RNA, 21 nt, Artificial Sequence
  Ebola virus siRNA sense strand
uaaaugauaauuuagccccgu

SEQ ID NO: 18584 - RNA, 21 nt, Artificial Sequence
  Ebola virus siRNA sense strand
aaaugauaauuuagccccguu

SEQ ID NO: 18585 - RNA, 21 nt, Artificial Sequence
  Ebola virus siRNA sense strand
aaugauaauuuagccccguuu

SEQ ID NO: 18586 - RNA, 21 nt, Artificial Sequence
  Ebola virus siRNA sense strand
augauaauuuagccccguuuu

SEQ ID NO: 18587 - RNA, 21 nt, Artificial Sequence
  Ebola virus siRNA sense strand
ugauaauuuagccccguuuuu

SEQ ID NO: 18588 - RNA, 21 nt, Artificial Sequence
  Ebola virus siRNA sense strand
gauaauuuagccccguuuuuu

SEQ ID NO: 18589 - RNA, 21 nt, Artificial Sequence
  Ebola virus siRNA sense strand
auaauuuagccccguuuuuug

SEQ ID NO: 18590 - RNA, 21 nt, Artificial Sequence
  Ebola virus siRNA sense strand
uaauuuagccccguuuuuugc

SEQ ID NO: 18591 - RNA, 21 nt, Artificial Sequence
  Ebola virus siRNA sense strand
aauuuagccccguuuuuugcc

SEQ ID NO: 18592 - RNA, 21 nt, Artificial Sequence
  Ebola virus siRNA sense strand
auuuagccccguuuuuugcca

SEQ ID NO: 18593 - RNA, 21 nt, Artificial Sequence
  Ebola virus siRNA sense strand
uuuagccccguuuuuugccac

SEQ ID NO: 18594 - RNA, 21 nt, Artificial Sequence
  Ebola virus siRNA sense strand
uuagccccguuuuuugccacu

SEQ ID NO: 18595 - RNA, 21 nt, Artificial Sequence
  Ebola virus siRNA sense strand
uagccccguuuuuugccacug

SEQ ID NO: 18596 - RNA, 21 nt, Artificial Sequence
  Ebola virus siRNA sense strand
agccccguuuuuugccacugg

SEQ ID NO: 18597 - RNA, 21 nt, Artificial Sequence
  Ebola virus siRNA sense strand
gccccguuuuuugccacuggu

SEQ ID NO: 18598 - RNA, 21 nt, Artificial Sequence
  Ebola virus siRNA sense strand
ccccguuuuuugccacugguu

SEQ ID NO: 18599 - RNA, 21 nt, Artificial Sequence
  Ebola virus siRNA sense strand
cccguuuuuugccacugguua

SEQ ID NO: 18600 - RNA, 21 nt, Artificial Sequence
  Ebola virus siRNA sense strand
ccguuuuuugccacugguuau

SEQ ID NO: 18601 - RNA, 21 nt, Artificial Sequence
  Ebola virus siRNA sense strand
cguuuuuugccacugguuauu

SEQ ID NO: 18602 - RNA, 21 nt, Artificial Sequence
  Ebola virus siRNA sense strand
guuuuuugccacugguuauuu

SEQ ID NO: 18603 - RNA, 21 nt, Artificial Sequence
  Ebola virus siRNA sense strand
uuuuuugccacugguuauuua

SEQ ID NO: 18604 - RNA, 21 nt, Artificial Sequence
  Ebola virus siRNA sense strand
uuuuugccacugguuauuuaa

SEQ ID NO: 18605 - RNA, 21 nt, Artificial Sequence
  Ebola virus siRNA sense strand
uuuugccacugguuauuuaau

SEQ ID NO: 18606 - RNA, 21 nt, Artificial Sequence
  Ebola virus siRNA sense strand
uuugccacugguuauuuaauu

SEQ ID NO: 18607 - RNA, 21 nt, Artificial Sequence
  Ebola virus siRNA sense strand
uugccacugguuauuuaauua

SEQ ID NO: 18608 - RNA, 21 nt, Artificial Sequence
  Ebola virus siRNA sense strand
ugccacugguuauuuaauuaa

SEQ ID NO: 18609 - RNA, 21 nt, Artificial Sequence
  Ebola virus siRNA sense strand
gccacugguuauuuaauuaag

SEQ ID NO: 18610 - RNA, 21 nt, Artificial Sequence
  Ebola virus siRNA sense strand
ccacugguuauuuaauuaagc

SEQ ID NO: 18611 - RNA, 21 nt, Artificial Sequence
  Ebola virus siRNA sense strand
cacugguuauuuaauuaagcc

SEQ ID NO: 18612 - RNA, 21 nt, Artificial Sequence
  Ebola virus siRNA sense strand
acugguuauuuaauuaagcca

SEQ ID NO: 18613 - RNA, 21 nt, Artificial Sequence
  Ebola virus siRNA sense strand
cugguuauuuaauuaagccaa

SEQ ID NO: 18614 - RNA, 21 nt, Artificial Sequence
  Ebola virus siRNA sense strand
ugguuauuuaauuaagccaau

SEQ ID NO: 18615 - RNA, 21 nt, Artificial Sequence
  Ebola virus siRNA sense strand
gguuauuuaauuaagccaaua

SEQ ID NO: 18616 - RNA, 21 nt, Artificial Sequence
  Ebola virus siRNA sense strand
guuauuuaauuaagccaauaa

SEQ ID NO: 18617 - RNA, 21 nt, Artificial Sequence
  Ebola virus siRNA sense strand
uuauuuaauuaagccaauaac

SEQ ID NO: 18618 - RNA, 21 nt, Artificial Sequence
  Ebola virus siRNA sense strand
uauuuaauuaagccaauaacg

SEQ ID NO: 18619 - RNA, 21 nt, Artificial Sequence
  Ebola virus siRNA sense strand
auuuaauuaagccaauaacgu

SEQ ID NO: 18620 - RNA, 21 nt, Artificial Sequence
  Ebola virus siRNA sense strand
uuuaauuaagccaauaacguc

SEQ ID NO: 18621 - RNA, 21 nt, Artificial Sequence
  Ebola virus siRNA sense strand
uuaauuaagccaauaacguca

SEQ ID NO: 18622 - RNA, 21 nt, Artificial Sequence
  Ebola virus siRNA sense strand
uaauuaagccaauaacgucaa

SEQ ID NO: 18623 - RNA, 21 nt, Artificial Sequence
  Ebola virus siRNA sense strand
aauuaagccaauaacgucaag

SEQ ID NO: 18624 - RNA, 21 nt, Artificial Sequence
  Ebola virus siRNA sense strand
auuaagccaauaacgucaagu

SEQ ID NO: 18625 - RNA, 21 nt, Artificial Sequence
  Ebola virus siRNA sense strand
uuaagccaauaacgucaagug

SEQ ID NO: 18626 - RNA, 21 nt, Artificial Sequence
  Ebola virus siRNA sense strand
uaagccaauaacgucaagugc

SEQ ID NO: 18627 - RNA, 21 nt, Artificial Sequence
  Ebola virus siRNA sense strand
aagccaauaacgucaagugcu

SEQ ID NO: 18628 - RNA, 21 nt, Artificial Sequence
  Ebola virus siRNA sense strand
agccaauaacgucaagugcua

SEQ ID NO: 18629 - RNA, 21 nt, Artificial Sequence
  Ebola virus siRNA sense strand
gccaauaacgucaagugcuag

SEQ ID NO: 18630 - RNA, 21 nt, Artificial Sequence
  Ebola virus siRNA sense strand
ccaauaacgucaagugcuaga

SEQ ID NO: 18631 - RNA, 21 nt, Artificial Sequence
  Ebola virus siRNA sense strand
caauaacgucaagugcuagau

SEQ ID NO: 18632 - RNA, 21 nt, Artificial Sequence
  Ebola virus siRNA sense strand
aauaacgucaagugcuagauc

SEQ ID NO: 18633 - RNA, 21 nt, Artificial Sequence
  Ebola virus siRNA sense strand
auaacgucaagugcuagaucu

SEQ ID NO: 18634 - RNA, 21 nt, Artificial Sequence
  Ebola virus siRNA sense strand
uaacgucaagugcuagaucua

SEQ ID NO: 18635 - RNA, 21 nt, Artificial Sequence
  Ebola virus siRNA sense strand
aacgucaagugcuagaucuag

SEQ ID NO: 18636 - RNA, 21 nt, Artificial Sequence
  Ebola virus siRNA sense strand
acgucaagugcuagaucuagu

SEQ ID NO: 18637 - RNA, 21 nt, Artificial Sequence
  Ebola virus siRNA sense strand
cgucaagugcuagaucuagug

SEQ ID NO: 18638 - RNA, 21 nt, Artificial Sequence
  Ebola virus siRNA sense strand
gucaagugcuagaucuaguga

SEQ ID NO: 18639 - RNA, 21 nt, Artificial Sequence
  Ebola virus siRNA sense strand
ucaagugcuagaucuagugag

SEQ ID NO: 18640 - RNA, 21 nt, Artificial Sequence
  Ebola virus siRNA sense strand
caagugcuagaucuagugagu

SEQ ID NO: 18641 - RNA, 21 nt, Artificial Sequence
  Ebola virus siRNA sense strand
aagugcuagaucuagugagug

SEQ ID NO: 18642 - RNA, 21 nt, Artificial Sequence
  Ebola virus siRNA sense strand
agugcuagaucuagugagugg

SEQ ID NO: 18643 - RNA, 21 nt, Artificial Sequence
  Ebola virus siRNA sense strand
gugcuagaucuagugaguggu

SEQ ID NO: 18644 - RNA, 21 nt, Artificial Sequence
  Ebola virus siRNA sense strand
ugcuagaucuagugaguggua

SEQ ID NO: 18645 - RNA, 21 nt, Artificial Sequence
  Ebola virus siRNA sense strand
gcuagaucuagugagugguau

SEQ ID NO: 18646 - RNA, 21 nt, Artificial Sequence
  Ebola virus siRNA sense strand
cuagaucuagugagugguauc

SEQ ID NO: 18647 - RNA, 21 nt, Artificial Sequence
  Ebola virus siRNA sense strand
uagaucuagugagugguaucu

SEQ ID NO: 18648 - RNA, 21 nt, Artificial Sequence
  Ebola virus siRNA sense strand
agaucuagugagugguaucuu

SEQ ID NO: 18649 - RNA, 21 nt, Artificial Sequence
  Ebola virus siRNA sense strand
gaucuagugagugguaucuuu

SEQ ID NO: 18650 - RNA, 21 nt, Artificial Sequence
  Ebola virus siRNA sense strand
aucuagugagugguaucuuug

SEQ ID NO: 18651 - RNA, 21 nt, Artificial Sequence
  Ebola virus siRNA sense strand
ucuagugagugguaucuuugu

SEQ ID NO: 18652 - RNA, 21 nt, Artificial Sequence
  Ebola virus siRNA sense strand
cuagugagugguaucuuuguc

SEQ ID NO: 18653 - RNA, 21 nt, Artificial Sequence
  Ebola virus siRNA sense strand
uagugagugguaucuuugucu

SEQ ID NO: 18654 - RNA, 21 nt, Artificial Sequence
  Ebola virus siRNA sense strand
agugagugguaucuuugucug

SEQ ID NO: 18655 - RNA, 21 nt, Artificial Sequence
  Ebola virus siRNA sense strand
gugagugguaucuuugucuga

SEQ ID NO: 18656 - RNA, 21 nt, Artificial Sequence
  Ebola virus siRNA sense strand
ugagugguaucuuugucugac

SEQ ID NO: 18657 - RNA, 21 nt, Artificial Sequence
  Ebola virus siRNA sense strand
gagugguaucuuugucugacg

SEQ ID NO: 18658 - RNA, 21 nt, Artificial Sequence
  Ebola virus siRNA sense strand
agugguaucuuugucugacga

SEQ ID NO: 18659 - RNA, 21 nt, Artificial Sequence
  Ebola virus siRNA sense strand
gugguaucuuugucugacgaa

SEQ ID NO: 18660 - RNA, 21 nt, Artificial Sequence
  Ebola virus siRNA sense strand
ugguaucuuugucugacgaac

SEQ ID NO: 18661 - RNA, 21 nt, Artificial Sequence
  Ebola virus siRNA sense strand
gguaucuuugucugacgaacu

SEQ ID NO: 18662 - RNA, 21 nt, Artificial Sequence
  Ebola virus siRNA sense strand
guaucuuugucugacgaacuu

SEQ ID NO: 18663 - RNA, 21 nt, Artificial Sequence
  Ebola virus siRNA sense strand
uaucuuugucugacgaacuuc

SEQ ID NO: 18664 - RNA, 21 nt, Artificial Sequence
  Ebola virus siRNA sense strand
aucuuugucugacgaacuucu

SEQ ID NO: 18665 - RNA, 21 nt, Artificial Sequence
  Ebola virus siRNA sense strand
ucuuugucugacgaacuucuu

SEQ ID NO: 18666 - RNA, 21 nt, Artificial Sequence
  Ebola virus siRNA sense strand
cuuugucugacgaacuucuua

SEQ ID NO: 18667 - RNA, 21 nt, Artificial Sequence
  Ebola virus siRNA sense strand
uuugucugacgaacuucuuau

SEQ ID NO: 18668 - RNA, 21 nt, Artificial Sequence
  Ebola virus siRNA sense strand
uugucugacgaacuucuuauc

SEQ ID NO: 18669 - RNA, 21 nt, Artificial Sequence
  Ebola virus siRNA sense strand
ugucugacgaacuucuuauca

SEQ ID NO: 18670 - RNA, 21 nt, Artificial Sequence
  Ebola virus siRNA sense strand
gucugacgaacuucuuaucaa

SEQ ID NO: 18671 - RNA, 21 nt, Artificial Sequence
  Ebola virus siRNA sense strand
ucugacgaacuucuuaucaac

SEQ ID NO: 18672 - RNA, 21 nt, Artificial Sequence
  Ebola virus siRNA sense strand
cugacgaacuucuuaucaacu

SEQ ID NO: 18673 - RNA, 21 nt, Artificial Sequence
  Ebola virus siRNA sense strand
ugacgaacuucuuaucaacua

SEQ ID NO: 18674 - RNA, 21 nt, Artificial Sequence
  Ebola virus siRNA sense strand
gacgaacuucuuaucaacuac

SEQ ID NO: 18675 - RNA, 21 nt, Artificial Sequence
  Ebola virus siRNA sense strand
acgaacuucuuaucaacuaca

SEQ ID NO: 18676 - RNA, 21 nt, Artificial Sequence
  Ebola virus siRNA sense strand
cgaacuucuuaucaacuacac

SEQ ID NO: 18677 - RNA, 21 nt, Artificial Sequence
  Ebola virus siRNA sense strand
gaacuucuuaucaacuacacg

SEQ ID NO: 18678 - RNA, 21 nt, Artificial Sequence
  Ebola virus siRNA sense strand
aacuucuuaucaacuacacgu

SEQ ID NO: 18679 - RNA, 21 nt, Artificial Sequence
  Ebola virus siRNA sense strand
acuucuuaucaacuacacgua

SEQ ID NO: 18680 - RNA, 21 nt, Artificial Sequence
  Ebola virus siRNA sense strand
cuucuuaucaacuacacguaa

SEQ ID NO: 18681 - RNA, 21 nt, Artificial Sequence
  Ebola virus siRNA sense strand
uucuuaucaacuacacguaag

SEQ ID NO: 18682 - RNA, 21 nt, Artificial Sequence
  Ebola virus siRNA sense strand
ucuuaucaacuacacguaaga

SEQ ID NO: 18683 - RNA, 21 nt, Artificial Sequence
  Ebola virus siRNA sense strand
cuuaucaacuacacguaagau

SEQ ID NO: 18684 - RNA, 21 nt, Artificial Sequence
  Ebola virus siRNA sense strand
uuaucaacuacacguaagaug

SEQ ID NO: 18685 - RNA, 21 nt, Artificial Sequence
  Ebola virus siRNA sense strand
uaucaacuacacguaagaugc

SEQ ID NO: 18686 - RNA, 21 nt, Artificial Sequence
  Ebola virus siRNA sense strand
aucaacuacacguaagaugcc

SEQ ID NO: 18687 - RNA, 21 nt, Artificial Sequence
  Ebola virus siRNA sense strand
ucaacuacacguaagaugcca

SEQ ID NO: 18688 - RNA, 21 nt, Artificial Sequence
  Ebola virus siRNA sense strand
caacuacacguaagaugccac

SEQ ID NO: 18689 - RNA, 21 nt, Artificial Sequence
  Ebola virus siRNA sense strand
aacuacacguaagaugccaca

SEQ ID NO: 18690 - RNA, 21 nt, Artificial Sequence
  Ebola virus siRNA sense strand
acuacacguaagaugccacac

SEQ ID NO: 18691 - RNA, 21 nt, Artificial Sequence
  Ebola virus siRNA sense strand
cuacacguaagaugccacacc

SEQ ID NO: 18692 - RNA, 21 nt, Artificial Sequence
  Ebola virus siRNA sense strand
uacacguaagaugccacacca

SEQ ID NO: 18693 - RNA, 21 nt, Artificial Sequence
  Ebola virus siRNA sense strand
acacguaagaugccacaccaa

SEQ ID NO: 18694 - RNA, 21 nt, Artificial Sequence
  Ebola virus siRNA sense strand
cacguaagaugccacaccaaa

SEQ ID NO: 18695 - RNA, 21 nt, Artificial Sequence
  Ebola virus siRNA sense strand
acguaagaugccacaccaaaa

SEQ ID NO: 18696 - RNA, 21 nt, Artificial Sequence
  Ebola virus siRNA sense strand
cguaagaugccacaccaaaac

SEQ ID NO: 18697 - RNA, 21 nt, Artificial Sequence
  Ebola virus siRNA sense strand
guaagaugccacaccaaaacc

SEQ ID NO: 18698 - RNA, 21 nt, Artificial Sequence
  Ebola virus siRNA sense strand
uaagaugccacaccaaaacca

SEQ ID NO: 18699 - RNA, 21 nt, Artificial Sequence
  Ebola virus siRNA sense strand
aagaugccacaccaaaaccau

SEQ ID NO: 18700 - RNA, 21 nt, Artificial Sequence
  Ebola virus siRNA sense strand
agaugccacaccaaaaccauc

SEQ ID NO: 18701 - RNA, 21 nt, Artificial Sequence
  Ebola virus siRNA sense strand
gaugccacaccaaaaccaucu

SEQ ID NO: 18702 - RNA, 21 nt, Artificial Sequence
  Ebola virus siRNA sense strand
augccacaccaaaaccaucuc

SEQ ID NO: 18703 - RNA, 21 nt, Artificial Sequence
  Ebola virus siRNA sense strand
ugccacaccaaaaccaucuca

SEQ ID NO: 18704 - RNA, 21 nt, Artificial Sequence
  Ebola virus siRNA sense strand
gccacaccaaaaccaucucag

SEQ ID NO: 18705 - RNA, 21 nt, Artificial Sequence
  Ebola virus siRNA sense strand
ccacaccaaaaccaucucagu

SEQ ID NO: 18706 - RNA, 21 nt, Artificial Sequence
  Ebola virus siRNA sense strand
cacaccaaaaccaucucaguu

SEQ ID NO: 18707 - RNA, 21 nt, Artificial Sequence
  Ebola virus siRNA sense strand
acaccaaaaccaucucaguug

SEQ ID NO: 18708 - RNA, 21 nt, Artificial Sequence
  Ebola virus siRNA sense strand
caccaaaaccaucucaguugu

SEQ ID NO: 18709 - RNA, 21 nt, Artificial Sequence
  Ebola virus siRNA sense strand
accaaaaccaucucaguugua

SEQ ID NO: 18710 - RNA, 21 nt, Artificial Sequence
  Ebola virus siRNA sense strand
ccaaaaccaucucaguuguaa

SEQ ID NO: 18711 - RNA, 21 nt, Artificial Sequence
  Ebola virus siRNA sense strand
caaaaccaucucaguuguaaa

SEQ ID NO: 18712 - RNA, 21 nt, Artificial Sequence
  Ebola virus siRNA sense strand
aaaaccaucucaguuguaaac

SEQ ID NO: 18713 - RNA, 21 nt, Artificial Sequence
  Ebola virus siRNA sense strand
aaaccaucucaguuguaaaca

SEQ ID NO: 18714 - RNA, 21 nt, Artificial Sequence
  Ebola virus siRNA sense strand
aaccaucucaguuguaaacag

SEQ ID NO: 18715 - RNA, 21 nt, Artificial Sequence
  Ebola virus siRNA sense strand
accaucucaguuguaaacagg

SEQ ID NO: 18716 - RNA, 21 nt, Artificial Sequence
  Ebola virus siRNA sense strand
ccaucucaguuguaaacaggu

SEQ ID NO: 18717 - RNA, 21 nt, Artificial Sequence
  Ebola virus siRNA sense strand
caucucaguuguaaacaggua

SEQ ID NO: 18718 - RNA, 21 nt, Artificial Sequence
  Ebola virus siRNA sense strand
aucucaguuguaaacagguaa

SEQ ID NO: 18719 - RNA, 21 nt, Artificial Sequence
  Ebola virus siRNA sense strand
ucucaguuguaaacagguaau

SEQ ID NO: 18720 - RNA, 21 nt, Artificial Sequence
  Ebola virus siRNA sense strand
cucaguuguaaacagguaaua

SEQ ID NO: 18721 - RNA, 21 nt, Artificial Sequence
  Ebola virus siRNA sense strand
ucaguuguaaacagguaauac

SEQ ID NO: 18722 - RNA, 21 nt, Artificial Sequence
  Ebola virus siRNA sense strand
caguuguaaacagguaauacu

SEQ ID NO: 18723 - RNA, 21 nt, Artificial Sequence
  Ebola virus siRNA sense strand
aguuguaaacagguaauacuu

SEQ ID NO: 18724 - RNA, 21 nt, Artificial Sequence
  Ebola virus siRNA sense strand
guuguaaacagguaauacuua

SEQ ID NO: 18725 - RNA, 21 nt, Artificial Sequence
  Ebola virus siRNA sense strand
uuguaaacagguaauacuuac

SEQ ID NO: 18726 - RNA, 21 nt, Artificial Sequence
  Ebola virus siRNA sense strand
uguaaacagguaauacuuacg

SEQ ID NO: 18727 - RNA, 21 nt, Artificial Sequence
  Ebola virus siRNA sense strand
guaaacagguaauacuuacgg

SEQ ID NO: 18728 - RNA, 21 nt, Artificial Sequence
  Ebola virus siRNA sense strand
uaaacagguaauacuuacggc

SEQ ID NO: 18729 - RNA, 21 nt, Artificial Sequence
  Ebola virus siRNA sense strand
aaacagguaauacuuacggca

SEQ ID NO: 18730 - RNA, 21 nt, Artificial Sequence
  Ebola virus siRNA sense strand
aacagguaauacuuacggcau

SEQ ID NO: 18731 - RNA, 21 nt, Artificial Sequence
  Ebola virus siRNA sense strand
acagguaauacuuacggcauu

SEQ ID NO: 18732 - RNA, 21 nt, Artificial Sequence
  Ebola virus siRNA sense strand
cagguaauacuuacggcauug

SEQ ID NO: 18733 - RNA, 21 nt, Artificial Sequence
  Ebola virus siRNA sense strand
agguaauacuuacggcauugc

SEQ ID NO: 18734 - RNA, 21 nt, Artificial Sequence
  Ebola virus siRNA sense strand
gguaauacuuacggcauugca

SEQ ID NO: 18735 - RNA, 21 nt, Artificial Sequence
  Ebola virus siRNA sense strand
guaauacuuacggcauugcaa

SEQ ID NO: 18736 - RNA, 21 nt, Artificial Sequence
  Ebola virus siRNA sense strand
uaauacuuacggcauugcaac

SEQ ID NO: 18737 - RNA, 21 nt, Artificial Sequence
  Ebola virus siRNA sense strand
aauacuuacggcauugcaacu

SEQ ID NO: 18738 - RNA, 21 nt, Artificial Sequence
  Ebola virus siRNA sense strand
auacuuacggcauugcaacug

SEQ ID NO: 18739 - RNA, 21 nt, Artificial Sequence
  Ebola virus siRNA sense strand
uacuuacggcauugcaacugc

SEQ ID NO: 18740 - RNA, 21 nt, Artificial Sequence
  Ebola virus siRNA sense strand
acuuacggcauugcaacugca

SEQ ID NO: 18741 - RNA, 21 nt, Artificial Sequence
  Ebola virus siRNA sense strand
cuuacggcauugcaacugcaa

SEQ ID NO: 18742 - RNA, 21 nt, Artificial Sequence
  Ebola virus siRNA sense strand
uuacggcauugcaacugcaaa

SEQ ID NO: 18743 - RNA, 21 nt, Artificial Sequence
  Ebola virus siRNA sense strand
uacggcauugcaacugcaaau

SEQ ID NO: 18744 - RNA, 21 nt, Artificial Sequence
  Ebola virus siRNA sense strand
acggcauugcaacugcaaauu

SEQ ID NO: 18745 - RNA, 21 nt, Artificial Sequence
  Ebola virus siRNA sense strand
cggcauugcaacugcaaauuc

SEQ ID NO: 18746 - RNA, 21 nt, Artificial Sequence
  Ebola virus siRNA sense strand
ggcauugcaacugcaaauuca

SEQ ID NO: 18747 - RNA, 21 nt, Artificial Sequence
  Ebola virus siRNA sense strand
gcauugcaacugcaaauucaa

SEQ ID NO: 18748 - RNA, 21 nt, Artificial Sequence
  Ebola virus siRNA sense strand
cauugcaacugcaaauucaac

SEQ ID NO: 18749 - RNA, 21 nt, Artificial Sequence
  Ebola virus siRNA sense strand
auugcaacugcaaauucaacg

SEQ ID NO: 18750 - RNA, 21 nt, Artificial Sequence
  Ebola virus siRNA sense strand
uugcaacugcaaauucaacga

SEQ ID NO: 18751 - RNA, 21 nt, Artificial Sequence
  Ebola virus siRNA sense strand
ugcaacugcaaauucaacgaa

SEQ ID NO: 18752 - RNA, 21 nt, Artificial Sequence
  Ebola virus siRNA sense strand
gcaacugcaaauucaacgaag

SEQ ID NO: 18753 - RNA, 21 nt, Artificial Sequence
  Ebola virus siRNA sense strand
caacugcaaauucaacgaagc

SEQ ID NO: 18754 - RNA, 21 nt, Artificial Sequence
  Ebola virus siRNA sense strand
aacugcaaauucaacgaagcc

SEQ ID NO: 18755 - RNA, 21 nt, Artificial Sequence
  Ebola virus siRNA sense strand
acugcaaauucaacgaagccc

SEQ ID NO: 18756 - RNA, 21 nt, Artificial Sequence
  Ebola virus siRNA sense strand
cugcaaauucaacgaagccca

SEQ ID NO: 18757 - RNA, 21 nt, Artificial Sequence
  Ebola virus siRNA sense strand
ugcaaauucaacgaagcccau

SEQ ID NO: 18758 - RNA, 21 nt, Artificial Sequence
  Ebola virus siRNA sense strand
gcaaauucaacgaagcccaua

SEQ ID NO: 18759 - RNA, 21 nt, Artificial Sequence
  Ebola virus siRNA sense strand
caaauucaacgaagcccauac

SEQ ID NO: 18760 - RNA, 21 nt, Artificial Sequence
  Ebola virus siRNA sense strand
aaauucaacgaagcccauacu

SEQ ID NO: 18761 - RNA, 21 nt, Artificial Sequence
  Ebola virus siRNA sense strand
aauucaacgaagcccauacug

SEQ ID NO: 18762 - RNA, 21 nt, Artificial Sequence
  Ebola virus siRNA sense strand
auucaacgaagcccauacugg

SEQ ID NO: 18763 - RNA, 21 nt, Artificial Sequence
  Ebola virus siRNA sense strand
uucaacgaagcccauacuggc

SEQ ID NO: 18764 - RNA, 21 nt, Artificial Sequence
  Ebola virus siRNA sense strand
ucaacgaagcccauacuggcu

SEQ ID NO: 18765 - RNA, 21 nt, Artificial Sequence
  Ebola virus siRNA sense strand
caacgaagcccauacuggcua

SEQ ID NO: 18766 - RNA, 21 nt, Artificial Sequence
  Ebola virus siRNA sense strand
aacgaagcccauacuggcuaa

SEQ ID NO: 18767 - RNA, 21 nt, Artificial Sequence
  Ebola virus siRNA sense strand
acgaagcccauacuggcuaag

SEQ ID NO: 18768 - RNA, 21 nt, Artificial Sequence
  Ebola virus siRNA sense strand
cgaagcccauacuggcuaagu

SEQ ID NO: 18769 - RNA, 21 nt, Artificial Sequence
  Ebola virus siRNA sense strand
gaagcccauacuggcuaaguc

SEQ ID NO: 18770 - RNA, 21 nt, Artificial Sequence
  Ebola virus siRNA sense strand
aagcccauacuggcuaaguca

SEQ ID NO: 18771 - RNA, 21 nt, Artificial Sequence
  Ebola virus siRNA sense strand
agcccauacuggcuaagucau

SEQ ID NO: 18772 - RNA, 21 nt, Artificial Sequence
  Ebola virus siRNA sense strand
gcccauacuggcuaagucauu

SEQ ID NO: 18773 - RNA, 21 nt, Artificial Sequence
  Ebola virus siRNA sense strand
cccauacuggcuaagucauuu

SEQ ID NO: 18774 - RNA, 21 nt, Artificial Sequence
  Ebola virus siRNA sense strand
ccauacuggcuaagucauuua

SEQ ID NO: 18775 - RNA, 21 nt, Artificial Sequence
  Ebola virus siRNA sense strand
cauacuggcuaagucauuuaa

SEQ ID NO: 18776 - RNA, 21 nt, Artificial Sequence
  Ebola virus siRNA sense strand
auacuggcuaagucauuuaac

SEQ ID NO: 18777 - RNA, 21 nt, Artificial Sequence
  Ebola virus siRNA sense strand
uacuggcuaagucauuuaacu

SEQ ID NO: 18778 - RNA, 21 nt, Artificial Sequence
  Ebola virus siRNA sense strand
acuggcuaagucauuuaacuc

SEQ ID NO: 18779 - RNA, 21 nt, Artificial Sequence
  Ebola virus siRNA sense strand
cuggcuaagucauuuaacuca

SEQ ID NO: 18780 - RNA, 21 nt, Artificial Sequence
  Ebola virus siRNA sense strand
uggcuaagucauuuaacucag

SEQ ID NO: 18781 - RNA, 21 nt, Artificial Sequence
  Ebola virus siRNA sense strand
ggcuaagucauuuaacucagu

SEQ ID NO: 18782 - RNA, 21 nt, Artificial Sequence
  Ebola virus siRNA sense strand
gcuaagucauuuaacucagua

SEQ ID NO: 18783 - RNA, 21 nt, Artificial Sequence
  Ebola virus siRNA sense strand
cuaagucauuuaacucaguau

SEQ ID NO: 18784 - RNA, 21 nt, Artificial Sequence
  Ebola virus siRNA sense strand
uaagucauuuaacucaguaug

SEQ ID NO: 18785 - RNA, 21 nt, Artificial Sequence
  Ebola virus siRNA sense strand
aagucauuuaacucaguaugc

SEQ ID NO: 18786 - RNA, 21 nt, Artificial Sequence
  Ebola virus siRNA sense strand
agucauuuaacucaguaugcu

SEQ ID NO: 18787 - RNA, 21 nt, Artificial Sequence
  Ebola virus siRNA sense strand
gucauuuaacucaguaugcug

SEQ ID NO: 18788 - RNA, 21 nt, Artificial Sequence
  Ebola virus siRNA sense strand
ucauuuaacucaguaugcuga

SEQ ID NO: 18789 - RNA, 21 nt, Artificial Sequence
  Ebola virus siRNA sense strand
cauuuaacucaguaugcugac

SEQ ID NO: 18790 - RNA, 21 nt, Artificial Sequence
  Ebola virus siRNA sense strand
auuuaacucaguaugcugacu

SEQ ID NO: 18791 - RNA, 21 nt, Artificial Sequence
  Ebola virus siRNA sense strand
uuuaacucaguaugcugacug

SEQ ID NO: 18792 - RNA, 21 nt, Artificial Sequence
  Ebola virus siRNA sense strand
uuaacucaguaugcugacugu

SEQ ID NO: 18793 - RNA, 21 nt, Artificial Sequence
  Ebola virus siRNA sense strand
uaacucaguaugcugacugug

SEQ ID NO: 18794 - RNA, 21 nt, Artificial Sequence
  Ebola virus siRNA sense strand
aacucaguaugcugacuguga

SEQ ID NO: 18795 - RNA, 21 nt, Artificial Sequence
  Ebola virus siRNA sense strand
acucaguaugcugacugugag

SEQ ID NO: 18796 - RNA, 21 nt, Artificial Sequence
  Ebola virus siRNA sense strand
cucaguaugcugacugugagu

SEQ ID NO: 18797 - RNA, 21 nt, Artificial Sequence
  Ebola virus siRNA sense strand
ucaguaugcugacugugaguu

SEQ ID NO: 18798 - RNA, 21 nt, Artificial Sequence
  Ebola virus siRNA sense strand
caguaugcugacugugaguua

SEQ ID NO: 18799 - RNA, 21 nt, Artificial Sequence
  Ebola virus siRNA sense strand
aguaugcugacugugaguuac

SEQ ID NO: 18800 - RNA, 21 nt, Artificial Sequence
  Ebola virus siRNA sense strand
guaugcugacugugaguuaca

SEQ ID NO: 18801 - RNA, 21 nt, Artificial Sequence
  Ebola virus siRNA sense strand
uaugcugacugugaguuacau

SEQ ID NO: 18802 - RNA, 21 nt, Artificial Sequence
  Ebola virus siRNA sense strand
augcugacugugaguuacauu

SEQ ID NO: 18803 - RNA, 21 nt, Artificial Sequence
  Ebola virus siRNA sense strand
ugcugacugugaguuacauuu

SEQ ID NO: 18804 - RNA, 21 nt, Artificial Sequence
  Ebola virus siRNA sense strand
gcugacugugaguuacauuua

SEQ ID NO: 18805 - RNA, 21 nt, Artificial Sequence
  Ebola virus siRNA sense strand
cugacugugaguuacauuuaa

SEQ ID NO: 18806 - RNA, 21 nt, Artificial Sequence
  Ebola virus siRNA sense strand
ugacugugaguuacauuuaag

SEQ ID NO: 18807 - RNA, 21 nt, Artificial Sequence
  Ebola virus siRNA sense strand
gacugugaguuacauuuaagu

SEQ ID NO: 18808 - RNA, 21 nt, Artificial Sequence
  Ebola virus siRNA sense strand
acugugaguuacauuuaaguu

SEQ ID NO: 18809 - RNA, 21 nt, Artificial Sequence
  Ebola virus siRNA sense strand
cugugaguuacauuuaaguua

SEQ ID NO: 18810 - RNA, 21 nt, Artificial Sequence
  Ebola virus siRNA sense strand
ugugaguuacauuuaaguuau

SEQ ID NO: 18811 - RNA, 21 nt, Artificial Sequence
  Ebola virus siRNA sense strand
gugaguuacauuuaaguuaua

SEQ ID NO: 18812 - RNA, 21 nt, Artificial Sequence
  Ebola virus siRNA sense strand
ugaguuacauuuaaguuauau

SEQ ID NO: 18813 - RNA, 21 nt, Artificial Sequence
  Ebola virus siRNA sense strand
gaguuacauuuaaguuauauc

SEQ ID NO: 18814 - RNA, 21 nt, Artificial Sequence
  Ebola virus siRNA sense strand
aguuacauuuaaguuauaucc

SEQ ID NO: 18815 - RNA, 21 nt, Artificial Sequence
  Ebola virus siRNA sense strand
guuacauuuaaguuauauccg

SEQ ID NO: 18816 - RNA, 21 nt, Artificial Sequence
  Ebola virus siRNA sense strand
uuacauuuaaguuauauccgc

SEQ ID NO: 18817 - RNA, 21 nt, Artificial Sequence
  Ebola virus siRNA sense strand
uacauuuaaguuauauccgcc

SEQ ID NO: 18818 - RNA, 21 nt, Artificial Sequence
  Ebola virus siRNA sense strand
acauuuaaguuauauccgccu

SEQ ID NO: 18819 - RNA, 21 nt, Artificial Sequence
  Ebola virus siRNA sense strand
cauuuaaguuauauccgccuu

SEQ ID NO: 18820 - RNA, 21 nt, Artificial Sequence
  Ebola virus siRNA sense strand
auuuaaguuauauccgccuug

SEQ ID NO: 18821 - RNA, 21 nt, Artificial Sequence
  Ebola virus siRNA sense strand
uuuaaguuauauccgccuugg

SEQ ID NO: 18822 - RNA, 21 nt, Artificial Sequence
  Ebola virus siRNA sense strand
uuaaguuauauccgccuuggu

SEQ ID NO: 18823 - RNA, 21 nt, Artificial Sequence
  Ebola virus siRNA sense strand
uaaguuauauccgccuugguu

SEQ ID NO: 18824 - RNA, 21 nt, Artificial Sequence
  Ebola virus siRNA sense strand
aaguuauauccgccuugguuu

SEQ ID NO: 18825 - RNA, 21 nt, Artificial Sequence
  Ebola virus siRNA sense strand
aguuauauccgccuugguuuu

SEQ ID NO: 18826 - RNA, 21 nt, Artificial Sequence
  Ebola virus siRNA sense strand
guuauauccgccuugguuuuc

SEQ ID NO: 18827 - RNA, 21 nt, Artificial Sequence
  Ebola virus siRNA sense strand
uuauauccgccuugguuuucc

SEQ ID NO: 18828 - RNA, 21 nt, Artificial Sequence
  Ebola virus siRNA sense strand
uauauccgccuugguuuucca

SEQ ID NO: 18829 - RNA, 21 nt, Artificial Sequence
  Ebola virus siRNA sense strand
auauccgccuugguuuuccau

SEQ ID NO: 18830 - RNA, 21 nt, Artificial Sequence
  Ebola virus siRNA sense strand
uauccgccuugguuuuccauc

SEQ ID NO: 18831 - RNA, 21 nt, Artificial Sequence
  Ebola virus siRNA sense strand
auccgccuugguuuuccauca

SEQ ID NO: 18832 - RNA, 21 nt, Artificial Sequence
  Ebola virus siRNA sense strand
uccgccuugguuuuccaucau

SEQ ID NO: 18833 - RNA, 21 nt, Artificial Sequence
  Ebola virus siRNA sense strand
ccgccuugguuuuccaucauu

SEQ ID NO: 18834 - RNA, 21 nt, Artificial Sequence
  Ebola virus siRNA sense strand
cgccuugguuuuccaucauua

SEQ ID NO: 18835 - RNA, 21 nt, Artificial Sequence
  Ebola virus siRNA sense strand
gccuugguuuuccaucauuag

SEQ ID NO: 18836 - RNA, 21 nt, Artificial Sequence
  Ebola virus siRNA sense strand
ccuugguuuuccaucauuaga

SEQ ID NO: 18837 - RNA, 21 nt, Artificial Sequence
  Ebola virus siRNA sense strand
cuugguuuuccaucauuagag

SEQ ID NO: 18838 - RNA, 21 nt, Artificial Sequence
  Ebola virus siRNA sense strand
uugguuuuccaucauuagaga

SEQ ID NO: 18839 - RNA, 21 nt, Artificial Sequence
  Ebola virus siRNA sense strand
ugguuuuccaucauuagagaa

SEQ ID NO: 18840 - RNA, 21 nt, Artificial Sequence
  Ebola virus siRNA sense strand
gguuuuccaucauuagagaaa

SEQ ID NO: 18841 - RNA, 21 nt, Artificial Sequence
  Ebola virus siRNA sense strand
guuuuccaucauuagagaaag

SEQ ID NO: 18842 - RNA, 21 nt, Artificial Sequence
  Ebola virus siRNA sense strand
uuuuccaucauuagagaaagu

SEQ ID NO: 18843 - RNA, 21 nt, Artificial Sequence
  Ebola virus siRNA sense strand
uuuccaucauuagagaaagua

SEQ ID NO: 18844 - RNA, 21 nt, Artificial Sequence
  Ebola virus siRNA sense strand
uuccaucauuagagaaaguac

SEQ ID NO: 18845 - RNA, 21 nt, Artificial Sequence
  Ebola virus siRNA sense strand
uccaucauuagagaaaguacu

SEQ ID NO: 18846 - RNA, 21 nt, Artificial Sequence
  Ebola virus siRNA sense strand
ccaucauuagagaaaguacua

SEQ ID NO: 18847 - RNA, 21 nt, Artificial Sequence
  Ebola virus siRNA sense strand
caucauuagagaaaguacuau

SEQ ID NO: 18848 - RNA, 21 nt, Artificial Sequence
  Ebola virus siRNA sense strand
aucauuagagaaaguacuaua

SEQ ID NO: 18849 - RNA, 21 nt, Artificial Sequence
  Ebola virus siRNA sense strand
ucauuagagaaaguacuauac

SEQ ID NO: 18850 - RNA, 21 nt, Artificial Sequence
  Ebola virus siRNA sense strand
cauuagagaaaguacuauacc

SEQ ID NO: 18851 - RNA, 21 nt, Artificial Sequence
  Ebola virus siRNA sense strand
auuagagaaaguacuauacca

SEQ ID NO: 18852 - RNA, 21 nt, Artificial Sequence
  Ebola virus siRNA sense strand
uuagagaaaguacuauaccac

SEQ ID NO: 18853 - RNA, 21 nt, Artificial Sequence
  Ebola virus siRNA sense strand
uagagaaaguacuauaccaca

SEQ ID NO: 18854 - RNA, 21 nt, Artificial Sequence
  Ebola virus siRNA sense strand
agagaaaguacuauaccacag

SEQ ID NO: 18855 - RNA, 21 nt, Artificial Sequence
  Ebola virus siRNA sense strand
gagaaaguacuauaccacagg

SEQ ID NO: 18856 - RNA, 21 nt, Artificial Sequence
  Ebola virus siRNA sense strand
agaaaguacuauaccacaggu

SEQ ID NO: 18857 - RNA, 21 nt, Artificial Sequence
  Ebola virus siRNA sense strand
gaaaguacuauaccacaggua

SEQ ID NO: 18858 - RNA, 21 nt, Artificial Sequence
  Ebola virus siRNA sense strand
aaaguacuauaccacagguau

SEQ ID NO: 18859 - RNA, 21 nt, Artificial Sequence
  Ebola virus siRNA sense strand
aaguacuauaccacagguaua

SEQ ID NO: 18860 - RNA, 21 nt, Artificial Sequence
  Ebola virus siRNA sense strand
aguacuauaccacagguauaa

SEQ ID NO: 18861 - RNA, 21 nt, Artificial Sequence
  Ebola virus siRNA sense strand
guacuauaccacagguauaac

SEQ ID NO: 18862 - RNA, 21 nt, Artificial Sequence
  Ebola virus siRNA sense strand
uacuauaccacagguauaacc

SEQ ID NO: 18863 - RNA, 21 nt, Artificial Sequence
  Ebola virus siRNA sense strand
acuauaccacagguauaaccu

SEQ ID NO: 18864 - RNA, 21 nt, Artificial Sequence
  Ebola virus siRNA sense strand
cuauaccacagguauaaccuc

SEQ ID NO: 18865 - RNA, 21 nt, Artificial Sequence
  Ebola virus siRNA sense strand
uauaccacagguauaaccucg

SEQ ID NO: 18866 - RNA, 21 nt, Artificial Sequence
  Ebola virus siRNA sense strand
auaccacagguauaaccucgu

SEQ ID NO: 18867 - RNA, 21 nt, Artificial Sequence
  Ebola virus siRNA sense strand
uaccacagguauaaccucguc

SEQ ID NO: 18868 - RNA, 21 nt, Artificial Sequence
  Ebola virus siRNA sense strand
accacagguauaaccucgucg

SEQ ID NO: 18869 - RNA, 21 nt, Artificial Sequence
  Ebola virus siRNA sense strand
ccacagguauaaccucgucga

SEQ ID NO: 18870 - RNA, 21 nt, Artificial Sequence
  Ebola virus siRNA sense strand
cacagguauaaccucgucgau

SEQ ID NO: 18871 - RNA, 21 nt, Artificial Sequence
  Ebola virus siRNA sense strand
acagguauaaccucgucgauu

SEQ ID NO: 18872 - RNA, 21 nt, Artificial Sequence
  Ebola virus siRNA sense strand
cagguauaaccucgucgauuc

SEQ ID NO: 18873 - RNA, 21 nt, Artificial Sequence
  Ebola virus siRNA sense strand
agguauaaccucgucgauuca

SEQ ID NO: 18874 - RNA, 21 nt, Artificial Sequence
  Ebola virus siRNA sense strand
gguauaaccucgucgauucaa

SEQ ID NO: 18875 - RNA, 21 nt, Artificial Sequence
  Ebola virus siRNA sense strand
guauaaccucgucgauucaaa

SEQ ID NO: 18876 - RNA, 21 nt, Artificial Sequence
  Ebola virus siRNA sense strand
uauaaccucgucgauucaaaa

SEQ ID NO: 18877 - RNA, 21 nt, Artificial Sequence
  Ebola virus siRNA sense strand
auaaccucgucgauucaaaaa

SEQ ID NO: 18878 - RNA, 21 nt, Artificial Sequence
  Ebola virus siRNA sense strand
uaaccucgucgauucaaaaag

SEQ ID NO: 18879 - RNA, 21 nt, Artificial Sequence
  Ebola virus siRNA sense strand
aaccucgucgauucaaaaaga

SEQ ID NO: 18880 - RNA, 21 nt, Artificial Sequence
  Ebola virus siRNA sense strand
accucgucgauucaaaaagag

SEQ ID NO: 18881 - RNA, 21 nt, Artificial Sequence
  Ebola virus siRNA sense strand
ccucgucgauucaaaaagagg

SEQ ID NO: 18882 - RNA, 21 nt, Artificial Sequence
  Ebola virus siRNA sense strand
cucgucgauucaaaaagaggu

SEQ ID NO: 18883 - RNA, 21 nt, Artificial Sequence
  Ebola virus siRNA sense strand
ucgucgauucaaaaagagguc

SEQ ID NO: 18884 - RNA, 21 nt, Artificial Sequence
  Ebola virus siRNA sense strand
cgucgauucaaaaagaggucc

SEQ ID NO: 18885 - RNA, 21 nt, Artificial Sequence
  Ebola virus siRNA sense strand
gucgauucaaaaagaggucca

SEQ ID NO: 18886 - RNA, 21 nt, Artificial Sequence
  Ebola virus siRNA sense strand
ucgauucaaaaagagguccac

SEQ ID NO: 18887 - RNA, 21 nt, Artificial Sequence
  Ebola virus siRNA sense strand
cgauucaaaaagagguccacu

SEQ ID NO: 18888 - RNA, 21 nt, Artificial Sequence
  Ebola virus siRNA sense strand
gauucaaaaagagguccacua

SEQ ID NO: 18889 - RNA, 21 nt, Artificial Sequence
  Ebola virus siRNA sense strand
auucaaaaagagguccacuag

SEQ ID NO: 18890 - RNA, 21 nt, Artificial Sequence
  Ebola virus siRNA sense strand
uucaaaaagagguccacuagu

SEQ ID NO: 18891 - RNA, 21 nt, Artificial Sequence
  Ebola virus siRNA sense strand
ucaaaaagagguccacuaguc

SEQ ID NO: 18892 - RNA, 21 nt, Artificial Sequence
  Ebola virus siRNA sense strand
caaaaagagguccacuagucu

SEQ ID NO: 18893 - RNA, 21 nt, Artificial Sequence
  Ebola virus siRNA sense strand
aaaaagagguccacuagucuc

SEQ ID NO: 18894 - RNA, 21 nt, Artificial Sequence
  Ebola virus siRNA sense strand
aaaagagguccacuagucucu

SEQ ID NO: 18895 - RNA, 21 nt, Artificial Sequence
  Ebola virus siRNA sense strand
aaagagguccacuagucucua

SEQ ID NO: 18896 - RNA, 21 nt, Artificial Sequence
  Ebola virus siRNA sense strand
aagagguccacuagucucuau

SEQ ID NO: 18897 - RNA, 21 nt, Artificial Sequence
  Ebola virus siRNA sense strand
agagguccacuagucucuauc

SEQ ID NO: 18898 - RNA, 21 nt, Artificial Sequence
  Ebola virus siRNA sense strand
gagguccacuagucucuauca

SEQ ID NO: 18899 - RNA, 21 nt, Artificial Sequence
  Ebola virus siRNA sense strand
agguccacuagucucuaucac

SEQ ID NO: 18900 - RNA, 21 nt, Artificial Sequence
  Ebola virus siRNA sense strand
gguccacuagucucuaucacu

SEQ ID NO: 18901 - RNA, 21 nt, Artificial Sequence
  Ebola virus siRNA sense strand
guccacuagucucuaucacuc

SEQ ID NO: 18902 - RNA, 21 nt, Artificial Sequence
  Ebola virus siRNA sense strand
uccacuagucucuaucacuca

SEQ ID NO: 18903 - RNA, 21 nt, Artificial Sequence
  Ebola virus siRNA sense strand
ccacuagucucuaucacucag

SEQ ID NO: 18904 - RNA, 21 nt, Artificial Sequence
  Ebola virus siRNA sense strand
cacuagucucuaucacucagc

SEQ ID NO: 18905 - RNA, 21 nt, Artificial Sequence
  Ebola virus siRNA sense strand
acuagucucuaucacucagca

SEQ ID NO: 18906 - RNA, 21 nt, Artificial Sequence
  Ebola virus siRNA sense strand
cuagucucuaucacucagcac

SEQ ID NO: 18907 - RNA, 21 nt, Artificial Sequence
  Ebola virus siRNA sense strand
uagucucuaucacucagcacu

SEQ ID NO: 18908 - RNA, 21 nt, Artificial Sequence
  Ebola virus siRNA sense strand
agucucuaucacucagcacuu

SEQ ID NO: 18909 - RNA, 21 nt, Artificial Sequence
  Ebola virus siRNA sense strand
gucucuaucacucagcacuua

SEQ ID NO: 18910 - RNA, 21 nt, Artificial Sequence
  Ebola virus siRNA sense strand
ucucuaucacucagcacuuag

SEQ ID NO: 18911 - RNA, 21 nt, Artificial Sequence
  Ebola virus siRNA sense strand
cucuaucacucagcacuuagc

SEQ ID NO: 18912 - RNA, 21 nt, Artificial Sequence
  Ebola virus siRNA sense strand
ucuaucacucagcacuuagca

SEQ ID NO: 18913 - RNA, 21 nt, Artificial Sequence
  Ebola virus siRNA sense strand
cuaucacucagcacuuagcac

SEQ ID NO: 18914 - RNA, 21 nt, Artificial Sequence
  Ebola virus siRNA sense strand
uaucacucagcacuuagcaca

SEQ ID NO: 18915 - RNA, 21 nt, Artificial Sequence
  Ebola virus siRNA sense strand
aucacucagcacuuagcacau

SEQ ID NO: 18916 - RNA, 21 nt, Artificial Sequence
  Ebola virus siRNA sense strand
ucacucagcacuuagcacauc

SEQ ID NO: 18917 - RNA, 21 nt, Artificial Sequence
  Ebola virus siRNA sense strand
cacucagcacuuagcacaucu

SEQ ID NO: 18918 - RNA, 21 nt, Artificial Sequence
  Ebola virus siRNA sense strand
acucagcacuuagcacaucuu

SEQ ID NO: 18919 - RNA, 21 nt, Artificial Sequence
  Ebola virus siRNA sense strand
cucagcacuuagcacaucuua

SEQ ID NO: 18920 - RNA, 21 nt, Artificial Sequence
  Ebola virus siRNA sense strand
ucagcacuuagcacaucuuag

SEQ ID NO: 18921 - RNA, 21 nt, Artificial Sequence
  Ebola virus siRNA sense strand
cagcacuuagcacaucuuaga

SEQ ID NO: 18922 - RNA, 21 nt, Artificial Sequence
  Ebola virus siRNA sense strand
agcacuuagcacaucuuagag

SEQ ID NO: 18923 - RNA, 21 nt, Artificial Sequence
  Ebola virus siRNA sense strand
gcacuuagcacaucuuagagc

SEQ ID NO: 18924 - RNA, 21 nt, Artificial Sequence
  Ebola virus siRNA sense strand
cacuuagcacaucuuagagca

SEQ ID NO: 18925 - RNA, 21 nt, Artificial Sequence
  Ebola virus siRNA sense strand
acuuagcacaucuuagagcag

SEQ ID NO: 18926 - RNA, 21 nt, Artificial Sequence
  Ebola virus siRNA sense strand
cuuagcacaucuuagagcaga

SEQ ID NO: 18927 - RNA, 21 nt, Artificial Sequence
  Ebola virus siRNA sense strand
uuagcacaucuuagagcagag

SEQ ID NO: 18928 - RNA, 21 nt, Artificial Sequence
  Ebola virus siRNA sense strand
uagcacaucuuagagcagaga

SEQ ID NO: 18929 - RNA, 21 nt, Artificial Sequence
  Ebola virus siRNA sense strand
agcacaucuuagagcagagau

SEQ ID NO: 18930 - RNA, 21 nt, Artificial Sequence
  Ebola virus siRNA sense strand
gcacaucuuagagcagagauu

SEQ ID NO: 18931 - RNA, 21 nt, Artificial Sequence
  Ebola virus siRNA sense strand
cacaucuuagagcagagauuc

SEQ ID NO: 18932 - RNA, 21 nt, Artificial Sequence
  Ebola virus siRNA sense strand
acaucuuagagcagagauucg

SEQ ID NO: 18933 - RNA, 21 nt, Artificial Sequence
  Ebola virus siRNA sense strand
caucuuagagcagagauucga

SEQ ID NO: 18934 - RNA, 21 nt, Artificial Sequence
  Ebola virus siRNA sense strand
aucuuagagcagagauucgag

SEQ ID NO: 18935 - RNA, 21 nt, Artificial Sequence
  Ebola virus siRNA sense strand
ucuuagagcagagauucgaga

SEQ ID NO: 18936 - RNA, 21 nt, Artificial Sequence
  Ebola virus siRNA sense strand
cuuagagcagagauucgagaa

SEQ ID NO: 18937 - RNA, 21 nt, Artificial Sequence
  Ebola virus siRNA sense strand
uuagagcagagauucgagaau

SEQ ID NO: 18938 - RNA, 21 nt, Artificial Sequence
  Ebola virus siRNA sense strand
uagagcagagauucgagaauu

SEQ ID NO: 18939 - RNA, 21 nt, Artificial Sequence
  Ebola virus siRNA sense strand
agagcagagauucgagaauua

SEQ ID NO: 18940 - RNA, 21 nt, Artificial Sequence
  Ebola virus siRNA sense strand
gagcagagauucgagaauuaa

SEQ ID NO: 18941 - RNA, 21 nt, Artificial Sequence
  Ebola virus siRNA sense strand
agcagagauucgagaauuaac

SEQ ID NO: 18942 - RNA, 21 nt, Artificial Sequence
  Ebola virus siRNA sense strand
gcagagauucgagaauuaacu

SEQ ID NO: 18943 - RNA, 21 nt, Artificial Sequence
  Ebola virus siRNA sense strand
cagagauucgagaauuaacua

SEQ ID NO: 18944 - RNA, 21 nt, Artificial Sequence
  Ebola virus siRNA sense strand
agagauucgagaauuaacuaa

SEQ ID NO: 18945 - RNA, 21 nt, Artificial Sequence
  Ebola virus siRNA sense strand
gagauucgagaauuaacuaau

SEQ ID NO: 18946 - RNA, 21 nt, Artificial Sequence
  Ebola virus siRNA sense strand
agauucgagaauuaacuaaug

SEQ ID NO: 18947 - RNA, 21 nt, Artificial Sequence
  Ebola virus siRNA sense strand
gauucgagaauuaacuaauga

SEQ ID NO: 18948 - RNA, 21 nt, Artificial Sequence
  Ebola virus siRNA sense strand
auucgagaauuaacuaaugau

SEQ ID NO: 18949 - RNA, 21 nt, Artificial Sequence
  Ebola virus siRNA sense strand
uucgagaauuaacuaaugauu

SEQ ID NO: 18950 - RNA, 21 nt, Artificial Sequence
  Ebola virus siRNA sense strand
ucgagaauuaacuaaugauua

SEQ ID NO: 18951 - RNA, 21 nt, Artificial Sequence
  Ebola virus siRNA sense strand
cgagaauuaacuaaugauuau

SEQ ID NO: 18952 - RNA, 21 nt, Artificial Sequence
  Ebola virus siRNA sense strand
gagaauuaacuaaugauuaua

SEQ ID NO: 18953 - RNA, 21 nt, Artificial Sequence
  Ebola virus siRNA sense strand
agaauuaacuaaugauuauaa

SEQ ID NO: 18954 - RNA, 21 nt, Artificial Sequence
  Ebola virus siRNA sense strand
gaauuaacuaaugauuauaau

SEQ ID NO: 18955 - RNA, 21 nt, Artificial Sequence
  Ebola virus siRNA sense strand
aauuaacuaaugauuauaauc

SEQ ID NO: 18956 - RNA, 21 nt, Artificial Sequence
  Ebola virus siRNA sense strand
auuaacuaaugauuauaauca

SEQ ID NO: 18957 - RNA, 21 nt, Artificial Sequence
  Ebola virus siRNA sense strand
uuaacuaaugauuauaaucaa

SEQ ID NO: 18958 - RNA, 21 nt, Artificial Sequence
  Ebola virus siRNA sense strand
uaacuaaugauuauaaucaac

SEQ ID NO: 18959 - RNA, 21 nt, Artificial Sequence
  Ebola virus siRNA sense strand
aacuaaugauuauaaucaaca

SEQ ID NO: 18960 - RNA, 21 nt, Artificial Sequence
  Ebola virus siRNA sense strand
acuaaugauuauaaucaacag

SEQ ID NO: 18961 - RNA, 21 nt, Artificial Sequence
  Ebola virus siRNA sense strand
cuaaugauuauaaucaacagc

SEQ ID NO: 18962 - RNA, 21 nt, Artificial Sequence
  Ebola virus siRNA sense strand
uaaugauuauaaucaacagcg

SEQ ID NO: 18963 - RNA, 21 nt, Artificial Sequence
  Ebola virus siRNA sense strand
aaugauuauaaucaacagcga

SEQ ID NO: 18964 - RNA, 21 nt, Artificial Sequence
  Ebola virus siRNA sense strand
augauuauaaucaacagcgac

SEQ ID NO: 18965 - RNA, 21 nt, Artificial Sequence
  Ebola virus siRNA sense strand
ugauuauaaucaacagcgaca

SEQ ID NO: 18966 - RNA, 21 nt, Artificial Sequence
  Ebola virus siRNA sense strand
gauuauaaucaacagcgacaa

SEQ ID NO: 18967 - RNA, 21 nt, Artificial Sequence
  Ebola virus siRNA sense strand
auuauaaucaacagcgacaaa

SEQ ID NO: 18968 - RNA, 21 nt, Artificial Sequence
  Ebola virus siRNA sense strand
uuauaaucaacagcgacaaag

SEQ ID NO: 18969 - RNA, 21 nt, Artificial Sequence
  Ebola virus siRNA sense strand
uauaaucaacagcgacaaagu

SEQ ID NO: 18970 - RNA, 21 nt, Artificial Sequence
  Ebola virus siRNA sense strand
auaaucaacagcgacaaaguc

SEQ ID NO: 18971 - RNA, 21 nt, Artificial Sequence
  Ebola virus siRNA sense strand
uaaucaacagcgacaaagucg

SEQ ID NO: 18972 - RNA, 21 nt, Artificial Sequence
  Ebola virus siRNA sense strand
aaucaacagcgacaaagucgg

SEQ ID NO: 18973 - RNA, 21 nt, Artificial Sequence
  Ebola virus siRNA sense strand
aucaacagcgacaaagucgga

SEQ ID NO: 18974 - RNA, 21 nt, Artificial Sequence
  Ebola virus siRNA sense strand
ucaacagcgacaaagucggac

SEQ ID NO: 18975 - RNA, 21 nt, Artificial Sequence
  Ebola virus siRNA sense strand
caacagcgacaaagucggacu

SEQ ID NO: 18976 - RNA, 21 nt, Artificial Sequence
  Ebola virus siRNA sense strand
aacagcgacaaagucggacuc

SEQ ID NO: 18977 - RNA, 21 nt, Artificial Sequence
  Ebola virus siRNA sense strand
acagcgacaaagucggacuca

SEQ ID NO: 18978 - RNA, 21 nt, Artificial Sequence
  Ebola virus siRNA sense strand
cagcgacaaagucggacucaa

SEQ ID NO: 18979 - RNA, 21 nt, Artificial Sequence
  Ebola virus siRNA sense strand
agcgacaaagucggacucaaa

SEQ ID NO: 18980 - RNA, 21 nt, Artificial Sequence
  Ebola virus siRNA sense strand
gcgacaaagucggacucaaac

SEQ ID NO: 18981 - RNA, 21 nt, Artificial Sequence
  Ebola virus siRNA sense strand
cgacaaagucggacucaaaca

SEQ ID NO: 18982 - RNA, 21 nt, Artificial Sequence
  Ebola virus siRNA sense strand
gacaaagucggacucaaacau

SEQ ID NO: 18983 - RNA, 21 nt, Artificial Sequence
  Ebola virus siRNA sense strand
acaaagucggacucaaacaua

SEQ ID NO: 18984 - RNA, 21 nt, Artificial Sequence
  Ebola virus siRNA sense strand
caaagucggacucaaacauau

SEQ ID NO: 18985 - RNA, 21 nt, Artificial Sequence
  Ebola virus siRNA sense strand
aaagucggacucaaacauauc

SEQ ID NO: 18986 - RNA, 21 nt, Artificial Sequence
  Ebola virus siRNA sense strand
aagucggacucaaacauauca

SEQ ID NO: 18987 - RNA, 21 nt, Artificial Sequence
  Ebola virus siRNA sense strand
agucggacucaaacauaucac

SEQ ID NO: 18988 - RNA, 21 nt, Artificial Sequence
  Ebola virus siRNA sense strand
gucggacucaaacauaucacu

SEQ ID NO: 18989 - RNA, 21 nt, Artificial Sequence
  Ebola virus siRNA sense strand
ucggacucaaacauaucacuu

SEQ ID NO: 18990 - RNA, 21 nt, Artificial Sequence
  Ebola virus siRNA sense strand
cggacucaaacauaucacuuu

SEQ ID NO: 18991 - RNA, 21 nt, Artificial Sequence
  Ebola virus siRNA sense strand
ggacucaaacauaucacuuua

SEQ ID NO: 18992 - RNA, 21 nt, Artificial Sequence
  Ebola virus siRNA sense strand
gacucaaacauaucacuuuau

SEQ ID NO: 18993 - RNA, 21 nt, Artificial Sequence
  Ebola virus siRNA sense strand
acucaaacauaucacuuuauu

SEQ ID NO: 18994 - RNA, 21 nt, Artificial Sequence
  Ebola virus siRNA sense strand
cucaaacauaucacuuuauuc

SEQ ID NO: 18995 - RNA, 21 nt, Artificial Sequence
  Ebola virus siRNA sense strand
ucaaacauaucacuuuauucg

SEQ ID NO: 18996 - RNA, 21 nt, Artificial Sequence
  Ebola virus siRNA sense strand
caaacauaucacuuuauucgu

SEQ ID NO: 18997 - RNA, 21 nt, Artificial Sequence
  Ebola virus siRNA sense strand
aaacauaucacuuuauucgua

SEQ ID NO: 18998 - RNA, 21 nt, Artificial Sequence
  Ebola virus siRNA sense strand
aacauaucacuuuauucguac

SEQ ID NO: 18999 - RNA, 21 nt, Artificial Sequence
  Ebola virus siRNA sense strand
acauaucacuuuauucguacu

SEQ ID NO: 19000 - RNA, 21 nt, Artificial Sequence
  Ebola virus siRNA sense strand
cauaucacuuuauucguacug

SEQ ID NO: 19001 - RNA, 21 nt, Artificial Sequence
  Ebola virus siRNA sense strand
auaucacuuuauucguacugc

SEQ ID NO: 19002 - RNA, 21 nt, Artificial Sequence
  Ebola virus siRNA sense strand
uaucacuuuauucguacugca

SEQ ID NO: 19003 - RNA, 21 nt, Artificial Sequence
  Ebola virus siRNA sense strand
aucacuuuauucguacugcaa

SEQ ID NO: 19004 - RNA, 21 nt, Artificial Sequence
  Ebola virus siRNA sense strand
ucacuuuauucguacugcaaa

SEQ ID NO: 19005 - RNA, 21 nt, Artificial Sequence
  Ebola virus siRNA sense strand
cacuuuauucguacugcaaaa

SEQ ID NO: 19006 - RNA, 21 nt, Artificial Sequence
  Ebola virus siRNA sense strand
acuuuauucguacugcaaaag

SEQ ID NO: 19007 - RNA, 21 nt, Artificial Sequence
  Ebola virus siRNA sense strand
cuuuauucguacugcaaaagg

SEQ ID NO: 19008 - RNA, 21 nt, Artificial Sequence
  Ebola virus siRNA sense strand
uuuauucguacugcaaaagga

SEQ ID NO: 19009 - RNA, 21 nt, Artificial Sequence
  Ebola virus siRNA sense strand
uuauucguacugcaaaaggac

SEQ ID NO: 19010 - RNA, 21 nt, Artificial Sequence
  Ebola virus siRNA sense strand
uauucguacugcaaaaggacg

SEQ ID NO: 19011 - RNA, 21 nt, Artificial Sequence
  Ebola virus siRNA sense strand
auucguacugcaaaaggacga

SEQ ID NO: 19012 - RNA, 21 nt, Artificial Sequence
  Ebola virus siRNA sense strand
uucguacugcaaaaggacgaa

SEQ ID NO: 19013 - RNA, 21 nt, Artificial Sequence
  Ebola virus siRNA sense strand
ucguacugcaaaaggacgaau

SEQ ID NO: 19014 - RNA, 21 nt, Artificial Sequence
  Ebola virus siRNA sense strand
cguacugcaaaaggacgaauc

SEQ ID NO: 19015 - RNA, 21 nt, Artificial Sequence
  Ebola virus siRNA sense strand
guacugcaaaaggacgaauca

SEQ ID NO: 19016 - RNA, 21 nt, Artificial Sequence
  Ebola virus siRNA sense strand
uacugcaaaaggacgaaucac

SEQ ID NO: 19017 - RNA, 21 nt, Artificial Sequence
  Ebola virus siRNA sense strand
acugcaaaaggacgaaucaca

SEQ ID NO: 19018 - RNA, 21 nt, Artificial Sequence
  Ebola virus siRNA sense strand
cugcaaaaggacgaaucacaa

SEQ ID NO: 19019 - RNA, 21 nt, Artificial Sequence
  Ebola virus siRNA sense strand
ugcaaaaggacgaaucacaaa

SEQ ID NO: 19020 - RNA, 21 nt, Artificial Sequence
  Ebola virus siRNA sense strand
gcaaaaggacgaaucacaaaa

SEQ ID NO: 19021 - RNA, 21 nt, Artificial Sequence
  Ebola virus siRNA sense strand
caaaaggacgaaucacaaaac

SEQ ID NO: 19022 - RNA, 21 nt, Artificial Sequence
  Ebola virus siRNA sense strand
aaaaggacgaaucacaaaacu

SEQ ID NO: 19023 - RNA, 21 nt, Artificial Sequence
  Ebola virus siRNA sense strand
aaaggacgaaucacaaaacua

SEQ ID NO: 19024 - RNA, 21 nt, Artificial Sequence
  Ebola virus siRNA sense strand
aaggacgaaucacaaaacuag

SEQ ID NO: 19025 - RNA, 21 nt, Artificial Sequence
  Ebola virus siRNA sense strand
aggacgaaucacaaaacuagu

SEQ ID NO: 19026 - RNA, 21 nt, Artificial Sequence
  Ebola virus siRNA sense strand
ggacgaaucacaaaacuaguc

SEQ ID NO: 19027 - RNA, 21 nt, Artificial Sequence
  Ebola virus siRNA sense strand
gacgaaucacaaaacuaguca

SEQ ID NO: 19028 - RNA, 21 nt, Artificial Sequence
  Ebola virus siRNA sense strand
acgaaucacaaaacuagucaa

SEQ ID NO: 19029 - RNA, 21 nt, Artificial Sequence
  Ebola virus siRNA sense strand
cgaaucacaaaacuagucaau

SEQ ID NO: 19030 - RNA, 21 nt, Artificial Sequence
  Ebola virus siRNA sense strand
gaaucacaaaacuagucaaug

SEQ ID NO: 19031 - RNA, 21 nt, Artificial Sequence
  Ebola virus siRNA sense strand
aaucacaaaacuagucaauga

SEQ ID NO: 19032 - RNA, 21 nt, Artificial Sequence
  Ebola virus siRNA sense strand
aucacaaaacuagucaaugau

SEQ ID NO: 19033 - RNA, 21 nt, Artificial Sequence
  Ebola virus siRNA sense strand
ucacaaaacuagucaaugauu

SEQ ID NO: 19034 - RNA, 21 nt, Artificial Sequence
  Ebola virus siRNA sense strand
cacaaaacuagucaaugauua

SEQ ID NO: 19035 - RNA, 21 nt, Artificial Sequence
  Ebola virus siRNA sense strand
acaaaacuagucaaugauuau

SEQ ID NO: 19036 - RNA, 21 nt, Artificial Sequence
  Ebola virus siRNA sense strand
caaaacuagucaaugauuauu

SEQ ID NO: 19037 - RNA, 21 nt, Artificial Sequence
  Ebola virus siRNA sense strand
aaaacuagucaaugauuauuu

SEQ ID NO: 19038 - RNA, 21 nt, Artificial Sequence
  Ebola virus siRNA sense strand
aaacuagucaaugauuauuua

SEQ ID NO: 19039 - RNA, 21 nt, Artificial Sequence
  Ebola virus siRNA sense strand
aacuagucaaugauuauuuaa

SEQ ID NO: 19040 - RNA, 21 nt, Artificial Sequence
  Ebola virus siRNA sense strand
acuagucaaugauuauuuaaa

SEQ ID NO: 19041 - RNA, 21 nt, Artificial Sequence
  Ebola virus siRNA sense strand
cuagucaaugauuauuuaaaa

SEQ ID NO: 19042 - RNA, 21 nt, Artificial Sequence
  Ebola virus siRNA sense strand
uagucaaugauuauuuaaaau

SEQ ID NO: 19043 - RNA, 21 nt, Artificial Sequence
  Ebola virus siRNA sense strand
agucaaugauuauuuaaaauu

SEQ ID NO: 19044 - RNA, 21 nt, Artificial Sequence
  Ebola virus siRNA sense strand
gucaaugauuauuuaaaauuc

SEQ ID NO: 19045 - RNA, 21 nt, Artificial Sequence
  Ebola virus siRNA sense strand
ucaaugauuauuuaaaauucu

SEQ ID NO: 19046 - RNA, 21 nt, Artificial Sequence
  Ebola virus siRNA sense strand
caaugauuauuuaaaauucuu

SEQ ID NO: 19047 - RNA, 21 nt, Artificial Sequence
  Ebola virus siRNA sense strand
aaugauuauuuaaaauucuuu

SEQ ID NO: 19048 - RNA, 21 nt, Artificial Sequence
  Ebola virus siRNA sense strand
augauuauuuaaaauucuuuc

SEQ ID NO: 19049 - RNA, 21 nt, Artificial Sequence
  Ebola virus siRNA sense strand
ugauuauuuaaaauucuuucu

SEQ ID NO: 19050 - RNA, 21 nt, Artificial Sequence
  Ebola virus siRNA sense strand
gauuauuuaaaauucuuucuu

SEQ ID NO: 19051 - RNA, 21 nt, Artificial Sequence
  Ebola virus siRNA sense strand
auuauuuaaaauucuuucuua

SEQ ID NO: 19052 - RNA, 21 nt, Artificial Sequence
  Ebola virus siRNA sense strand
uuauuuaaaauucuuucuuau

SEQ ID NO: 19053 - RNA, 21 nt, Artificial Sequence
  Ebola virus siRNA sense strand
uauuuaaaauucuuucuuauu

SEQ ID NO: 19054 - RNA, 21 nt, Artificial Sequence
  Ebola virus siRNA sense strand
auuuaaaauucuuucuuauug

SEQ ID NO: 19055 - RNA, 21 nt, Artificial Sequence
  Ebola virus siRNA sense strand
uuuaaaauucuuucuuauugu

SEQ ID NO: 19056 - RNA, 21 nt, Artificial Sequence
  Ebola virus siRNA sense strand
uuaaaauucuuucuuauugug

SEQ ID NO: 19057 - RNA, 21 nt, Artificial Sequence
  Ebola virus siRNA sense strand
uaaaauucuuucuuauugugc

SEQ ID NO: 19058 - RNA, 21 nt, Artificial Sequence
  Ebola virus siRNA sense strand
aaaauucuuucuuauugugca

SEQ ID NO: 19059 - RNA, 21 nt, Artificial Sequence
  Ebola virus siRNA sense strand
aaauucuuucuuauugugcaa

SEQ ID NO: 19060 - RNA, 21 nt, Artificial Sequence
  Ebola virus siRNA sense strand
aauucuuucuuauugugcaag

SEQ ID NO: 19061 - RNA, 21 nt, Artificial Sequence
  Ebola virus siRNA sense strand
auucuuucuuauugugcaagc

SEQ ID NO: 19062 - RNA, 21 nt, Artificial Sequence
  Ebola virus siRNA sense strand
uucuuucuuauugugcaagca

SEQ ID NO: 19063 - RNA, 21 nt, Artificial Sequence
  Ebola virus siRNA sense strand
ucuuucuuauugugcaagcau

SEQ ID NO: 19064 - RNA, 21 nt, Artificial Sequence
  Ebola virus siRNA sense strand
cuuucuuauugugcaagcauu

SEQ ID NO: 19065 - RNA, 21 nt, Artificial Sequence
  Ebola virus siRNA sense strand
uuucuuauugugcaagcauua

SEQ ID NO: 19066 - RNA, 21 nt, Artificial Sequence
  Ebola virus siRNA sense strand
uucuuauugugcaagcauuaa

SEQ ID NO: 19067 - RNA, 21 nt, Artificial Sequence
  Ebola virus siRNA sense strand
ucuuauugugcaagcauuaaa

SEQ ID NO: 19068 - RNA, 21 nt, Artificial Sequence
  Ebola virus siRNA sense strand
cuuauugugcaagcauuaaaa

SEQ ID NO: 19069 - RNA, 21 nt, Artificial Sequence
  Ebola virus siRNA sense strand
uuauugugcaagcauuaaaac

SEQ ID NO: 19070 - RNA, 21 nt, Artificial Sequence
  Ebola virus siRNA sense strand
uauugugcaagcauuaaaaca

SEQ ID NO: 19071 - RNA, 21 nt, Artificial Sequence
  Ebola virus siRNA sense strand
auugugcaagcauuaaaacau

SEQ ID NO: 19072 - RNA, 21 nt, Artificial Sequence
  Ebola virus siRNA sense strand
uugugcaagcauuaaaacaua

SEQ ID NO: 19073 - RNA, 21 nt, Artificial Sequence
  Ebola virus siRNA sense strand
ugugcaagcauuaaaacauaa

SEQ ID NO: 19074 - RNA, 21 nt, Artificial Sequence
  Ebola virus siRNA sense strand
gugcaagcauuaaaacauaau

SEQ ID NO: 19075 - RNA, 21 nt, Artificial Sequence
  Ebola virus siRNA sense strand
ugcaagcauuaaaacauaaug

SEQ ID NO: 19076 - RNA, 21 nt, Artificial Sequence
  Ebola virus siRNA sense strand
gcaagcauuaaaacauaaugg

SEQ ID NO: 19077 - RNA, 21 nt, Artificial Sequence
  Ebola virus siRNA sense strand
caagcauuaaaacauaauggg

SEQ ID NO: 19078 - RNA, 21 nt, Artificial Sequence
  Ebola virus siRNA sense strand
aagcauuaaaacauaauggga

SEQ ID NO: 19079 - RNA, 21 nt, Artificial Sequence
  Ebola virus siRNA sense strand
agcauuaaaacauaaugggac

SEQ ID NO: 19080 - RNA, 21 nt, Artificial Sequence
  Ebola virus siRNA sense strand
gcauuaaaacauaaugggaca

SEQ ID NO: 19081 - RNA, 21 nt, Artificial Sequence
  Ebola virus siRNA sense strand
cauuaaaacauaaugggacau

SEQ ID NO: 19082 - RNA, 21 nt, Artificial Sequence
  Ebola virus siRNA sense strand
auuaaaacauaaugggacaug

SEQ ID NO: 19083 - RNA, 21 nt, Artificial Sequence
  Ebola virus siRNA sense strand
uuaaaacauaaugggacaugg

SEQ ID NO: 19084 - RNA, 21 nt, Artificial Sequence
  Ebola virus siRNA sense strand
uaaaacauaaugggacauggc

SEQ ID NO: 19085 - RNA, 21 nt, Artificial Sequence
  Ebola virus siRNA sense strand
aaaacauaaugggacauggca

SEQ ID NO: 19086 - RNA, 21 nt, Artificial Sequence
  Ebola virus siRNA sense strand
aaacauaaugggacauggcaa

SEQ ID NO: 19087 - RNA, 21 nt, Artificial Sequence
  Ebola virus siRNA sense strand
aacauaaugggacauggcaag

SEQ ID NO: 19088 - RNA, 21 nt, Artificial Sequence
  Ebola virus siRNA sense strand
acauaaugggacauggcaagc

SEQ ID NO: 19089 - RNA, 21 nt, Artificial Sequence
  Ebola virus siRNA sense strand
cauaaugggacauggcaagcu

SEQ ID NO: 19090 - RNA, 21 nt, Artificial Sequence
  Ebola virus siRNA sense strand
auaaugggacauggcaagcug

SEQ ID NO: 19091 - RNA, 21 nt, Artificial Sequence
  Ebola virus siRNA sense strand
uaaugggacauggcaagcuga

SEQ ID NO: 19092 - RNA, 21 nt, Artificial Sequence
  Ebola virus siRNA sense strand
aaugggacauggcaagcugag

SEQ ID NO: 19093 - RNA, 21 nt, Artificial Sequence
  Ebola virus siRNA sense strand
augggacauggcaagcugagu

SEQ ID NO: 19094 - RNA, 21 nt, Artificial Sequence
  Ebola virus siRNA sense strand
ugggacauggcaagcugaguu

SEQ ID NO: 19095 - RNA, 21 nt, Artificial Sequence
  Ebola virus siRNA sense strand
gggacauggcaagcugaguuu

SEQ ID NO: 19096 - RNA, 21 nt, Artificial Sequence
  Ebola virus siRNA sense strand
ggacauggcaagcugaguuua

SEQ ID NO: 19097 - RNA, 21 nt, Artificial Sequence
  Ebola virus siRNA sense strand
gacauggcaagcugaguuuaa

SEQ ID NO: 19098 - RNA, 21 nt, Artificial Sequence
  Ebola virus siRNA sense strand
acauggcaagcugaguuuaag

SEQ ID NO: 19099 - RNA, 21 nt, Artificial Sequence
  Ebola virus siRNA sense strand
cauggcaagcugaguuuaaga

SEQ ID NO: 19100 - RNA, 21 nt, Artificial Sequence
  Ebola virus siRNA sense strand
auggcaagcugaguuuaagaa

SEQ ID NO: 19101 - RNA, 21 nt, Artificial Sequence
  Ebola virus siRNA sense strand
uggcaagcugaguuuaagaaa

SEQ ID NO: 19102 - RNA, 21 nt, Artificial Sequence
  Ebola virus siRNA sense strand
ggcaagcugaguuuaagaaau

SEQ ID NO: 19103 - RNA, 21 nt, Artificial Sequence
  Ebola virus siRNA sense strand
gcaagcugaguuuaagaaauu

SEQ ID NO: 19104 - RNA, 21 nt, Artificial Sequence
  Ebola virus siRNA sense strand
caagcugaguuuaagaaauua

SEQ ID NO: 19105 - RNA, 21 nt, Artificial Sequence
  Ebola virus siRNA sense strand
aagcugaguuuaagaaauuac

SEQ ID NO: 19106 - RNA, 21 nt, Artificial Sequence
  Ebola virus siRNA sense strand
agcugaguuuaagaaauuacc

SEQ ID NO: 19107 - RNA, 21 nt, Artificial Sequence
  Ebola virus siRNA sense strand
gcugaguuuaagaaauuacca

SEQ ID NO: 19108 - RNA, 21 nt, Artificial Sequence
  Ebola virus siRNA sense strand
cugaguuuaagaaauuaccag

SEQ ID NO: 19109 - RNA, 21 nt, Artificial Sequence
  Ebola virus siRNA sense strand
ugaguuuaagaaauuaccaga

SEQ ID NO: 19110 - RNA, 21 nt, Artificial Sequence
  Ebola virus siRNA sense strand
gaguuuaagaaauuaccagag

SEQ ID NO: 19111 - RNA, 21 nt, Artificial Sequence
  Ebola virus siRNA sense strand
aguuuaagaaauuaccagagu

SEQ ID NO: 19112 - RNA, 21 nt, Artificial Sequence
  Ebola virus siRNA sense strand
guuuaagaaauuaccagaguu

SEQ ID NO: 19113 - RNA, 21 nt, Artificial Sequence
  Ebola virus siRNA sense strand
uuuaagaaauuaccagaguug

SEQ ID NO: 19114 - RNA, 21 nt, Artificial Sequence
  Ebola virus siRNA sense strand
uuaagaaauuaccagaguuga

SEQ ID NO: 19115 - RNA, 21 nt, Artificial Sequence
  Ebola virus siRNA sense strand
uaagaaauuaccagaguugau

SEQ ID NO: 19116 - RNA, 21 nt, Artificial Sequence
  Ebola virus siRNA sense strand
aagaaauuaccagaguugauu

SEQ ID NO: 19117 - RNA, 21 nt, Artificial Sequence
  Ebola virus siRNA sense strand
agaaauuaccagaguugauua

SEQ ID NO: 19118 - RNA, 21 nt, Artificial Sequence
  Ebola virus siRNA sense strand
gaaauuaccagaguugauuag

SEQ ID NO: 19119 - RNA, 21 nt, Artificial Sequence
  Ebola virus siRNA sense strand
aaauuaccagaguugauuagu

SEQ ID NO: 19120 - RNA, 21 nt, Artificial Sequence
  Ebola virus siRNA sense strand
aauuaccagaguugauuagug

SEQ ID NO: 19121 - RNA, 21 nt, Artificial Sequence
  Ebola virus siRNA sense strand
auuaccagaguugauuagugu

SEQ ID NO: 19122 - RNA, 21 nt, Artificial Sequence
  Ebola virus siRNA sense strand
uuaccagaguugauuagugug

SEQ ID NO: 19123 - RNA, 21 nt, Artificial Sequence
  Ebola virus siRNA sense strand
uaccagaguugauuagugugu

SEQ ID NO: 19124 - RNA, 21 nt, Artificial Sequence
  Ebola virus siRNA sense strand
accagaguugauuagugugug

SEQ ID NO: 19125 - RNA, 21 nt, Artificial Sequence
  Ebola virus siRNA sense strand
ccagaguugauuagugugugc

SEQ ID NO: 19126 - RNA, 21 nt, Artificial Sequence
  Ebola virus siRNA sense strand
cagaguugauuagugugugca

SEQ ID NO: 19127 - RNA, 21 nt, Artificial Sequence
  Ebola virus siRNA sense strand
agaguugauuagugugugcaa

SEQ ID NO: 19128 - RNA, 21 nt, Artificial Sequence
  Ebola virus siRNA sense strand
gaguugauuagugugugcaau

SEQ ID NO: 19129 - RNA, 21 nt, Artificial Sequence
  Ebola virus siRNA sense strand
aguugauuagugugugcaaua

SEQ ID NO: 19130 - RNA, 21 nt, Artificial Sequence
  Ebola virus siRNA sense strand
guugauuagugugugcaauag

SEQ ID NO: 19131 - RNA, 21 nt, Artificial Sequence
  Ebola virus siRNA sense strand
uugauuagugugugcaauagg

SEQ ID NO: 19132 - RNA, 21 nt, Artificial Sequence
  Ebola virus siRNA sense strand
ugauuagugugugcaauaggu

SEQ ID NO: 19133 - RNA, 21 nt, Artificial Sequence
  Ebola virus siRNA sense strand
gauuagugugugcaauagguu

SEQ ID NO: 19134 - RNA, 21 nt, Artificial Sequence
  Ebola virus siRNA sense strand
auuagugugugcaauagguuc

SEQ ID NO: 19135 - RNA, 21 nt, Artificial Sequence
  Ebola virus siRNA sense strand
uuagugugugcaauagguucu

SEQ ID NO: 19136 - RNA, 21 nt, Artificial Sequence
  Ebola virus siRNA sense strand
uagugugugcaauagguucua

SEQ ID NO: 19137 - RNA, 21 nt, Artificial Sequence
  Ebola virus siRNA sense strand
agugugugcaauagguucuac

SEQ ID NO: 19138 - RNA, 21 nt, Artificial Sequence
  Ebola virus siRNA sense strand
gugugugcaauagguucuacc

SEQ ID NO: 19139 - RNA, 21 nt, Artificial Sequence
  Ebola virus siRNA sense strand
ugugugcaauagguucuacca

SEQ ID NO: 19140 - RNA, 21 nt, Artificial Sequence
  Ebola virus siRNA sense strand
gugugcaauagguucuaccau

SEQ ID NO: 19141 - RNA, 21 nt, Artificial Sequence
  Ebola virus siRNA sense strand
ugugcaauagguucuaccaua

SEQ ID NO: 19142 - RNA, 21 nt, Artificial Sequence
  Ebola virus siRNA sense strand
gugcaauagguucuaccauau

SEQ ID NO: 19143 - RNA, 21 nt, Artificial Sequence
  Ebola virus siRNA sense strand
ugcaauagguucuaccauauu

SEQ ID NO: 19144 - RNA, 21 nt, Artificial Sequence
  Ebola virus siRNA sense strand
gcaauagguucuaccauauua

SEQ ID NO: 19145 - RNA, 21 nt, Artificial Sequence
  Ebola virus siRNA sense strand
caauagguucuaccauauuag

SEQ ID NO: 19146 - RNA, 21 nt, Artificial Sequence
  Ebola virus siRNA sense strand
aauagguucuaccauauuaga

SEQ ID NO: 19147 - RNA, 21 nt, Artificial Sequence
  Ebola virus siRNA sense strand
auagguucuaccauauuagag

SEQ ID NO: 19148 - RNA, 21 nt, Artificial Sequence
  Ebola virus siRNA sense strand
uagguucuaccauauuagaga

SEQ ID NO: 19149 - RNA, 21 nt, Artificial Sequence
  Ebola virus siRNA sense strand
agguucuaccauauuagagau

SEQ ID NO: 19150 - RNA, 21 nt, Artificial Sequence
  Ebola virus siRNA sense strand
gguucuaccauauuagagauu

SEQ ID NO: 19151 - RNA, 21 nt, Artificial Sequence
  Ebola virus siRNA sense strand
guucuaccauauuagagauug

SEQ ID NO: 19152 - RNA, 21 nt, Artificial Sequence
  Ebola virus siRNA sense strand
uucuaccauauuagagauugc

SEQ ID NO: 19153 - RNA, 21 nt, Artificial Sequence
  Ebola virus siRNA sense strand
ucuaccauauuagagauugca

SEQ ID NO: 19154 - RNA, 21 nt, Artificial Sequence
  Ebola virus siRNA sense strand
cuaccauauuagagauugcaa

SEQ ID NO: 19155 - RNA, 21 nt, Artificial Sequence
  Ebola virus siRNA sense strand
uaccauauuagagauugcaau

SEQ ID NO: 19156 - RNA, 21 nt, Artificial Sequence
  Ebola virus siRNA sense strand
accauauuagagauugcaauu

SEQ ID NO: 19157 - RNA, 21 nt, Artificial Sequence
  Ebola virus siRNA sense strand
ccauauuagagauugcaauug

SEQ ID NO: 19158 - RNA, 21 nt, Artificial Sequence
  Ebola virus siRNA sense strand
cauauuagagauugcaauugu

SEQ ID NO: 19159 - RNA, 21 nt, Artificial Sequence
  Ebola virus siRNA sense strand
auauuagagauugcaauugug

SEQ ID NO: 19160 - RNA, 21 nt, Artificial Sequence
  Ebola virus siRNA sense strand
uauuagagauugcaauuguga

SEQ ID NO: 19161 - RNA, 21 nt, Artificial Sequence
  Ebola virus siRNA sense strand
auuagagauugcaauugugaa

SEQ ID NO: 19162 - RNA, 21 nt, Artificial Sequence
  Ebola virus siRNA sense strand
uuagagauugcaauugugaag

SEQ ID NO: 19163 - RNA, 21 nt, Artificial Sequence
  Ebola virus siRNA sense strand
uagagauugcaauugugaaga

SEQ ID NO: 19164 - RNA, 21 nt, Artificial Sequence
  Ebola virus siRNA sense strand
agagauugcaauugugaagaa

SEQ ID NO: 19165 - RNA, 21 nt, Artificial Sequence
  Ebola virus siRNA sense strand
gagauugcaauugugaagaac

SEQ ID NO: 19166 - RNA, 21 nt, Artificial Sequence
  Ebola virus siRNA sense strand
agauugcaauugugaagaacg

SEQ ID NO: 19167 - RNA, 21 nt, Artificial Sequence
  Ebola virus siRNA sense strand
gauugcaauugugaagaacgu

SEQ ID NO: 19168 - RNA, 21 nt, Artificial Sequence
  Ebola virus siRNA sense strand
auugcaauugugaagaacguu

SEQ ID NO: 19169 - RNA, 21 nt, Artificial Sequence
  Ebola virus siRNA sense strand
uugcaauugugaagaacguuu

SEQ ID NO: 19170 - RNA, 21 nt, Artificial Sequence
  Ebola virus siRNA sense strand
ugcaauugugaagaacguuuc

SEQ ID NO: 19171 - RNA, 21 nt, Artificial Sequence
  Ebola virus siRNA sense strand
gcaauugugaagaacguuucu

SEQ ID NO: 19172 - RNA, 21 nt, Artificial Sequence
  Ebola virus siRNA sense strand
caauugugaagaacguuucuu

SEQ ID NO: 19173 - RNA, 21 nt, Artificial Sequence
  Ebola virus siRNA sense strand
aauugugaagaacguuucuua

SEQ ID NO: 19174 - RNA, 21 nt, Artificial Sequence
  Ebola virus siRNA sense strand
auugugaagaacguuucuuag

SEQ ID NO: 19175 - RNA, 21 nt, Artificial Sequence
  Ebola virus siRNA sense strand
uugugaagaacguuucuuagu

SEQ ID NO: 19176 - RNA, 21 nt, Artificial Sequence
  Ebola virus siRNA sense strand
ugugaagaacguuucuuaguu

SEQ ID NO: 19177 - RNA, 21 nt, Artificial Sequence
  Ebola virus siRNA sense strand
gugaagaacguuucuuaguuc

SEQ ID NO: 19178 - RNA, 21 nt, Artificial Sequence
  Ebola virus siRNA sense strand
ugaagaacguuucuuaguuca

SEQ ID NO: 19179 - RNA, 21 nt, Artificial Sequence
  Ebola virus siRNA sense strand
gaagaacguuucuuaguucaa

SEQ ID NO: 19180 - RNA, 21 nt, Artificial Sequence
  Ebola virus siRNA sense strand
aagaacguuucuuaguucaaa

SEQ ID NO: 19181 - RNA, 21 nt, Artificial Sequence
  Ebola virus siRNA sense strand
agaacguuucuuaguucaaac

SEQ ID NO: 19182 - RNA, 21 nt, Artificial Sequence
  Ebola virus siRNA sense strand
gaacguuucuuaguucaaacc

SEQ ID NO: 19183 - RNA, 21 nt, Artificial Sequence
  Ebola virus siRNA sense strand
aacguuucuuaguucaaaccu

SEQ ID NO: 19184 - RNA, 21 nt, Artificial Sequence
  Ebola virus siRNA sense strand
acguuucuuaguucaaaccuu

SEQ ID NO: 19185 - RNA, 21 nt, Artificial Sequence
  Ebola virus siRNA sense strand
cguuucuuaguucaaaccuua

SEQ ID NO: 19186 - RNA, 21 nt, Artificial Sequence
  Ebola virus siRNA sense strand
guuucuuaguucaaaccuuau

SEQ ID NO: 19187 - RNA, 21 nt, Artificial Sequence
  Ebola virus siRNA sense strand
uuucuuaguucaaaccuuaua

SEQ ID NO: 19188 - RNA, 21 nt, Artificial Sequence
  Ebola virus siRNA sense strand
uucuuaguucaaaccuuauau

SEQ ID NO: 19189 - RNA, 21 nt, Artificial Sequence
  Ebola virus siRNA sense strand
ucuuaguucaaaccuuauauu

SEQ ID NO: 19190 - RNA, 21 nt, Artificial Sequence
  Ebola virus siRNA sense strand
cuuaguucaaaccuuauauuu

SEQ ID NO: 19191 - RNA, 21 nt, Artificial Sequence
  Ebola virus siRNA sense strand
uuaguucaaaccuuauauuua

SEQ ID NO: 19192 - RNA, 21 nt, Artificial Sequence
  Ebola virus siRNA sense strand
uaguucaaaccuuauauuuac

SEQ ID NO: 19193 - RNA, 21 nt, Artificial Sequence
  Ebola virus siRNA sense strand
aguucaaaccuuauauuuaca

SEQ ID NO: 19194 - RNA, 21 nt, Artificial Sequence
  Ebola virus siRNA sense strand
guucaaaccuuauauuuacau

SEQ ID NO: 19195 - RNA, 21 nt, Artificial Sequence
  Ebola virus siRNA sense strand
uucaaaccuuauauuuacaua

SEQ ID NO: 19196 - RNA, 21 nt, Artificial Sequence
  Ebola virus siRNA sense strand
ucaaaccuuauauuuacauag

SEQ ID NO: 19197 - RNA, 21 nt, Artificial Sequence
  Ebola virus siRNA sense strand
caaaccuuauauuuacauaga

SEQ ID NO: 19198 - RNA, 21 nt, Artificial Sequence
  Ebola virus siRNA sense strand
aaaccuuauauuuacauagaa

SEQ ID NO: 19199 - RNA, 21 nt, Artificial Sequence
  Ebola virus siRNA sense strand
aaccuuauauuuacauagaau

SEQ ID NO: 19200 - RNA, 21 nt, Artificial Sequence
  Ebola virus siRNA sense strand
accuuauauuuacauagaaug

SEQ ID NO: 19201 - RNA, 21 nt, Artificial Sequence
  Ebola virus siRNA sense strand
ccuuauauuuacauagaaugc

SEQ ID NO: 19202 - RNA, 21 nt, Artificial Sequence
  Ebola virus siRNA sense strand
cuuauauuuacauagaaugca

SEQ ID NO: 19203 - RNA, 21 nt, Artificial Sequence
  Ebola virus siRNA sense strand
uuauauuuacauagaaugcag

SEQ ID NO: 19204 - RNA, 21 nt, Artificial Sequence
  Ebola virus siRNA sense strand
uauauuuacauagaaugcagg

SEQ ID NO: 19205 - RNA, 21 nt, Artificial Sequence
  Ebola virus siRNA sense strand
auauuuacauagaaugcagga

SEQ ID NO: 19206 - RNA, 21 nt, Artificial Sequence
  Ebola virus siRNA sense strand
uauuuacauagaaugcaggau

SEQ ID NO: 19207 - RNA, 21 nt, Artificial Sequence
  Ebola virus siRNA sense strand
auuuacauagaaugcaggauu

SEQ ID NO: 19208 - RNA, 21 nt, Artificial Sequence
  Ebola virus siRNA sense strand
uuuacauagaaugcaggauuc

SEQ ID NO: 19209 - RNA, 21 nt, Artificial Sequence
  Ebola virus siRNA sense strand
uuacauagaaugcaggauucu

SEQ ID NO: 19210 - RNA, 21 nt, Artificial Sequence
  Ebola virus siRNA sense strand
uacauagaaugcaggauucug

SEQ ID NO: 19211 - RNA, 21 nt, Artificial Sequence
  Ebola virus siRNA sense strand
acauagaaugcaggauucuga

SEQ ID NO: 19212 - RNA, 21 nt, Artificial Sequence
  Ebola virus siRNA sense strand
cauagaaugcaggauucugaa

SEQ ID NO: 19213 - RNA, 21 nt, Artificial Sequence
  Ebola virus siRNA sense strand
auagaaugcaggauucugaag

SEQ ID NO: 19214 - RNA, 21 nt, Artificial Sequence
  Ebola virus siRNA sense strand
uagaaugcaggauucugaagu

SEQ ID NO: 19215 - RNA, 21 nt, Artificial Sequence
  Ebola virus siRNA sense strand
agaaugcaggauucugaaguu

SEQ ID NO: 19216 - RNA, 21 nt, Artificial Sequence
  Ebola virus siRNA sense strand
gaaugcaggauucugaaguua

SEQ ID NO: 19217 - RNA, 21 nt, Artificial Sequence
  Ebola virus siRNA sense strand
aaugcaggauucugaaguuaa

SEQ ID NO: 19218 - RNA, 21 nt, Artificial Sequence
  Ebola virus siRNA sense strand
augcaggauucugaaguuaag

SEQ ID NO: 19219 - RNA, 21 nt, Artificial Sequence
  Ebola virus siRNA sense strand
ugcaggauucugaaguuaagc

SEQ ID NO: 19220 - RNA, 21 nt, Artificial Sequence
  Ebola virus siRNA sense strand
gcaggauucugaaguuaagcu

SEQ ID NO: 19221 - RNA, 21 nt, Artificial Sequence
  Ebola virus siRNA sense strand
caggauucugaaguuaagcuu

SEQ ID NO: 19222 - RNA, 21 nt, Artificial Sequence
  Ebola virus siRNA sense strand
aggauucugaaguuaagcuua

SEQ ID NO: 19223 - RNA, 21 nt, Artificial Sequence
  Ebola virus siRNA sense strand
ggauucugaaguuaagcuuau

SEQ ID NO: 19224 - RNA, 21 nt, Artificial Sequence
  Ebola virus siRNA sense strand
gauucugaaguuaagcuuauc

SEQ ID NO: 19225 - RNA, 21 nt, Artificial Sequence
  Ebola virus siRNA sense strand
auucugaaguuaagcuuaucg

SEQ ID NO: 19226 - RNA, 21 nt, Artificial Sequence
  Ebola virus siRNA sense strand
uucugaaguuaagcuuaucga

SEQ ID NO: 19227 - RNA, 21 nt, Artificial Sequence
  Ebola virus siRNA sense strand
ucugaaguuaagcuuaucgaa

SEQ ID NO: 19228 - RNA, 21 nt, Artificial Sequence
  Ebola virus siRNA sense strand
cugaaguuaagcuuaucgaaa

SEQ ID NO: 19229 - RNA, 21 nt, Artificial Sequence
  Ebola virus siRNA sense strand
ugaaguuaagcuuaucgaaag

SEQ ID NO: 19230 - RNA, 21 nt, Artificial Sequence
  Ebola virus siRNA sense strand
gaaguuaagcuuaucgaaagg

SEQ ID NO: 19231 - RNA, 21 nt, Artificial Sequence
  Ebola virus siRNA sense strand
aaguuaagcuuaucgaaaggc

SEQ ID NO: 19232 - RNA, 21 nt, Artificial Sequence
  Ebola virus siRNA sense strand
aguuaagcuuaucgaaaggcu

SEQ ID NO: 19233 - RNA, 21 nt, Artificial Sequence
  Ebola virus siRNA sense strand
guuaagcuuaucgaaaggcug

SEQ ID NO: 19234 - RNA, 21 nt, Artificial Sequence
  Ebola virus siRNA sense strand
uuaagcuuaucgaaaggcuga

SEQ ID NO: 19235 - RNA, 21 nt, Artificial Sequence
  Ebola virus siRNA sense strand
uaagcuuaucgaaaggcugac

SEQ ID NO: 19236 - RNA, 21 nt, Artificial Sequence
  Ebola virus siRNA sense strand
aagcuuaucgaaaggcugaca

SEQ ID NO: 19237 - RNA, 21 nt, Artificial Sequence
  Ebola virus siRNA sense strand
agcuuaucgaaaggcugacag

SEQ ID NO: 19238 - RNA, 21 nt, Artificial Sequence
  Ebola virus siRNA sense strand
gcuuaucgaaaggcugacagg

SEQ ID NO: 19239 - RNA, 21 nt, Artificial Sequence
  Ebola virus siRNA sense strand
cuuaucgaaaggcugacaggg

SEQ ID NO: 19240 - RNA, 21 nt, Artificial Sequence
  Ebola virus siRNA sense strand
uuaucgaaaggcugacagggc

SEQ ID NO: 19241 - RNA, 21 nt, Artificial Sequence
  Ebola virus siRNA sense strand
uaucgaaaggcugacagggcu

SEQ ID NO: 19242 - RNA, 21 nt, Artificial Sequence
  Ebola virus siRNA sense strand
aucgaaaggcugacagggcuu

SEQ ID NO: 19243 - RNA, 21 nt, Artificial Sequence
  Ebola virus siRNA sense strand
ucgaaaggcugacagggcuuc

SEQ ID NO: 19244 - RNA, 21 nt, Artificial Sequence
  Ebola virus siRNA sense strand
cgaaaggcugacagggcuucu

SEQ ID NO: 19245 - RNA, 21 nt, Artificial Sequence
  Ebola virus siRNA sense strand
gaaaggcugacagggcuucug

SEQ ID NO: 19246 - RNA, 21 nt, Artificial Sequence
  Ebola virus siRNA sense strand
aaaggcugacagggcuucuga

SEQ ID NO: 19247 - RNA, 21 nt, Artificial Sequence
  Ebola virus siRNA sense strand
aaggcugacagggcuucugag

SEQ ID NO: 19248 - RNA, 21 nt, Artificial Sequence
  Ebola virus siRNA sense strand
aggcugacagggcuucugagu

SEQ ID NO: 19249 - RNA, 21 nt, Artificial Sequence
  Ebola virus siRNA sense strand
ggcugacagggcuucugaguu

SEQ ID NO: 19250 - RNA, 21 nt, Artificial Sequence
  Ebola virus siRNA sense strand
gcugacagggcuucugaguuu

SEQ ID NO: 19251 - RNA, 21 nt, Artificial Sequence
  Ebola virus siRNA sense strand
cugacagggcuucugaguuua

SEQ ID NO: 19252 - RNA, 21 nt, Artificial Sequence
  Ebola virus siRNA sense strand
ugacagggcuucugaguuuau

SEQ ID NO: 19253 - RNA, 21 nt, Artificial Sequence
  Ebola virus siRNA sense strand
gacagggcuucugaguuuauu

SEQ ID NO: 19254 - RNA, 21 nt, Artificial Sequence
  Ebola virus siRNA sense strand
acagggcuucugaguuuauuu

SEQ ID NO: 19255 - RNA, 21 nt, Artificial Sequence
  Ebola virus siRNA sense strand
cagggcuucugaguuuauuuc

SEQ ID NO: 19256 - RNA, 21 nt, Artificial Sequence
  Ebola virus siRNA sense strand
agggcuucugaguuuauuucc

SEQ ID NO: 19257 - RNA, 21 nt, Artificial Sequence
  Ebola virus siRNA sense strand
gggcuucugaguuuauuuccg

SEQ ID NO: 19258 - RNA, 21 nt, Artificial Sequence
  Ebola virus siRNA sense strand
ggcuucugaguuuauuuccgg

SEQ ID NO: 19259 - RNA, 21 nt, Artificial Sequence
  Ebola virus siRNA sense strand
gcuucugaguuuauuuccgga

SEQ ID NO: 19260 - RNA, 21 nt, Artificial Sequence
  Ebola virus siRNA sense strand
cuucugaguuuauuuccggau

SEQ ID NO: 19261 - RNA, 21 nt, Artificial Sequence
  Ebola virus siRNA sense strand
uucugaguuuauuuccggaug

SEQ ID NO: 19262 - RNA, 21 nt, Artificial Sequence
  Ebola virus siRNA sense strand
ucugaguuuauuuccggaugg

SEQ ID NO: 19263 - RNA, 21 nt, Artificial Sequence
  Ebola virus siRNA sense strand
cugaguuuauuuccggauggu

SEQ ID NO: 19264 - RNA, 21 nt, Artificial Sequence
  Ebola virus siRNA sense strand
ugaguuuauuuccggaugguc

SEQ ID NO: 19265 - RNA, 21 nt, Artificial Sequence
  Ebola virus siRNA sense strand
gaguuuauuuccggauggucu

SEQ ID NO: 19266 - RNA, 21 nt, Artificial Sequence
  Ebola virus siRNA sense strand
aguuuauuuccggauggucuc

SEQ ID NO: 19267 - RNA, 21 nt, Artificial Sequence
  Ebola virus siRNA sense strand
guuuauuuccggauggucucu

SEQ ID NO: 19268 - RNA, 21 nt, Artificial Sequence
  Ebola virus siRNA sense strand
uuuauuuccggauggucucua

SEQ ID NO: 19269 - RNA, 21 nt, Artificial Sequence
  Ebola virus siRNA sense strand
uuauuuccggauggucucuac

SEQ ID NO: 19270 - RNA, 21 nt, Artificial Sequence
  Ebola virus siRNA sense strand
uauuuccggauggucucuaca

SEQ ID NO: 19271 - RNA, 21 nt, Artificial Sequence
  Ebola virus siRNA sense strand
auuuccggauggucucuacag

SEQ ID NO: 19272 - RNA, 21 nt, Artificial Sequence
  Ebola virus siRNA sense strand
uuuccggauggucucuacagg

SEQ ID NO: 19273 - RNA, 21 nt, Artificial Sequence
  Ebola virus siRNA sense strand
uuccggauggucucuacaggu

SEQ ID NO: 19274 - RNA, 21 nt, Artificial Sequence
  Ebola virus siRNA sense strand
uccggauggucucuacagguu

SEQ ID NO: 19275 - RNA, 21 nt, Artificial Sequence
  Ebola virus siRNA sense strand
ccggauggucucuacagguuu

SEQ ID NO: 19276 - RNA, 21 nt, Artificial Sequence
  Ebola virus siRNA sense strand
cggauggucucuacagguuug

SEQ ID NO: 19277 - RNA, 21 nt, Artificial Sequence
  Ebola virus siRNA sense strand
ggauggucucuacagguuuga

SEQ ID NO: 19278 - RNA, 21 nt, Artificial Sequence
  Ebola virus siRNA sense strand
gauggucucuacagguuugau

SEQ ID NO: 19279 - RNA, 21 nt, Artificial Sequence
  Ebola virus siRNA sense strand
auggucucuacagguuugauu

SEQ ID NO: 19280 - RNA, 21 nt, Artificial Sequence
  Ebola virus siRNA sense strand
uggucucuacagguuugauug

SEQ ID NO: 19281 - RNA, 21 nt, Artificial Sequence
  Ebola virus siRNA sense strand
ggucucuacagguuugauuga

SEQ ID NO: 19282 - RNA, 21 nt, Artificial Sequence
  Ebola virus siRNA sense strand
gucucuacagguuugauugaa

SEQ ID NO: 19283 - RNA, 21 nt, Artificial Sequence
  Ebola virus siRNA sense strand
ucucuacagguuugauugaau

SEQ ID NO: 19284 - RNA, 21 nt, Artificial Sequence
  Ebola virus siRNA sense strand
cucuacagguuugauugaauu

SEQ ID NO: 19285 - RNA, 21 nt, Artificial Sequence
  Ebola virus siRNA sense strand
ucuacagguuugauugaauua

SEQ ID NO: 19286 - RNA, 21 nt, Artificial Sequence
  Ebola virus siRNA sense strand
cuacagguuugauugaauuac

SEQ ID NO: 19287 - RNA, 21 nt, Artificial Sequence
  Ebola virus siRNA sense strand
uacagguuugauugaauuacc

SEQ ID NO: 19288 - RNA, 21 nt, Artificial Sequence
  Ebola virus siRNA sense strand
acagguuugauugaauuaccg

SEQ ID NO: 19289 - RNA, 21 nt, Artificial Sequence
  Ebola virus siRNA sense strand
cagguuugauugaauuaccgu

SEQ ID NO: 19290 - RNA, 21 nt, Artificial Sequence
  Ebola virus siRNA sense strand
agguuugauugaauuaccgug

SEQ ID NO: 19291 - RNA, 21 nt, Artificial Sequence
  Ebola virus siRNA sense strand
gguuugauugaauuaccgugc

SEQ ID NO: 19292 - RNA, 21 nt, Artificial Sequence
  Ebola virus siRNA sense strand
guuugauugaauuaccgugca

SEQ ID NO: 19293 - RNA, 21 nt, Artificial Sequence
  Ebola virus siRNA sense strand
uuugauugaauuaccgugcau

SEQ ID NO: 19294 - RNA, 21 nt, Artificial Sequence
  Ebola virus siRNA sense strand
uugauugaauuaccgugcaua

SEQ ID NO: 19295 - RNA, 21 nt, Artificial Sequence
  Ebola virus siRNA sense strand
ugauugaauuaccgugcauag

SEQ ID NO: 19296 - RNA, 21 nt, Artificial Sequence
  Ebola virus siRNA sense strand
gauugaauuaccgugcauagu

SEQ ID NO: 19297 - RNA, 21 nt, Artificial Sequence
  Ebola virus siRNA sense strand
auugaauuaccgugcauagua

SEQ ID NO: 19298 - RNA, 21 nt, Artificial Sequence
  Ebola virus siRNA sense strand
uugaauuaccgugcauaguau

SEQ ID NO: 19299 - RNA, 21 nt, Artificial Sequence
  Ebola virus siRNA sense strand
ugaauuaccgugcauaguauc

SEQ ID NO: 19300 - RNA, 21 nt, Artificial Sequence
  Ebola virus siRNA sense strand
gaauuaccgugcauaguaucc

SEQ ID NO: 19301 - RNA, 21 nt, Artificial Sequence
  Ebola virus siRNA sense strand
aauuaccgugcauaguauccu

SEQ ID NO: 19302 - RNA, 21 nt, Artificial Sequence
  Ebola virus siRNA sense strand
auuaccgugcauaguauccug

SEQ ID NO: 19303 - RNA, 21 nt, Artificial Sequence
  Ebola virus siRNA sense strand
uuaccgugcauaguauccuga

SEQ ID NO: 19304 - RNA, 21 nt, Artificial Sequence
  Ebola virus siRNA sense strand
uaccgugcauaguauccugau

SEQ ID NO: 19305 - RNA, 21 nt, Artificial Sequence
  Ebola virus siRNA sense strand
accgugcauaguauccugaua

SEQ ID NO: 19306 - RNA, 21 nt, Artificial Sequence
  Ebola virus siRNA sense strand
ccgugcauaguauccugauac

SEQ ID NO: 19307 - RNA, 21 nt, Artificial Sequence
  Ebola virus siRNA sense strand
cgugcauaguauccugauacu

SEQ ID NO: 19308 - RNA, 21 nt, Artificial Sequence
  Ebola virus siRNA sense strand
gugcauaguauccugauacuu

SEQ ID NO: 19309 - RNA, 21 nt, Artificial Sequence
  Ebola virus siRNA sense strand
ugcauaguauccugauacuug

SEQ ID NO: 19310 - RNA, 21 nt, Artificial Sequence
  Ebola virus siRNA sense strand
gcauaguauccugauacuugc

SEQ ID NO: 19311 - RNA, 21 nt, Artificial Sequence
  Ebola virus siRNA sense strand
cauaguauccugauacuugca

SEQ ID NO: 19312 - RNA, 21 nt, Artificial Sequence
  Ebola virus siRNA sense strand
auaguauccugauacuugcaa

SEQ ID NO: 19313 - RNA, 21 nt, Artificial Sequence
  Ebola virus siRNA sense strand
uaguauccugauacuugcaaa

SEQ ID NO: 19314 - RNA, 21 nt, Artificial Sequence
  Ebola virus siRNA sense strand
aguauccugauacuugcaaag

SEQ ID NO: 19315 - RNA, 21 nt, Artificial Sequence
  Ebola virus siRNA sense strand
guauccugauacuugcaaagg

SEQ ID NO: 19316 - RNA, 21 nt, Artificial Sequence
  Ebola virus siRNA sense strand
uauccugauacuugcaaaggu

SEQ ID NO: 19317 - RNA, 21 nt, Artificial Sequence
  Ebola virus siRNA sense strand
auccugauacuugcaaagguu

SEQ ID NO: 19318 - RNA, 21 nt, Artificial Sequence
  Ebola virus siRNA sense strand
uccugauacuugcaaagguug

SEQ ID NO: 19319 - RNA, 21 nt, Artificial Sequence
  Ebola virus siRNA sense strand
ccugauacuugcaaagguugg

SEQ ID NO: 19320 - RNA, 21 nt, Artificial Sequence
  Ebola virus siRNA sense strand
cugauacuugcaaagguuggu

SEQ ID NO: 19321 - RNA, 21 nt, Artificial Sequence
  Ebola virus siRNA sense strand
ugauacuugcaaagguugguu

SEQ ID NO: 19322 - RNA, 21 nt, Artificial Sequence
  Ebola virus siRNA sense strand
gauacuugcaaagguugguua

SEQ ID NO: 19323 - RNA, 21 nt, Artificial Sequence
  Ebola virus siRNA sense strand
auacuugcaaagguugguuau

SEQ ID NO: 19324 - RNA, 21 nt, Artificial Sequence
  Ebola virus siRNA sense strand
uacuugcaaagguugguuauu

SEQ ID NO: 19325 - RNA, 21 nt, Artificial Sequence
  Ebola virus siRNA sense strand
acuugcaaagguugguuauua

SEQ ID NO: 19326 - RNA, 21 nt, Artificial Sequence
  Ebola virus siRNA sense strand
cuugcaaagguugguuauuaa

SEQ ID NO: 19327 - RNA, 21 nt, Artificial Sequence
  Ebola virus siRNA sense strand
uugcaaagguugguuauuaac

SEQ ID NO: 19328 - RNA, 21 nt, Artificial Sequence
  Ebola virus siRNA sense strand
ugcaaagguugguuauuaaca

SEQ ID NO: 19329 - RNA, 21 nt, Artificial Sequence
  Ebola virus siRNA sense strand
gcaaagguugguuauuaacau

SEQ ID NO: 19330 - RNA, 21 nt, Artificial Sequence
  Ebola virus siRNA sense strand
caaagguugguuauuaacaua

SEQ ID NO: 19331 - RNA, 21 nt, Artificial Sequence
  Ebola virus siRNA sense strand
aaagguugguuauuaacauac

SEQ ID NO: 19332 - RNA, 21 nt, Artificial Sequence
  Ebola virus siRNA sense strand
aagguugguuauuaacauaca

SEQ ID NO: 19333 - RNA, 21 nt, Artificial Sequence
  Ebola virus siRNA sense strand
agguugguuauuaacauacag

SEQ ID NO: 19334 - RNA, 21 nt, Artificial Sequence
  Ebola virus siRNA sense strand
gguugguuauuaacauacaga

SEQ ID NO: 19335 - RNA, 21 nt, Artificial Sequence
  Ebola virus siRNA sense strand
guugguuauuaacauacagau

SEQ ID NO: 19336 - RNA, 21 nt, Artificial Sequence
  Ebola virus siRNA sense strand
uugguuauuaacauacagauu

SEQ ID NO: 19337 - RNA, 21 nt, Artificial Sequence
  Ebola virus siRNA sense strand
ugguuauuaacauacagauua

SEQ ID NO: 19338 - RNA, 21 nt, Artificial Sequence
  Ebola virus siRNA sense strand
gguuauuaacauacagauuau

SEQ ID NO: 19339 - RNA, 21 nt, Artificial Sequence
  Ebola virus siRNA sense strand
guuauuaacauacagauuaua

SEQ ID NO: 19340 - RNA, 21 nt, Artificial Sequence
  Ebola virus siRNA sense strand
uuauuaacauacagauuauaa

SEQ ID NO: 19341 - RNA, 21 nt, Artificial Sequence
  Ebola virus siRNA sense strand
uauuaacauacagauuauaaa

SEQ ID NO: 19342 - RNA, 21 nt, Artificial Sequence
  Ebola virus siRNA sense strand
auuaacauacagauuauaaaa

SEQ ID NO: 19343 - RNA, 21 nt, Artificial Sequence
  Ebola virus siRNA sense strand
uuaacauacagauuauaaaaa

SEQ ID NO: 19344 - RNA, 21 nt, Artificial Sequence
  Ebola virus siRNA sense strand
uaacauacagauuauaaaaaa

SEQ ID NO: 19345 - RNA, 21 nt, Artificial Sequence
  Ebola virus siRNA sense strand
aacauacagauuauaaaaaac

SEQ ID NO: 19346 - RNA, 21 nt, Artificial Sequence
  Ebola virus siRNA sense strand
acauacagauuauaaaaaacu

SEQ ID NO: 19347 - RNA, 21 nt, Artificial Sequence
  Ebola virus siRNA sense strand
cauacagauuauaaaaaacuc

SEQ ID NO: 19348 - RNA, 21 nt, Artificial Sequence
  Ebola virus siRNA sense strand
auacagauuauaaaaaacuca

SEQ ID NO: 19349 - RNA, 21 nt, Artificial Sequence
  Ebola virus siRNA sense strand
uacagauuauaaaaaacucau

SEQ ID NO: 19350 - RNA, 21 nt, Artificial Sequence
  Ebola virus siRNA sense strand
acagauuauaaaaaacucaua

SEQ ID NO: 19351 - RNA, 21 nt, Artificial Sequence
  Ebola virus siRNA sense strand
cagauuauaaaaaacucauaa

SEQ ID NO: 19352 - RNA, 21 nt, Artificial Sequence
  Ebola virus siRNA sense strand
agauuauaaaaaacucauaaa

SEQ ID NO: 19353 - RNA, 21 nt, Artificial Sequence
  Ebola virus siRNA sense strand
gauuauaaaaaacucauaaau

SEQ ID NO: 19354 - RNA, 21 nt, Artificial Sequence
  Ebola virus siRNA sense strand
auuauaaaaaacucauaaauu

SEQ ID NO: 19355 - RNA, 21 nt, Artificial Sequence
  Ebola virus siRNA sense strand
uuauaaaaaacucauaaauug

SEQ ID NO: 19356 - RNA, 21 nt, Artificial Sequence
  Ebola virus siRNA sense strand
uauaaaaaacucauaaauugc

SEQ ID NO: 19357 - RNA, 21 nt, Artificial Sequence
  Ebola virus siRNA sense strand
auaaaaaacucauaaauugcu

SEQ ID NO: 19358 - RNA, 21 nt, Artificial Sequence
  Ebola virus siRNA sense strand
uaaaaaacucauaaauugcuc

SEQ ID NO: 19359 - RNA, 21 nt, Artificial Sequence
  Ebola virus siRNA sense strand
aaaaaacucauaaauugcucu

SEQ ID NO: 19360 - RNA, 21 nt, Artificial Sequence
  Ebola virus siRNA sense strand
aaaaacucauaaauugcucuc

SEQ ID NO: 19361 - RNA, 21 nt, Artificial Sequence
  Ebola virus siRNA sense strand
aaaacucauaaauugcucuca

SEQ ID NO: 19362 - RNA, 21 nt, Artificial Sequence
  Ebola virus siRNA sense strand
aaacucauaaauugcucucau

SEQ ID NO: 19363 - RNA, 21 nt, Artificial Sequence
  Ebola virus siRNA sense strand
aacucauaaauugcucucaua

SEQ ID NO: 19364 - RNA, 21 nt, Artificial Sequence
  Ebola virus siRNA sense strand
acucauaaauugcucucauac

SEQ ID NO: 19365 - RNA, 21 nt, Artificial Sequence
  Ebola virus siRNA sense strand
cucauaaauugcucucauaca

SEQ ID NO: 19366 - RNA, 21 nt, Artificial Sequence
  Ebola virus siRNA sense strand
ucauaaauugcucucauacau

SEQ ID NO: 19367 - RNA, 21 nt, Artificial Sequence
  Ebola virus siRNA sense strand
cauaaauugcucucauacauc

SEQ ID NO: 19368 - RNA, 21 nt, Artificial Sequence
  Ebola virus siRNA sense strand
auaaauugcucucauacauca

SEQ ID NO: 19369 - RNA, 21 nt, Artificial Sequence
  Ebola virus siRNA sense strand
uaaauugcucucauacaucau

SEQ ID NO: 19370 - RNA, 21 nt, Artificial Sequence
  Ebola virus siRNA sense strand
aaauugcucucauacaucaua

SEQ ID NO: 19371 - RNA, 21 nt, Artificial Sequence
  Ebola virus siRNA sense strand
aauugcucucauacaucauau

SEQ ID NO: 19372 - RNA, 21 nt, Artificial Sequence
  Ebola virus siRNA sense strand
auugcucucauacaucauauu

SEQ ID NO: 19373 - RNA, 21 nt, Artificial Sequence
  Ebola virus siRNA sense strand
uugcucucauacaucauauug

SEQ ID NO: 19374 - RNA, 21 nt, Artificial Sequence
  Ebola virus siRNA sense strand
ugcucucauacaucauauuga

SEQ ID NO: 19375 - RNA, 21 nt, Artificial Sequence
  Ebola virus siRNA sense strand
gcucucauacaucauauugau

SEQ ID NO: 19376 - RNA, 21 nt, Artificial Sequence
  Ebola virus siRNA sense strand
cucucauacaucauauugauc

SEQ ID NO: 19377 - RNA, 21 nt, Artificial Sequence
  Ebola virus siRNA sense strand
ucucauacaucauauugaucu

SEQ ID NO: 19378 - RNA, 21 nt, Artificial Sequence
  Ebola virus siRNA sense strand
cucauacaucauauugaucua

SEQ ID NO: 19379 - RNA, 21 nt, Artificial Sequence
  Ebola virus siRNA sense strand
ucauacaucauauugaucuaa

SEQ ID NO: 19380 - RNA, 21 nt, Artificial Sequence
  Ebola virus siRNA sense strand
cauacaucauauugaucuaau

SEQ ID NO: 19381 - RNA, 21 nt, Artificial Sequence
  Ebola virus siRNA sense strand
auacaucauauugaucuaauc

SEQ ID NO: 19382 - RNA, 21 nt, Artificial Sequence
  Ebola virus siRNA sense strand
uacaucauauugaucuaaucu

SEQ ID NO: 19383 - RNA, 21 nt, Artificial Sequence
  Ebola virus siRNA sense strand
acaucauauugaucuaaucuc

SEQ ID NO: 19384 - RNA, 21 nt, Artificial Sequence
  Ebola virus siRNA sense strand
caucauauugaucuaaucuca

SEQ ID NO: 19385 - RNA, 21 nt, Artificial Sequence
  Ebola virus siRNA sense strand
aucauauugaucuaaucucaa

SEQ ID NO: 19386 - RNA, 21 nt, Artificial Sequence
  Ebola virus siRNA sense strand
ucauauugaucuaaucucaau

SEQ ID NO: 19387 - RNA, 21 nt, Artificial Sequence
  Ebola virus siRNA sense strand
cauauugaucuaaucucaaua

SEQ ID NO: 19388 - RNA, 21 nt, Artificial Sequence
  Ebola virus siRNA sense strand
auauugaucuaaucucaauaa

SEQ ID NO: 19389 - RNA, 21 nt, Artificial Sequence
  Ebola virus siRNA sense strand
uauugaucuaaucucaauaaa

SEQ ID NO: 19390 - RNA, 21 nt, Artificial Sequence
  Ebola virus siRNA sense strand
auugaucuaaucucaauaaac

SEQ ID NO: 19391 - RNA, 21 nt, Artificial Sequence
  Ebola virus siRNA sense strand
uugaucuaaucucaauaaaca

SEQ ID NO: 19392 - RNA, 21 nt, Artificial Sequence
  Ebola virus siRNA sense strand
ugaucuaaucucaauaaacaa

SEQ ID NO: 19393 - RNA, 21 nt, Artificial Sequence
  Ebola virus siRNA sense strand
gaucuaaucucaauaaacaac

SEQ ID NO: 19394 - RNA, 21 nt, Artificial Sequence
  Ebola virus siRNA sense strand
aucuaaucucaauaaacaacu

SEQ ID NO: 19395 - RNA, 21 nt, Artificial Sequence
  Ebola virus siRNA sense strand
ucuaaucucaauaaacaacua

SEQ ID NO: 19396 - RNA, 21 nt, Artificial Sequence
  Ebola virus siRNA sense strand
cuaaucucaauaaacaacuau

SEQ ID NO: 19397 - RNA, 21 nt, Artificial Sequence
  Ebola virus siRNA sense strand
uaaucucaauaaacaacuauu

SEQ ID NO: 19398 - RNA, 21 nt, Artificial Sequence
  Ebola virus siRNA sense strand
aaucucaauaaacaacuauuu

SEQ ID NO: 19399 - RNA, 21 nt, Artificial Sequence
  Ebola virus siRNA sense strand
aucucaauaaacaacuauuua

SEQ ID NO: 19400 - RNA, 21 nt, Artificial Sequence
  Ebola virus siRNA sense strand
ucucaauaaacaacuauuuaa

SEQ ID NO: 19401 - RNA, 21 nt, Artificial Sequence
  Ebola virus siRNA sense strand
cucaauaaacaacuauuuaaa

SEQ ID NO: 19402 - RNA, 21 nt, Artificial Sequence
  Ebola virus siRNA sense strand
ucaauaaacaacuauuuaaau

SEQ ID NO: 19403 - RNA, 21 nt, Artificial Sequence
  Ebola virus siRNA sense strand
caauaaacaacuauuuaaaua

SEQ ID NO: 19404 - RNA, 21 nt, Artificial Sequence
  Ebola virus siRNA sense strand
aauaaacaacuauuuaaauaa

SEQ ID NO: 19405 - RNA, 21 nt, Artificial Sequence
  Ebola virus siRNA sense strand
auaaacaacuauuuaaauaac

SEQ ID NO: 19406 - RNA, 21 nt, Artificial Sequence
  Ebola virus siRNA sense strand
uaaacaacuauuuaaauaacg

SEQ ID NO: 19407 - RNA, 21 nt, Artificial Sequence
  Ebola virus siRNA sense strand
aaacaacuauuuaaauaacga

SEQ ID NO: 19408 - RNA, 21 nt, Artificial Sequence
  Ebola virus siRNA sense strand
aacaacuauuuaaauaacgaa

SEQ ID NO: 19409 - RNA, 21 nt, Artificial Sequence
  Ebola virus siRNA sense strand
acaacuauuuaaauaacgaaa

SEQ ID NO: 19410 - RNA, 21 nt, Artificial Sequence
  Ebola virus siRNA sense strand
caacuauuuaaauaacgaaag

SEQ ID NO: 19411 - RNA, 21 nt, Artificial Sequence
  Ebola virus siRNA sense strand
aacuauuuaaauaacgaaagg

SEQ ID NO: 19412 - RNA, 21 nt, Artificial Sequence
  Ebola virus siRNA sense strand
acuauuuaaauaacgaaagga

SEQ ID NO: 19413 - RNA, 21 nt, Artificial Sequence
  Ebola virus siRNA sense strand
cuauuuaaauaacgaaaggag

SEQ ID NO: 19414 - RNA, 21 nt, Artificial Sequence
  Ebola virus siRNA sense strand
uauuuaaauaacgaaaggagu

SEQ ID NO: 19415 - RNA, 21 nt, Artificial Sequence
  Ebola virus siRNA sense strand
auuuaaauaacgaaaggaguc

SEQ ID NO: 19416 - RNA, 21 nt, Artificial Sequence
  Ebola virus siRNA sense strand
uuuaaauaacgaaaggagucc

SEQ ID NO: 19417 - RNA, 21 nt, Artificial Sequence
  Ebola virus siRNA sense strand
uuaaauaacgaaaggaguccc

SEQ ID NO: 19418 - RNA, 21 nt, Artificial Sequence
  Ebola virus siRNA sense strand
uaaauaacgaaaggagucccu

SEQ ID NO: 19419 - RNA, 21 nt, Artificial Sequence
  Ebola virus siRNA sense strand
aaauaacgaaaggagucccua

SEQ ID NO: 19420 - RNA, 21 nt, Artificial Sequence
  Ebola virus siRNA sense strand
aauaacgaaaggagucccuau

SEQ ID NO: 19421 - RNA, 21 nt, Artificial Sequence
  Ebola virus siRNA sense strand
auaacgaaaggagucccuaua

SEQ ID NO: 19422 - RNA, 21 nt, Artificial Sequence
  Ebola virus siRNA sense strand
uaacgaaaggagucccuauau

SEQ ID NO: 19423 - RNA, 21 nt, Artificial Sequence
  Ebola virus siRNA sense strand
aacgaaaggagucccuauauu

SEQ ID NO: 19424 - RNA, 21 nt, Artificial Sequence
  Ebola virus siRNA sense strand
acgaaaggagucccuauauua

SEQ ID NO: 19425 - RNA, 21 nt, Artificial Sequence
  Ebola virus siRNA sense strand
cgaaaggagucccuauauuau

SEQ ID NO: 19426 - RNA, 21 nt, Artificial Sequence
  Ebola virus siRNA sense strand
gaaaggagucccuauauuaua

SEQ ID NO: 19427 - RNA, 21 nt, Artificial Sequence
  Ebola virus siRNA sense strand
aaaggagucccuauauuauau

SEQ ID NO: 19428 - RNA, 21 nt, Artificial Sequence
  Ebola virus siRNA sense strand
aaggagucccuauauuauaua

SEQ ID NO: 19429 - RNA, 21 nt, Artificial Sequence
  Ebola virus siRNA sense strand
aggagucccuauauuauauac

SEQ ID NO: 19430 - RNA, 21 nt, Artificial Sequence
  Ebola virus siRNA sense strand
ggagucccuauauuauauacu

SEQ ID NO: 19431 - RNA, 21 nt, Artificial Sequence
  Ebola virus siRNA sense strand
gagucccuauauuauauacua

SEQ ID NO: 19432 - RNA, 21 nt, Artificial Sequence
  Ebola virus siRNA sense strand
agucccuauauuauauacuau

SEQ ID NO: 19433 - RNA, 21 nt, Artificial Sequence
  Ebola virus siRNA sense strand
gucccuauauuauauacuaua

SEQ ID NO: 19434 - RNA, 21 nt, Artificial Sequence
  Ebola virus siRNA sense strand
ucccuauauuauauacuauau

SEQ ID NO: 19435 - RNA, 21 nt, Artificial Sequence
  Ebola virus siRNA sense strand
cccuauauuauauacuauauu

SEQ ID NO: 19436 - RNA, 21 nt, Artificial Sequence
  Ebola virus siRNA sense strand
ccuauauuauauacuauauuu

SEQ ID NO: 19437 - RNA, 21 nt, Artificial Sequence
  Ebola virus siRNA sense strand
cuauauuauauacuauauuua

SEQ ID NO: 19438 - RNA, 21 nt, Artificial Sequence
  Ebola virus siRNA sense strand
uauauuauauacuauauuuag

SEQ ID NO: 19439 - RNA, 21 nt, Artificial Sequence
  Ebola virus siRNA sense strand
auauuauauacuauauuuagc

SEQ ID NO: 19440 - RNA, 21 nt, Artificial Sequence
  Ebola virus siRNA sense strand
uauuauauacuauauuuagcc

SEQ ID NO: 19441 - RNA, 21 nt, Artificial Sequence
  Ebola virus siRNA sense strand
auuauauacuauauuuagccu

SEQ ID NO: 19442 - RNA, 21 nt, Artificial Sequence
  Ebola virus siRNA sense strand
uuauauacuauauuuagccuc

SEQ ID NO: 19443 - RNA, 21 nt, Artificial Sequence
  Ebola virus siRNA sense strand
uauauacuauauuuagccucu

SEQ ID NO: 19444 - RNA, 21 nt, Artificial Sequence
  Ebola virus siRNA sense strand
auauacuauauuuagccucuc

SEQ ID NO: 19445 - RNA, 21 nt, Artificial Sequence
  Ebola virus siRNA sense strand
uauacuauauuuagccucucu

SEQ ID NO: 19446 - RNA, 21 nt, Artificial Sequence
  Ebola virus siRNA sense strand
auacuauauuuagccucucuc

SEQ ID NO: 19447 - RNA, 21 nt, Artificial Sequence
  Ebola virus siRNA sense strand
uacuauauuuagccucucucc

SEQ ID NO: 19448 - RNA, 21 nt, Artificial Sequence
  Ebola virus siRNA sense strand
acuauauuuagccucucuccc

SEQ ID NO: 19449 - RNA, 21 nt, Artificial Sequence
  Ebola virus siRNA sense strand
cuauauuuagccucucucccu

SEQ ID NO: 19450 - RNA, 21 nt, Artificial Sequence
  Ebola virus siRNA sense strand
uauauuuagccucucucccug

SEQ ID NO: 19451 - RNA, 21 nt, Artificial Sequence
  Ebola virus siRNA sense strand
auauuuagccucucucccugc

SEQ ID NO: 19452 - RNA, 21 nt, Artificial Sequence
  Ebola virus siRNA sense strand
uauuuagccucucucccugcg

SEQ ID NO: 19453 - RNA, 21 nt, Artificial Sequence
  Ebola virus siRNA sense strand
auuuagccucucucccugcgu

SEQ ID NO: 19454 - RNA, 21 nt, Artificial Sequence
  Ebola virus siRNA sense strand
uuuagccucucucccugcgug

SEQ ID NO: 19455 - RNA, 21 nt, Artificial Sequence
  Ebola virus siRNA sense strand
uuagccucucucccugcguga

SEQ ID NO: 19456 - RNA, 21 nt, Artificial Sequence
  Ebola virus siRNA sense strand
uagccucucucccugcgugau

SEQ ID NO: 19457 - RNA, 21 nt, Artificial Sequence
  Ebola virus siRNA sense strand
agccucucucccugcgugaua

SEQ ID NO: 19458 - RNA, 21 nt, Artificial Sequence
  Ebola virus siRNA sense strand
gccucucucccugcgugauaa

SEQ ID NO: 19459 - RNA, 21 nt, Artificial Sequence
  Ebola virus siRNA sense strand
ccucucucccugcgugauaau

SEQ ID NO: 19460 - RNA, 21 nt, Artificial Sequence
  Ebola virus siRNA sense strand
cucucucccugcgugauaauc

SEQ ID NO: 19461 - RNA, 21 nt, Artificial Sequence
  Ebola virus siRNA sense strand
ucucucccugcgugauaauca

SEQ ID NO: 19462 - RNA, 21 nt, Artificial Sequence
  Ebola virus siRNA sense strand
cucucccugcgugauaaucaa

SEQ ID NO: 19463 - RNA, 21 nt, Artificial Sequence
  Ebola virus siRNA sense strand
ucucccugcgugauaaucaaa

SEQ ID NO: 19464 - RNA, 21 nt, Artificial Sequence
  Ebola virus siRNA sense strand
cucccugcgugauaaucaaaa

SEQ ID NO: 19465 - RNA, 21 nt, Artificial Sequence
  Ebola virus siRNA sense strand
ucccugcgugauaaucaaaaa

SEQ ID NO: 19466 - RNA, 21 nt, Artificial Sequence
  Ebola virus siRNA sense strand
cccugcgugauaaucaaaaaa

SEQ ID NO: 19467 - RNA, 21 nt, Artificial Sequence
  Ebola virus siRNA sense strand
ccugcgugauaaucaaaaaau

SEQ ID NO: 19468 - RNA, 21 nt, Artificial Sequence
  Ebola virus siRNA sense strand
cugcgugauaaucaaaaaauu

SEQ ID NO: 19469 - RNA, 21 nt, Artificial Sequence
  Ebola virus siRNA sense strand
ugcgugauaaucaaaaaauuc

SEQ ID NO: 19470 - RNA, 21 nt, Artificial Sequence
  Ebola virus siRNA sense strand
gcgugauaaucaaaaaauuca

SEQ ID NO: 19471 - RNA, 21 nt, Artificial Sequence
  Ebola virus siRNA sense strand
cgugauaaucaaaaaauucac

SEQ ID NO: 19472 - RNA, 21 nt, Artificial Sequence
  Ebola virus siRNA sense strand
gugauaaucaaaaaauucaca

SEQ ID NO: 19473 - RNA, 21 nt, Artificial Sequence
  Ebola virus siRNA sense strand
ugauaaucaaaaaauucacaa

SEQ ID NO: 19474 - RNA, 21 nt, Artificial Sequence
  Ebola virus siRNA sense strand
gauaaucaaaaaauucacaau

SEQ ID NO: 19475 - RNA, 21 nt, Artificial Sequence
  Ebola virus siRNA sense strand
auaaucaaaaaauucacaaug

SEQ ID NO: 19476 - RNA, 21 nt, Artificial Sequence
  Ebola virus siRNA sense strand
uaaucaaaaaauucacaaugc

SEQ ID NO: 19477 - RNA, 21 nt, Artificial Sequence
  Ebola virus siRNA sense strand
aaucaaaaaauucacaaugca

SEQ ID NO: 19478 - RNA, 21 nt, Artificial Sequence
  Ebola virus siRNA sense strand
aucaaaaaauucacaaugcag

SEQ ID NO: 19479 - RNA, 21 nt, Artificial Sequence
  Ebola virus siRNA sense strand
ucaaaaaauucacaaugcagc

SEQ ID NO: 19480 - RNA, 21 nt, Artificial Sequence
  Ebola virus siRNA sense strand
caaaaaauucacaaugcagca

SEQ ID NO: 19481 - RNA, 21 nt, Artificial Sequence
  Ebola virus siRNA sense strand
aaaaaauucacaaugcagcau

SEQ ID NO: 19482 - RNA, 21 nt, Artificial Sequence
  Ebola virus siRNA sense strand
aaaaauucacaaugcagcaug

SEQ ID NO: 19483 - RNA, 21 nt, Artificial Sequence
  Ebola virus siRNA sense strand
aaaauucacaaugcagcaugu

SEQ ID NO: 19484 - RNA, 21 nt, Artificial Sequence
  Ebola virus siRNA sense strand
aaauucacaaugcagcaugug

SEQ ID NO: 19485 - RNA, 21 nt, Artificial Sequence
  Ebola virus siRNA sense strand
aauucacaaugcagcaugugu

SEQ ID NO: 19486 - RNA, 21 nt, Artificial Sequence
  Ebola virus siRNA sense strand
auucacaaugcagcaugugug

SEQ ID NO: 19487 - RNA, 21 nt, Artificial Sequence
  Ebola virus siRNA sense strand
uucacaaugcagcauguguga

SEQ ID NO: 19488 - RNA, 21 nt, Artificial Sequence
  Ebola virus siRNA sense strand
ucacaaugcagcaugugugac

SEQ ID NO: 19489 - RNA, 21 nt, Artificial Sequence
  Ebola virus siRNA sense strand
cacaaugcagcaugugugaca

SEQ ID NO: 19490 - RNA, 21 nt, Artificial Sequence
  Ebola virus siRNA sense strand
acaaugcagcaugugugacau

SEQ ID NO: 19491 - RNA, 21 nt, Artificial Sequence
  Ebola virus siRNA sense strand
caaugcagcaugugugacaua

SEQ ID NO: 19492 - RNA, 21 nt, Artificial Sequence
  Ebola virus siRNA sense strand
aaugcagcaugugugacauau

SEQ ID NO: 19493 - RNA, 21 nt, Artificial Sequence
  Ebola virus siRNA sense strand
augcagcaugugugacauauu

SEQ ID NO: 19494 - RNA, 21 nt, Artificial Sequence
  Ebola virus siRNA sense strand
ugcagcaugugugacauauua

SEQ ID NO: 19495 - RNA, 21 nt, Artificial Sequence
  Ebola virus siRNA sense strand
gcagcaugugugacauauuac

SEQ ID NO: 19496 - RNA, 21 nt, Artificial Sequence
  Ebola virus siRNA sense strand
cagcaugugugacauauuacu

SEQ ID NO: 19497 - RNA, 21 nt, Artificial Sequence
  Ebola virus siRNA sense strand
agcaugugugacauauuacug

SEQ ID NO: 19498 - RNA, 21 nt, Artificial Sequence
  Ebola virus siRNA sense strand
gcaugugugacauauuacugc

SEQ ID NO: 19499 - RNA, 21 nt, Artificial Sequence
  Ebola virus siRNA sense strand
caugugugacauauuacugcc

SEQ ID NO: 19500 - RNA, 21 nt, Artificial Sequence
  Ebola virus siRNA sense strand
augugugacauauuacugccg

SEQ ID NO: 19501 - RNA, 21 nt, Artificial Sequence
  Ebola virus siRNA sense strand
ugugugacauauuacugccgc

SEQ ID NO: 19502 - RNA, 21 nt, Artificial Sequence
  Ebola virus siRNA sense strand
gugugacauauuacugccgca

SEQ ID NO: 19503 - RNA, 21 nt, Artificial Sequence
  Ebola virus siRNA sense strand
ugugacauauuacugccgcaa

SEQ ID NO: 19504 - RNA, 21 nt, Artificial Sequence
  Ebola virus siRNA sense strand
gugacauauuacugccgcaau

SEQ ID NO: 19505 - RNA, 21 nt, Artificial Sequence
  Ebola virus siRNA sense strand
ugacauauuacugccgcaaug

SEQ ID NO: 19506 - RNA, 21 nt, Artificial Sequence
  Ebola virus siRNA sense strand
gacauauuacugccgcaauga

SEQ ID NO: 19507 - RNA, 21 nt, Artificial Sequence
  Ebola virus siRNA sense strand
acauauuacugccgcaaugaa

SEQ ID NO: 19508 - RNA, 21 nt, Artificial Sequence
  Ebola virus siRNA sense strand
cauauuacugccgcaaugaau

SEQ ID NO: 19509 - RNA, 21 nt, Artificial Sequence
  Ebola virus siRNA sense strand
auauuacugccgcaaugaauu

SEQ ID NO: 19510 - RNA, 21 nt, Artificial Sequence
  Ebola virus siRNA sense strand
uauuacugccgcaaugaauuu

SEQ ID NO: 19511 - RNA, 21 nt, Artificial Sequence
  Ebola virus siRNA sense strand
auuacugccgcaaugaauuua

SEQ ID NO: 19512 - RNA, 21 nt, Artificial Sequence
  Ebola virus siRNA sense strand
uuacugccgcaaugaauuuaa

SEQ ID NO: 19513 - RNA, 21 nt, Artificial Sequence
  Ebola virus siRNA sense strand
uacugccgcaaugaauuuaac

SEQ ID NO: 19514 - RNA, 21 nt, Artificial Sequence
  Ebola virus siRNA sense strand
acugccgcaaugaauuuaacg

SEQ ID NO: 19515 - RNA, 21 nt, Artificial Sequence
  Ebola virus siRNA sense strand
cugccgcaaugaauuuaacgc

SEQ ID NO: 19516 - RNA, 21 nt, Artificial Sequence
  Ebola virus siRNA sense strand
ugccgcaaugaauuuaacgca

SEQ ID NO: 19517 - RNA, 21 nt, Artificial Sequence
  Ebola virus siRNA sense strand
gccgcaaugaauuuaacgcaa

SEQ ID NO: 19518 - RNA, 21 nt, Artificial Sequence
  Ebola virus siRNA sense strand
ccgcaaugaauuuaacgcaac

SEQ ID NO: 19519 - RNA, 21 nt, Artificial Sequence
  Ebola virus siRNA sense strand
cgcaaugaauuuaacgcaaca

SEQ ID NO: 19520 - RNA, 21 nt, Artificial Sequence
  Ebola virus siRNA sense strand
gcaaugaauuuaacgcaacau

SEQ ID NO: 19521 - RNA, 21 nt, Artificial Sequence
  Ebola virus siRNA sense strand
caaugaauuuaacgcaacaua

SEQ ID NO: 19522 - RNA, 21 nt, Artificial Sequence
  Ebola virus siRNA sense strand
aaugaauuuaacgcaacauaa

SEQ ID NO: 19523 - RNA, 21 nt, Artificial Sequence
  Ebola virus siRNA sense strand
augaauuuaacgcaacauaau

SEQ ID NO: 19524 - RNA, 21 nt, Artificial Sequence
  Ebola virus siRNA sense strand
ugaauuuaacgcaacauaaua

SEQ ID NO: 19525 - RNA, 21 nt, Artificial Sequence
  Ebola virus siRNA sense strand
gaauuuaacgcaacauaauaa

SEQ ID NO: 19526 - RNA, 21 nt, Artificial Sequence
  Ebola virus siRNA sense strand
aauuuaacgcaacauaauaaa

SEQ ID NO: 19527 - RNA, 21 nt, Artificial Sequence
  Ebola virus siRNA sense strand
auuuaacgcaacauaauaaac

SEQ ID NO: 19528 - RNA, 21 nt, Artificial Sequence
  Ebola virus siRNA sense strand
uuuaacgcaacauaauaaacu

SEQ ID NO: 19529 - RNA, 21 nt, Artificial Sequence
  Ebola virus siRNA sense strand
uuaacgcaacauaauaaacuc

SEQ ID NO: 19530 - RNA, 21 nt, Artificial Sequence
  Ebola virus siRNA sense strand
uaacgcaacauaauaaacucu

SEQ ID NO: 19531 - RNA, 21 nt, Artificial Sequence
  Ebola virus siRNA sense strand
aacgcaacauaauaaacucug

SEQ ID NO: 19532 - RNA, 21 nt, Artificial Sequence
  Ebola virus siRNA sense strand
acgcaacauaauaaacucugc

SEQ ID NO: 19533 - RNA, 21 nt, Artificial Sequence
  Ebola virus siRNA sense strand
cgcaacauaauaaacucugca

SEQ ID NO: 19534 - RNA, 21 nt, Artificial Sequence
  Ebola virus siRNA sense strand
gcaacauaauaaacucugcac

SEQ ID NO: 19535 - RNA, 21 nt, Artificial Sequence
  Ebola virus siRNA sense strand
caacauaauaaacucugcacu

SEQ ID NO: 19536 - RNA, 21 nt, Artificial Sequence
  Ebola virus siRNA sense strand
aacauaauaaacucugcacuc

SEQ ID NO: 19537 - RNA, 21 nt, Artificial Sequence
  Ebola virus siRNA sense strand
acauaauaaacucugcacucu

SEQ ID NO: 19538 - RNA, 21 nt, Artificial Sequence
  Ebola virus siRNA sense strand
cauaauaaacucugcacucuu

SEQ ID NO: 19539 - RNA, 21 nt, Artificial Sequence
  Ebola virus siRNA sense strand
auaauaaacucugcacucuuu

SEQ ID NO: 19540 - RNA, 21 nt, Artificial Sequence
  Ebola virus siRNA sense strand
uaauaaacucugcacucuuua

SEQ ID NO: 19541 - RNA, 21 nt, Artificial Sequence
  Ebola virus siRNA sense strand
aauaaacucugcacucuuuau

SEQ ID NO: 19542 - RNA, 21 nt, Artificial Sequence
  Ebola virus siRNA sense strand
auaaacucugcacucuuuaua

SEQ ID NO: 19543 - RNA, 21 nt, Artificial Sequence
  Ebola virus siRNA sense strand
uaaacucugcacucuuuauaa

SEQ ID NO: 19544 - RNA, 21 nt, Artificial Sequence
  Ebola virus siRNA sense strand
aaacucugcacucuuuauaau

SEQ ID NO: 19545 - RNA, 21 nt, Artificial Sequence
  Ebola virus siRNA sense strand
aacucugcacucuuuauaauu

SEQ ID NO: 19546 - RNA, 21 nt, Artificial Sequence
  Ebola virus siRNA sense strand
acucugcacucuuuauaauua

SEQ ID NO: 19547 - RNA, 21 nt, Artificial Sequence
  Ebola virus siRNA sense strand
cucugcacucuuuauaauuaa

SEQ ID NO: 19548 - RNA, 21 nt, Artificial Sequence
  Ebola virus siRNA sense strand
ucugcacucuuuauaauuaag

SEQ ID NO: 19549 - RNA, 21 nt, Artificial Sequence
  Ebola virus siRNA sense strand
cugcacucuuuauaauuaagc

SEQ ID NO: 19550 - RNA, 21 nt, Artificial Sequence
  Ebola virus siRNA sense strand
ugcacucuuuauaauuaagcu

SEQ ID NO: 19551 - RNA, 21 nt, Artificial Sequence
  Ebola virus siRNA sense strand
gcacucuuuauaauuaagcuu

SEQ ID NO: 19552 - RNA, 21 nt, Artificial Sequence
  Ebola virus siRNA sense strand
cacucuuuauaauuaagcuuu

SEQ ID NO: 19553 - RNA, 21 nt, Artificial Sequence
  Ebola virus siRNA sense strand
acucuuuauaauuaagcuuua

SEQ ID NO: 19554 - RNA, 21 nt, Artificial Sequence
  Ebola virus siRNA sense strand
cucuuuauaauuaagcuuuaa

SEQ ID NO: 19555 - RNA, 21 nt, Artificial Sequence
  Ebola virus siRNA sense strand
ucuuuauaauuaagcuuuaac

SEQ ID NO: 19556 - RNA, 21 nt, Artificial Sequence
  Ebola virus siRNA sense strand
cuuuauaauuaagcuuuaacg

SEQ ID NO: 19557 - RNA, 21 nt, Artificial Sequence
  Ebola virus siRNA sense strand
uuuauaauuaagcuuuaacga

SEQ ID NO: 19558 - RNA, 21 nt, Artificial Sequence
  Ebola virus siRNA sense strand
uuauaauuaagcuuuaacgaa

SEQ ID NO: 19559 - RNA, 21 nt, Artificial Sequence
  Ebola virus siRNA sense strand
uauaauuaagcuuuaacgaaa

SEQ ID NO: 19560 - RNA, 21 nt, Artificial Sequence
  Ebola virus siRNA sense strand
auaauuaagcuuuaacgaaag

SEQ ID NO: 19561 - RNA, 21 nt, Artificial Sequence
  Ebola virus siRNA sense strand
uaauuaagcuuuaacgaaagg

SEQ ID NO: 19562 - RNA, 21 nt, Artificial Sequence
  Ebola virus siRNA sense strand
aauuaagcuuuaacgaaaggu

SEQ ID NO: 19563 - RNA, 21 nt, Artificial Sequence
  Ebola virus siRNA sense strand
auuaagcuuuaacgaaagguc

SEQ ID NO: 19564 - RNA, 21 nt, Artificial Sequence
  Ebola virus siRNA sense strand
uuaagcuuuaacgaaaggucu

SEQ ID NO: 19565 - RNA, 21 nt, Artificial Sequence
  Ebola virus siRNA sense strand
uaagcuuuaacgaaaggucug

SEQ ID NO: 19566 - RNA, 21 nt, Artificial Sequence
  Ebola virus siRNA sense strand
aagcuuuaacgaaaggucugg

SEQ ID NO: 19567 - RNA, 21 nt, Artificial Sequence
  Ebola virus siRNA sense strand
agcuuuaacgaaaggucuggg

SEQ ID NO: 19568 - RNA, 21 nt, Artificial Sequence
  Ebola virus siRNA sense strand
gcuuuaacgaaaggucugggc

SEQ ID NO: 19569 - RNA, 21 nt, Artificial Sequence
  Ebola virus siRNA sense strand
cuuuaacgaaaggucugggcu

SEQ ID NO: 19570 - RNA, 21 nt, Artificial Sequence
  Ebola virus siRNA sense strand
uuuaacgaaaggucugggcuc

SEQ ID NO: 19571 - RNA, 21 nt, Artificial Sequence
  Ebola virus siRNA sense strand
uuaacgaaaggucugggcuca

SEQ ID NO: 19572 - RNA, 21 nt, Artificial Sequence
  Ebola virus siRNA sense strand
uaacgaaaggucugggcucau

SEQ ID NO: 19573 - RNA, 21 nt, Artificial Sequence
  Ebola virus siRNA sense strand
aacgaaaggucugggcucaua

SEQ ID NO: 19574 - RNA, 21 nt, Artificial Sequence
  Ebola virus siRNA sense strand
acgaaaggucugggcucauau

SEQ ID NO: 19575 - RNA, 21 nt, Artificial Sequence
  Ebola virus siRNA sense strand
cgaaaggucugggcucauauu

SEQ ID NO: 19576 - RNA, 21 nt, Artificial Sequence
  Ebola virus siRNA sense strand
gaaaggucugggcucauauug

SEQ ID NO: 19577 - RNA, 21 nt, Artificial Sequence
  Ebola virus siRNA sense strand
aaaggucugggcucauauugu

SEQ ID NO: 19578 - RNA, 21 nt, Artificial Sequence
  Ebola virus siRNA sense strand
aaggucugggcucauauuguu

SEQ ID NO: 19579 - RNA, 21 nt, Artificial Sequence
  Ebola virus siRNA sense strand
aggucugggcucauauuguua

SEQ ID NO: 19580 - RNA, 21 nt, Artificial Sequence
  Ebola virus siRNA sense strand
ggucugggcucauauuguuau

SEQ ID NO: 19581 - RNA, 21 nt, Artificial Sequence
  Ebola virus siRNA sense strand
gucugggcucauauuguuauu

SEQ ID NO: 19582 - RNA, 21 nt, Artificial Sequence
  Ebola virus siRNA sense strand
ucugggcucauauuguuauug

SEQ ID NO: 19583 - RNA, 21 nt, Artificial Sequence
  Ebola virus siRNA sense strand
cugggcucauauuguuauuga

SEQ ID NO: 19584 - RNA, 21 nt, Artificial Sequence
  Ebola virus siRNA sense strand
ugggcucauauuguuauugau

SEQ ID NO: 19585 - RNA, 21 nt, Artificial Sequence
  Ebola virus siRNA sense strand
gggcucauauuguuauugaua

SEQ ID NO: 19586 - RNA, 21 nt, Artificial Sequence
  Ebola virus siRNA sense strand
ggcucauauuguuauugauau

SEQ ID NO: 19587 - RNA, 21 nt, Artificial Sequence
  Ebola virus siRNA sense strand
gcucauauuguuauugauaua

SEQ ID NO: 19588 - RNA, 21 nt, Artificial Sequence
  Ebola virus siRNA sense strand
cucauauuguuauugauauaa

SEQ ID NO: 19589 - RNA, 21 nt, Artificial Sequence
  Ebola virus siRNA sense strand
ucauauuguuauugauauaau

SEQ ID NO: 19590 - RNA, 21 nt, Artificial Sequence
  Ebola virus siRNA sense strand
cauauuguuauugauauaaua

SEQ ID NO: 19591 - RNA, 21 nt, Artificial Sequence
  Ebola virus siRNA sense strand
auauuguuauugauauaauaa

SEQ ID NO: 19592 - RNA, 21 nt, Artificial Sequence
  Ebola virus siRNA sense strand
uauuguuauugauauaauaau

SEQ ID NO: 19593 - RNA, 21 nt, Artificial Sequence
  Ebola virus siRNA sense strand
auuguuauugauauaauaaug

SEQ ID NO: 19594 - RNA, 21 nt, Artificial Sequence
  Ebola virus siRNA sense strand
uuguuauugauauaauaaugu

SEQ ID NO: 19595 - RNA, 21 nt, Artificial Sequence
  Ebola virus siRNA sense strand
uguuauugauauaauaauguu

SEQ ID NO: 19596 - RNA, 21 nt, Artificial Sequence
  Ebola virus siRNA sense strand
guuauugauauaauaauguug

SEQ ID NO: 19597 - RNA, 21 nt, Artificial Sequence
  Ebola virus siRNA sense strand
uuauugauauaauaauguugu

SEQ ID NO: 19598 - RNA, 21 nt, Artificial Sequence
  Ebola virus siRNA sense strand
uauugauauaauaauguugua

SEQ ID NO: 19599 - RNA, 21 nt, Artificial Sequence
  Ebola virus siRNA sense strand
auugauauaauaauguuguau

SEQ ID NO: 19600 - RNA, 21 nt, Artificial Sequence
  Ebola virus siRNA sense strand
uugauauaauaauguuguauc

SEQ ID NO: 19601 - RNA, 21 nt, Artificial Sequence
  Ebola virus siRNA sense strand
ugauauaauaauguuguauca

SEQ ID NO: 19602 - RNA, 21 nt, Artificial Sequence
  Ebola virus siRNA sense strand
gauauaauaauguuguaucaa

SEQ ID NO: 19603 - RNA, 21 nt, Artificial Sequence
  Ebola virus siRNA sense strand
auauaauaauguuguaucaau

SEQ ID NO: 19604 - RNA, 21 nt, Artificial Sequence
  Ebola virus siRNA sense strand
uauaauaauguuguaucaaua

SEQ ID NO: 19605 - RNA, 21 nt, Artificial Sequence
  Ebola virus siRNA sense strand
auaauaauguuguaucaauau

SEQ ID NO: 19606 - RNA, 21 nt, Artificial Sequence
  Ebola virus siRNA sense strand
uaauaauguuguaucaauauc

SEQ ID NO: 19607 - RNA, 21 nt, Artificial Sequence
  Ebola virus siRNA sense strand
aauaauguuguaucaauaucc

SEQ ID NO: 19608 - RNA, 21 nt, Artificial Sequence
  Ebola virus siRNA sense strand
auaauguuguaucaauauccu

SEQ ID NO: 19609 - RNA, 21 nt, Artificial Sequence
  Ebola virus siRNA sense strand
uaauguuguaucaauauccug

SEQ ID NO: 19610 - RNA, 21 nt, Artificial Sequence
  Ebola virus siRNA sense strand
aauguuguaucaauauccugu

SEQ ID NO: 19611 - RNA, 21 nt, Artificial Sequence
  Ebola virus siRNA sense strand
auguuguaucaauauccuguc

SEQ ID NO: 19612 - RNA, 21 nt, Artificial Sequence
  Ebola virus siRNA sense strand
uguuguaucaauauccuguca

SEQ ID NO: 19613 - RNA, 21 nt, Artificial Sequence
  Ebola virus siRNA sense strand
guuguaucaauauccugucag

SEQ ID NO: 19614 - RNA, 21 nt, Artificial Sequence
  Ebola virus siRNA sense strand
uuguaucaauauccugucaga

SEQ ID NO: 19615 - RNA, 21 nt, Artificial Sequence
  Ebola virus siRNA sense strand
uguaucaauauccugucagau

SEQ ID NO: 19616 - RNA, 21 nt, Artificial Sequence
  Ebola virus siRNA sense strand
guaucaauauccugucagaug

SEQ ID NO: 19617 - RNA, 21 nt, Artificial Sequence
  Ebola virus siRNA sense strand
uaucaauauccugucagaugg

SEQ ID NO: 19618 - RNA, 21 nt, Artificial Sequence
  Ebola virus siRNA sense strand
aucaauauccugucagaugga

SEQ ID NO: 19619 - RNA, 21 nt, Artificial Sequence
  Ebola virus siRNA sense strand
ucaauauccugucagauggaa

SEQ ID NO: 19620 - RNA, 21 nt, Artificial Sequence
  Ebola virus siRNA sense strand
caauauccugucagauggaau

SEQ ID NO: 19621 - RNA, 21 nt, Artificial Sequence
  Ebola virus siRNA sense strand
aauauccugucagauggaaua

SEQ ID NO: 19622 - RNA, 21 nt, Artificial Sequence
  Ebola virus siRNA sense strand
auauccugucagauggaauag

SEQ ID NO: 19623 - RNA, 21 nt, Artificial Sequence
  Ebola virus siRNA sense strand
uauccugucagauggaauagu

SEQ ID NO: 19624 - RNA, 21 nt, Artificial Sequence
  Ebola virus siRNA sense strand
auccugucagauggaauagug

SEQ ID NO: 19625 - RNA, 21 nt, Artificial Sequence
  Ebola virus siRNA sense strand
uccugucagauggaauagugu

SEQ ID NO: 19626 - RNA, 21 nt, Artificial Sequence
  Ebola virus siRNA sense strand
ccugucagauggaauaguguu

SEQ ID NO: 19627 - RNA, 21 nt, Artificial Sequence
  Ebola virus siRNA sense strand
cugucagauggaauaguguuu

SEQ ID NO: 19628 - RNA, 21 nt, Artificial Sequence
  Ebola virus siRNA sense strand
ugucagauggaauaguguuuu

SEQ ID NO: 19629 - RNA, 21 nt, Artificial Sequence
  Ebola virus siRNA sense strand
gucagauggaauaguguuuug

SEQ ID NO: 19630 - RNA, 21 nt, Artificial Sequence
  Ebola virus siRNA sense strand
ucagauggaauaguguuuugg

SEQ ID NO: 19631 - RNA, 21 nt, Artificial Sequence
  Ebola virus siRNA sense strand
cagauggaauaguguuuuggu

SEQ ID NO: 19632 - RNA, 21 nt, Artificial Sequence
  Ebola virus siRNA sense strand
agauggaauaguguuuugguu

SEQ ID NO: 19633 - RNA, 21 nt, Artificial Sequence
  Ebola virus siRNA sense strand
gauggaauaguguuuugguug

SEQ ID NO: 19634 - RNA, 21 nt, Artificial Sequence
  Ebola virus siRNA sense strand
auggaauaguguuuugguuga

SEQ ID NO: 19635 - RNA, 21 nt, Artificial Sequence
  Ebola virus siRNA sense strand
uggaauaguguuuugguugau

SEQ ID NO: 19636 - RNA, 21 nt, Artificial Sequence
  Ebola virus siRNA sense strand
ggaauaguguuuugguugaua

SEQ ID NO: 19637 - RNA, 21 nt, Artificial Sequence
  Ebola virus siRNA sense strand
gaauaguguuuugguugauaa

SEQ ID NO: 19638 - RNA, 21 nt, Artificial Sequence
  Ebola virus siRNA sense strand
aauaguguuuugguugauaac

SEQ ID NO: 19639 - RNA, 21 nt, Artificial Sequence
  Ebola virus siRNA sense strand
auaguguuuugguugauaaca

SEQ ID NO: 19640 - RNA, 21 nt, Artificial Sequence
  Ebola virus siRNA sense strand
uaguguuuugguugauaacac

SEQ ID NO: 19641 - RNA, 21 nt, Artificial Sequence
  Ebola virus siRNA sense strand
aguguuuugguugauaacaca

SEQ ID NO: 19642 - RNA, 21 nt, Artificial Sequence
  Ebola virus siRNA sense strand
guguuuugguugauaacacaa

SEQ ID NO: 19643 - RNA, 21 nt, Artificial Sequence
  Ebola virus siRNA sense strand
uguuuugguugauaacacaac

SEQ ID NO: 19644 - RNA, 21 nt, Artificial Sequence
  Ebola virus siRNA sense strand
guuuugguugauaacacaacu

SEQ ID NO: 19645 - RNA, 21 nt, Artificial Sequence
  Ebola virus siRNA sense strand
uuuugguugauaacacaacuu

SEQ ID NO: 19646 - RNA, 21 nt, Artificial Sequence
  Ebola virus siRNA sense strand
uuugguugauaacacaacuuc

SEQ ID NO: 19647 - RNA, 21 nt, Artificial Sequence
  Ebola virus siRNA sense strand
uugguugauaacacaacuucu

SEQ ID NO: 19648 - RNA, 21 nt, Artificial Sequence
  Ebola virus siRNA sense strand
ugguugauaacacaacuucuu

SEQ ID NO: 19649 - RNA, 21 nt, Artificial Sequence
  Ebola virus siRNA sense strand
gguugauaacacaacuucuua

SEQ ID NO: 19650 - RNA, 21 nt, Artificial Sequence
  Ebola virus siRNA sense strand
guugauaacacaacuucuuaa

SEQ ID NO: 19651 - RNA, 21 nt, Artificial Sequence
  Ebola virus siRNA sense strand
uugauaacacaacuucuuaaa

SEQ ID NO: 19652 - RNA, 21 nt, Artificial Sequence
  Ebola virus siRNA sense strand
ugauaacacaacuucuuaaaa

SEQ ID NO: 19653 - RNA, 21 nt, Artificial Sequence
  Ebola virus siRNA sense strand
gauaacacaacuucuuaaaac

SEQ ID NO: 19654 - RNA, 21 nt, Artificial Sequence
  Ebola virus siRNA sense strand
auaacacaacuucuuaaaaca

SEQ ID NO: 19655 - RNA, 21 nt, Artificial Sequence
  Ebola virus siRNA sense strand
uaacacaacuucuuaaaacaa

SEQ ID NO: 19656 - RNA, 21 nt, Artificial Sequence
  Ebola virus siRNA sense strand
aacacaacuucuuaaaacaaa

SEQ ID NO: 19657 - RNA, 21 nt, Artificial Sequence
  Ebola virus siRNA sense strand
acacaacuucuuaaaacaaaa

SEQ ID NO: 19658 - RNA, 21 nt, Artificial Sequence
  Ebola virus siRNA sense strand
cacaacuucuuaaaacaaaau

SEQ ID NO: 19659 - RNA, 21 nt, Artificial Sequence
  Ebola virus siRNA sense strand
acaacuucuuaaaacaaaauu

SEQ ID NO: 19660 - RNA, 21 nt, Artificial Sequence
  Ebola virus siRNA sense strand
caacuucuuaaaacaaaauug

SEQ ID NO: 19661 - RNA, 21 nt, Artificial Sequence
  Ebola virus siRNA sense strand
aacuucuuaaaacaaaauuga

SEQ ID NO: 19662 - RNA, 21 nt, Artificial Sequence
  Ebola virus siRNA sense strand
acuucuuaaaacaaaauugau

SEQ ID NO: 19663 - RNA, 21 nt, Artificial Sequence
  Ebola virus siRNA sense strand
cuucuuaaaacaaaauugauc

SEQ ID NO: 19664 - RNA, 21 nt, Artificial Sequence
  Ebola virus siRNA sense strand
uucuuaaaacaaaauugaucu

SEQ ID NO: 19665 - RNA, 21 nt, Artificial Sequence
  Ebola virus siRNA sense strand
ucuuaaaacaaaauugaucuu

SEQ ID NO: 19666 - RNA, 21 nt, Artificial Sequence
  Ebola virus siRNA sense strand
cuuaaaacaaaauugaucuuu

SEQ ID NO: 19667 - RNA, 21 nt, Artificial Sequence
  Ebola virus siRNA sense strand
uuaaaacaaaauugaucuuua

SEQ ID NO: 19668 - RNA, 21 nt, Artificial Sequence
  Ebola virus siRNA sense strand
uaaaacaaaauugaucuuuaa

SEQ ID NO: 19669 - RNA, 21 nt, Artificial Sequence
  Ebola virus siRNA sense strand
aaaacaaaauugaucuuuaag

SEQ ID NO: 19670 - RNA, 21 nt, Artificial Sequence
  Ebola virus siRNA sense strand
aaacaaaauugaucuuuaaga

SEQ ID NO: 19671 - RNA, 21 nt, Artificial Sequence
  Ebola virus siRNA sense strand
aacaaaauugaucuuuaagau

SEQ ID NO: 19672 - RNA, 21 nt, Artificial Sequence
  Ebola virus siRNA sense strand
acaaaauugaucuuuaagauu

SEQ ID NO: 19673 - RNA, 21 nt, Artificial Sequence
  Ebola virus siRNA sense strand
caaaauugaucuuuaagauua

SEQ ID NO: 19674 - RNA, 21 nt, Artificial Sequence
  Ebola virus siRNA sense strand
aaaauugaucuuuaagauuaa

SEQ ID NO: 19675 - RNA, 21 nt, Artificial Sequence
  Ebola virus siRNA sense strand
aaauugaucuuuaagauuaag

SEQ ID NO: 19676 - RNA, 21 nt, Artificial Sequence
  Ebola virus siRNA sense strand
aauugaucuuuaagauuaagu

SEQ ID NO: 19677 - RNA, 21 nt, Artificial Sequence
  Ebola virus siRNA sense strand
auugaucuuuaagauuaaguu

SEQ ID NO: 19678 - RNA, 21 nt, Artificial Sequence
  Ebola virus siRNA sense strand
uugaucuuuaagauuaaguuu

SEQ ID NO: 19679 - RNA, 21 nt, Artificial Sequence
  Ebola virus siRNA sense strand
ugaucuuuaagauuaaguuuu

SEQ ID NO: 19680 - RNA, 21 nt, Artificial Sequence
  Ebola virus siRNA sense strand
gaucuuuaagauuaaguuuuu

SEQ ID NO: 19681 - RNA, 21 nt, Artificial Sequence
  Ebola virus siRNA sense strand
aucuuuaagauuaaguuuuuu

SEQ ID NO: 19682 - RNA, 21 nt, Artificial Sequence
  Ebola virus siRNA sense strand
ucuuuaagauuaaguuuuuua

SEQ ID NO: 19683 - RNA, 21 nt, Artificial Sequence
  Ebola virus siRNA sense strand
cuuuaagauuaaguuuuuuau

SEQ ID NO: 19684 - RNA, 21 nt, Artificial Sequence
  Ebola virus siRNA sense strand
uuuaagauuaaguuuuuuaua

SEQ ID NO: 19685 - RNA, 21 nt, Artificial Sequence
  Ebola virus siRNA sense strand
uuaagauuaaguuuuuuauaa

SEQ ID NO: 19686 - RNA, 21 nt, Artificial Sequence
  Ebola virus siRNA sense strand
uaagauuaaguuuuuuauaau

SEQ ID NO: 19687 - RNA, 21 nt, Artificial Sequence
  Ebola virus siRNA sense strand
aagauuaaguuuuuuauaauu

SEQ ID NO: 19688 - RNA, 21 nt, Artificial Sequence
  Ebola virus siRNA sense strand
agauuaaguuuuuuauaauua

SEQ ID NO: 19689 - RNA, 21 nt, Artificial Sequence
  Ebola virus siRNA sense strand
gauuaaguuuuuuauaauuau

SEQ ID NO: 19690 - RNA, 21 nt, Artificial Sequence
  Ebola virus siRNA sense strand
auuaaguuuuuuauaauuauc

SEQ ID NO: 19691 - RNA, 21 nt, Artificial Sequence
  Ebola virus siRNA sense strand
uuaaguuuuuuauaauuauca

SEQ ID NO: 19692 - RNA, 21 nt, Artificial Sequence
  Ebola virus siRNA sense strand
uaaguuuuuuauaauuaucau

SEQ ID NO: 19693 - RNA, 21 nt, Artificial Sequence
  Ebola virus siRNA sense strand
aaguuuuuuauaauuaucauu

SEQ ID NO: 19694 - RNA, 21 nt, Artificial Sequence
  Ebola virus siRNA sense strand
aguuuuuuauaauuaucauua

SEQ ID NO: 19695 - RNA, 21 nt, Artificial Sequence
  Ebola virus siRNA sense strand
guuuuuuauaauuaucauuac

SEQ ID NO: 19696 - RNA, 21 nt, Artificial Sequence
  Ebola virus siRNA sense strand
uuuuuuauaauuaucauuacu

SEQ ID NO: 19697 - RNA, 21 nt, Artificial Sequence
  Ebola virus siRNA sense strand
uuuuuauaauuaucauuacuu

SEQ ID NO: 19698 - RNA, 21 nt, Artificial Sequence
  Ebola virus siRNA sense strand
uuuuauaauuaucauuacuuu

SEQ ID NO: 19699 - RNA, 21 nt, Artificial Sequence
  Ebola virus siRNA sense strand
uuuauaauuaucauuacuuua

SEQ ID NO: 19700 - RNA, 21 nt, Artificial Sequence
  Ebola virus siRNA sense strand
uuauaauuaucauuacuuuaa

SEQ ID NO: 19701 - RNA, 21 nt, Artificial Sequence
  Ebola virus siRNA sense strand
uauaauuaucauuacuuuaau

SEQ ID NO: 19702 - RNA, 21 nt, Artificial Sequence
  Ebola virus siRNA sense strand
auaauuaucauuacuuuaauu

SEQ ID NO: 19703 - RNA, 21 nt, Artificial Sequence
  Ebola virus siRNA sense strand
uaauuaucauuacuuuaauuu

SEQ ID NO: 19704 - RNA, 21 nt, Artificial Sequence
  Ebola virus siRNA sense strand
aauuaucauuacuuuaauuug

SEQ ID NO: 19705 - RNA, 21 nt, Artificial Sequence
  Ebola virus siRNA sense strand
auuaucauuacuuuaauuugu

SEQ ID NO: 19706 - RNA, 21 nt, Artificial Sequence
  Ebola virus siRNA sense strand
uuaucauuacuuuaauuuguc

SEQ ID NO: 19707 - RNA, 21 nt, Artificial Sequence
  Ebola virus siRNA sense strand
uaucauuacuuuaauuugucg

SEQ ID NO: 19708 - RNA, 21 nt, Artificial Sequence
  Ebola virus siRNA sense strand
aucauuacuuuaauuugucgu

SEQ ID NO: 19709 - RNA, 21 nt, Artificial Sequence
  Ebola virus siRNA sense strand
ucauuacuuuaauuugucguu

SEQ ID NO: 19710 - RNA, 21 nt, Artificial Sequence
  Ebola virus siRNA sense strand
cauuacuuuaauuugucguuu

SEQ ID NO: 19711 - RNA, 21 nt, Artificial Sequence
  Ebola virus siRNA sense strand
auuacuuuaauuugucguuuu

SEQ ID NO: 19712 - RNA, 21 nt, Artificial Sequence
  Ebola virus siRNA sense strand
uuacuuuaauuugucguuuua

SEQ ID NO: 19713 - RNA, 21 nt, Artificial Sequence
  Ebola virus siRNA sense strand
uacuuuaauuugucguuuuaa

SEQ ID NO: 19714 - RNA, 21 nt, Artificial Sequence
  Ebola virus siRNA sense strand
acuuuaauuugucguuuuaaa

SEQ ID NO: 19715 - RNA, 21 nt, Artificial Sequence
  Ebola virus siRNA sense strand
cuuuaauuugucguuuuaaaa

SEQ ID NO: 19716 - RNA, 21 nt, Artificial Sequence
  Ebola virus siRNA sense strand
uuuaauuugucguuuuaaaaa

SEQ ID NO: 19717 - RNA, 21 nt, Artificial Sequence
  Ebola virus siRNA sense strand
uuaauuugucguuuuaaaaac

SEQ ID NO: 19718 - RNA, 21 nt, Artificial Sequence
  Ebola virus siRNA sense strand
uaauuugucguuuuaaaaacg

SEQ ID NO: 19719 - RNA, 21 nt, Artificial Sequence
  Ebola virus siRNA sense strand
aauuugucguuuuaaaaacgg

SEQ ID NO: 19720 - RNA, 21 nt, Artificial Sequence
  Ebola virus siRNA sense strand
auuugucguuuuaaaaacggu

SEQ ID NO: 19721 - RNA, 21 nt, Artificial Sequence
  Ebola virus siRNA sense strand
uuugucguuuuaaaaacggug

SEQ ID NO: 19722 - RNA, 21 nt, Artificial Sequence
  Ebola virus siRNA sense strand
uugucguuuuaaaaacgguga

SEQ ID NO: 19723 - RNA, 21 nt, Artificial Sequence
  Ebola virus siRNA sense strand
ugucguuuuaaaaacggugau

SEQ ID NO: 19724 - RNA, 21 nt, Artificial Sequence
  Ebola virus siRNA sense strand
gucguuuuaaaaacggugaua

SEQ ID NO: 19725 - RNA, 21 nt, Artificial Sequence
  Ebola virus siRNA sense strand
ucguuuuaaaaacggugauag

SEQ ID NO: 19726 - RNA, 21 nt, Artificial Sequence
  Ebola virus siRNA sense strand
cguuuuaaaaacggugauagc

SEQ ID NO: 19727 - RNA, 21 nt, Artificial Sequence
  Ebola virus siRNA sense strand
guuuuaaaaacggugauagcc

SEQ ID NO: 19728 - RNA, 21 nt, Artificial Sequence
  Ebola virus siRNA sense strand
uuuuaaaaacggugauagccu

SEQ ID NO: 19729 - RNA, 21 nt, Artificial Sequence
  Ebola virus siRNA sense strand
uuuaaaaacggugauagccuu

SEQ ID NO: 19730 - RNA, 21 nt, Artificial Sequence
  Ebola virus siRNA sense strand
uuaaaaacggugauagccuua

SEQ ID NO: 19731 - RNA, 21 nt, Artificial Sequence
  Ebola virus siRNA sense strand
uaaaaacggugauagccuuaa

SEQ ID NO: 19732 - RNA, 21 nt, Artificial Sequence
  Ebola virus siRNA sense strand
aaaaacggugauagccuuaau

SEQ ID NO: 19733 - RNA, 21 nt, Artificial Sequence
  Ebola virus siRNA sense strand
aaaacggugauagccuuaauc

SEQ ID NO: 19734 - RNA, 21 nt, Artificial Sequence
  Ebola virus siRNA sense strand
aaacggugauagccuuaaucu

SEQ ID NO: 19735 - RNA, 21 nt, Artificial Sequence
  Ebola virus siRNA sense strand
aacggugauagccuuaaucuu

SEQ ID NO: 19736 - RNA, 21 nt, Artificial Sequence
  Ebola virus siRNA sense strand
acggugauagccuuaaucuuu

SEQ ID NO: 19737 - RNA, 21 nt, Artificial Sequence
  Ebola virus siRNA sense strand
cggugauagccuuaaucuuug

SEQ ID NO: 19738 - RNA, 21 nt, Artificial Sequence
  Ebola virus siRNA sense strand
ggugauagccuuaaucuuugu

SEQ ID NO: 19739 - RNA, 21 nt, Artificial Sequence
  Ebola virus siRNA sense strand
gugauagccuuaaucuuugug

SEQ ID NO: 19740 - RNA, 21 nt, Artificial Sequence
  Ebola virus siRNA sense strand
ugauagccuuaaucuuugugu

SEQ ID NO: 19741 - RNA, 21 nt, Artificial Sequence
  Ebola virus siRNA sense strand
gauagccuuaaucuuugugua

SEQ ID NO: 19742 - RNA, 21 nt, Artificial Sequence
  Ebola virus siRNA sense strand
auagccuuaaucuuuguguaa

SEQ ID NO: 19743 - RNA, 21 nt, Artificial Sequence
  Ebola virus siRNA sense strand
uagccuuaaucuuuguguaaa

SEQ ID NO: 19744 - RNA, 21 nt, Artificial Sequence
  Ebola virus siRNA sense strand
agccuuaaucuuuguguaaaa

SEQ ID NO: 19745 - RNA, 21 nt, Artificial Sequence
  Ebola virus siRNA sense strand
gccuuaaucuuuguguaaaau

SEQ ID NO: 19746 - RNA, 21 nt, Artificial Sequence
  Ebola virus siRNA sense strand
ccuuaaucuuuguguaaaaua

SEQ ID NO: 19747 - RNA, 21 nt, Artificial Sequence
  Ebola virus siRNA sense strand
cuuaaucuuuguguaaaauaa

SEQ ID NO: 19748 - RNA, 21 nt, Artificial Sequence
  Ebola virus siRNA sense strand
uuaaucuuuguguaaaauaag

SEQ ID NO: 19749 - RNA, 21 nt, Artificial Sequence
  Ebola virus siRNA sense strand
uaaucuuuguguaaaauaaga

SEQ ID NO: 19750 - RNA, 21 nt, Artificial Sequence
  Ebola virus siRNA sense strand
aaucuuuguguaaaauaagag

SEQ ID NO: 19751 - RNA, 21 nt, Artificial Sequence
  Ebola virus siRNA sense strand
aucuuuguguaaaauaagaga

SEQ ID NO: 19752 - RNA, 21 nt, Artificial Sequence
  Ebola virus siRNA sense strand
ucuuuguguaaaauaagagau

SEQ ID NO: 19753 - RNA, 21 nt, Artificial Sequence
  Ebola virus siRNA sense strand
cuuuguguaaaauaagagauu

SEQ ID NO: 19754 - RNA, 21 nt, Artificial Sequence
  Ebola virus siRNA sense strand
uuuguguaaaauaagagauua

SEQ ID NO: 19755 - RNA, 21 nt, Artificial Sequence
  Ebola virus siRNA sense strand
uuguguaaaauaagagauuag

SEQ ID NO: 19756 - RNA, 21 nt, Artificial Sequence
  Ebola virus siRNA sense strand
uguguaaaauaagagauuagg

SEQ ID NO: 19757 - RNA, 21 nt, Artificial Sequence
  Ebola virus siRNA sense strand
guguaaaauaagagauuaggu

SEQ ID NO: 19758 - RNA, 21 nt, Artificial Sequence
  Ebola virus siRNA sense strand
uguaaaauaagagauuaggug

SEQ ID NO: 19759 - RNA, 21 nt, Artificial Sequence
  Ebola virus siRNA sense strand
guaaaauaagagauuaggugu

SEQ ID NO: 19760 - RNA, 21 nt, Artificial Sequence
  Ebola virus siRNA sense strand
uaaaauaagagauuaggugua

SEQ ID NO: 19761 - RNA, 21 nt, Artificial Sequence
  Ebola virus siRNA sense strand
aaaauaagagauuagguguaa

SEQ ID NO: 19762 - RNA, 21 nt, Artificial Sequence
  Ebola virus siRNA sense strand
aaauaagagauuagguguaau

SEQ ID NO: 19763 - RNA, 21 nt, Artificial Sequence
  Ebola virus siRNA sense strand
aauaagagauuagguguaaua

SEQ ID NO: 19764 - RNA, 21 nt, Artificial Sequence
  Ebola virus siRNA sense strand
auaagagauuagguguaauaa

SEQ ID NO: 19765 - RNA, 21 nt, Artificial Sequence
  Ebola virus siRNA sense strand
uaagagauuagguguaauaac

SEQ ID NO: 19766 - RNA, 21 nt, Artificial Sequence
  Ebola virus siRNA sense strand
aagagauuagguguaauaacc

SEQ ID NO: 19767 - RNA, 21 nt, Artificial Sequence
  Ebola virus siRNA sense strand
agagauuagguguaauaaccu

SEQ ID NO: 19768 - RNA, 21 nt, Artificial Sequence
  Ebola virus siRNA sense strand
gagauuagguguaauaaccuu

SEQ ID NO: 19769 - RNA, 21 nt, Artificial Sequence
  Ebola virus siRNA sense strand
agauuagguguaauaaccuua

SEQ ID NO: 19770 - RNA, 21 nt, Artificial Sequence
  Ebola virus siRNA sense strand
gauuagguguaauaaccuuaa

SEQ ID NO: 19771 - RNA, 21 nt, Artificial Sequence
  Ebola virus siRNA sense strand
auuagguguaauaaccuuaac

SEQ ID NO: 19772 - RNA, 21 nt, Artificial Sequence
  Ebola virus siRNA sense strand
uuagguguaauaaccuuaaca

SEQ ID NO: 19773 - RNA, 21 nt, Artificial Sequence
  Ebola virus siRNA sense strand
uagguguaauaaccuuaacau

SEQ ID NO: 19774 - RNA, 21 nt, Artificial Sequence
  Ebola virus siRNA sense strand
agguguaauaaccuuaacauu

SEQ ID NO: 19775 - RNA, 21 nt, Artificial Sequence
  Ebola virus siRNA sense strand
gguguaauaaccuuaacauuu

SEQ ID NO: 19776 - RNA, 21 nt, Artificial Sequence
  Ebola virus siRNA sense strand
guguaauaaccuuaacauuuu

SEQ ID NO: 19777 - RNA, 21 nt, Artificial Sequence
  Ebola virus siRNA sense strand
uguaauaaccuuaacauuuuu

SEQ ID NO: 19778 - RNA, 21 nt, Artificial Sequence
  Ebola virus siRNA sense strand
guaauaaccuuaacauuuuug

SEQ ID NO: 19779 - RNA, 21 nt, Artificial Sequence
  Ebola virus siRNA sense strand
uaauaaccuuaacauuuuugu

SEQ ID NO: 19780 - RNA, 21 nt, Artificial Sequence
  Ebola virus siRNA sense strand
aauaaccuuaacauuuuuguc

SEQ ID NO: 19781 - RNA, 21 nt, Artificial Sequence
  Ebola virus siRNA sense strand
auaaccuuaacauuuuugucu

SEQ ID NO: 19782 - RNA, 21 nt, Artificial Sequence
  Ebola virus siRNA sense strand
uaaccuuaacauuuuugucua

SEQ ID NO: 19783 - RNA, 21 nt, Artificial Sequence
  Ebola virus siRNA sense strand
aaccuuaacauuuuugucuag

SEQ ID NO: 19784 - RNA, 21 nt, Artificial Sequence
  Ebola virus siRNA sense strand
accuuaacauuuuugucuagu

SEQ ID NO: 19785 - RNA, 21 nt, Artificial Sequence
  Ebola virus siRNA sense strand
ccuuaacauuuuugucuagua

SEQ ID NO: 19786 - RNA, 21 nt, Artificial Sequence
  Ebola virus siRNA sense strand
cuuaacauuuuugucuaguaa

SEQ ID NO: 19787 - RNA, 21 nt, Artificial Sequence
  Ebola virus siRNA sense strand
uuaacauuuuugucuaguaag

SEQ ID NO: 19788 - RNA, 21 nt, Artificial Sequence
  Ebola virus siRNA sense strand
uaacauuuuugucuaguaagc

SEQ ID NO: 19789 - RNA, 21 nt, Artificial Sequence
  Ebola virus siRNA sense strand
aacauuuuugucuaguaagcu

SEQ ID NO: 19790 - RNA, 21 nt, Artificial Sequence
  Ebola virus siRNA sense strand
acauuuuugucuaguaagcua

SEQ ID NO: 19791 - RNA, 21 nt, Artificial Sequence
  Ebola virus siRNA sense strand
cauuuuugucuaguaagcuac

SEQ ID NO: 19792 - RNA, 21 nt, Artificial Sequence
  Ebola virus siRNA sense strand
auuuuugucuaguaagcuacu

SEQ ID NO: 19793 - RNA, 21 nt, Artificial Sequence
  Ebola virus siRNA sense strand
uuuuugucuaguaagcuacua

SEQ ID NO: 19794 - RNA, 21 nt, Artificial Sequence
  Ebola virus siRNA sense strand
uuuugucuaguaagcuacuau

SEQ ID NO: 19795 - RNA, 21 nt, Artificial Sequence
  Ebola virus siRNA sense strand
uuugucuaguaagcuacuauu

SEQ ID NO: 19796 - RNA, 21 nt, Artificial Sequence
  Ebola virus siRNA sense strand
uugucuaguaagcuacuauuu

SEQ ID NO: 19797 - RNA, 21 nt, Artificial Sequence
  Ebola virus siRNA sense strand
ugucuaguaagcuacuauuuc

SEQ ID NO: 19798 - RNA, 21 nt, Artificial Sequence
  Ebola virus siRNA sense strand
gucuaguaagcuacuauuuca

SEQ ID NO: 19799 - RNA, 21 nt, Artificial Sequence
  Ebola virus siRNA sense strand
ucuaguaagcuacuauuucau

SEQ ID NO: 19800 - RNA, 21 nt, Artificial Sequence
  Ebola virus siRNA sense strand
cuaguaagcuacuauuucaua

SEQ ID NO: 19801 - RNA, 21 nt, Artificial Sequence
  Ebola virus siRNA sense strand
uaguaagcuacuauuucauac

SEQ ID NO: 19802 - RNA, 21 nt, Artificial Sequence
  Ebola virus siRNA sense strand
aguaagcuacuauuucauaca

SEQ ID NO: 19803 - RNA, 21 nt, Artificial Sequence
  Ebola virus siRNA sense strand
guaagcuacuauuucauacag

SEQ ID NO: 19804 - RNA, 21 nt, Artificial Sequence
  Ebola virus siRNA sense strand
uaagcuacuauuucauacaga

SEQ ID NO: 19805 - RNA, 21 nt, Artificial Sequence
  Ebola virus siRNA sense strand
aagcuacuauuucauacagaa

SEQ ID NO: 19806 - RNA, 21 nt, Artificial Sequence
  Ebola virus siRNA sense strand
agcuacuauuucauacagaau

SEQ ID NO: 19807 - RNA, 21 nt, Artificial Sequence
  Ebola virus siRNA sense strand
gcuacuauuucauacagaaug

SEQ ID NO: 19808 - RNA, 21 nt, Artificial Sequence
  Ebola virus siRNA sense strand
cuacuauuucauacagaauga

SEQ ID NO: 19809 - RNA, 21 nt, Artificial Sequence
  Ebola virus siRNA sense strand
uacuauuucauacagaaugau

SEQ ID NO: 19810 - RNA, 21 nt, Artificial Sequence
  Ebola virus siRNA sense strand
acuauuucauacagaaugaua

SEQ ID NO: 19811 - RNA, 21 nt, Artificial Sequence
  Ebola virus siRNA sense strand
cuauuucauacagaaugauaa

SEQ ID NO: 19812 - RNA, 21 nt, Artificial Sequence
  Ebola virus siRNA sense strand
uauuucauacagaaugauaaa

SEQ ID NO: 19813 - RNA, 21 nt, Artificial Sequence
  Ebola virus siRNA sense strand
auuucauacagaaugauaaaa

SEQ ID NO: 19814 - RNA, 21 nt, Artificial Sequence
  Ebola virus siRNA sense strand
uuucauacagaaugauaaaau

SEQ ID NO: 19815 - RNA, 21 nt, Artificial Sequence
  Ebola virus siRNA sense strand
uucauacagaaugauaaaauu

SEQ ID NO: 19816 - RNA, 21 nt, Artificial Sequence
  Ebola virus siRNA sense strand
ucauacagaaugauaaaauua

SEQ ID NO: 19817 - RNA, 21 nt, Artificial Sequence
  Ebola virus siRNA sense strand
cauacagaaugauaaaauuaa

SEQ ID NO: 19818 - RNA, 21 nt, Artificial Sequence
  Ebola virus siRNA sense strand
auacagaaugauaaaauuaaa

SEQ ID NO: 19819 - RNA, 21 nt, Artificial Sequence
  Ebola virus siRNA sense strand
uacagaaugauaaaauuaaaa

SEQ ID NO: 19820 - RNA, 21 nt, Artificial Sequence
  Ebola virus siRNA sense strand
acagaaugauaaaauuaaaag

SEQ ID NO: 19821 - RNA, 21 nt, Artificial Sequence
  Ebola virus siRNA sense strand
cagaaugauaaaauuaaaaga

SEQ ID NO: 19822 - RNA, 21 nt, Artificial Sequence
  Ebola virus siRNA sense strand
agaaugauaaaauuaaaagaa

SEQ ID NO: 19823 - RNA, 21 nt, Artificial Sequence
  Ebola virus siRNA sense strand
gaaugauaaaauuaaaagaaa

SEQ ID NO: 19824 - RNA, 21 nt, Artificial Sequence
  Ebola virus siRNA sense strand
aaugauaaaauuaaaagaaaa

SEQ ID NO: 19825 - RNA, 21 nt, Artificial Sequence
  Ebola virus siRNA sense strand
augauaaaauuaaaagaaaag

SEQ ID NO: 19826 - RNA, 21 nt, Artificial Sequence
  Ebola virus siRNA sense strand
ugauaaaauuaaaagaaaagg

SEQ ID NO: 19827 - RNA, 21 nt, Artificial Sequence
  Ebola virus siRNA sense strand
gauaaaauuaaaagaaaaggc

SEQ ID NO: 19828 - RNA, 21 nt, Artificial Sequence
  Ebola virus siRNA sense strand
auaaaauuaaaagaaaaggca

SEQ ID NO: 19829 - RNA, 21 nt, Artificial Sequence
  Ebola virus siRNA sense strand
uaaaauuaaaagaaaaggcag

SEQ ID NO: 19830 - RNA, 21 nt, Artificial Sequence
  Ebola virus siRNA sense strand
aaaauuaaaagaaaaggcagg

SEQ ID NO: 19831 - RNA, 21 nt, Artificial Sequence
  Ebola virus siRNA sense strand
aaauuaaaagaaaaggcagga

SEQ ID NO: 19832 - RNA, 21 nt, Artificial Sequence
  Ebola virus siRNA sense strand
aauuaaaagaaaaggcaggac

SEQ ID NO: 19833 - RNA, 21 nt, Artificial Sequence
  Ebola virus siRNA sense strand
auuaaaagaaaaggcaggacu

SEQ ID NO: 19834 - RNA, 21 nt, Artificial Sequence
  Ebola virus siRNA sense strand
uuaaaagaaaaggcaggacug

SEQ ID NO: 19835 - RNA, 21 nt, Artificial Sequence
  Ebola virus siRNA sense strand
uaaaagaaaaggcaggacugu

SEQ ID NO: 19836 - RNA, 21 nt, Artificial Sequence
  Ebola virus siRNA sense strand
aaaagaaaaggcaggacugua

SEQ ID NO: 19837 - RNA, 21 nt, Artificial Sequence
  Ebola virus siRNA sense strand
aaagaaaaggcaggacuguaa

SEQ ID NO: 19838 - RNA, 21 nt, Artificial Sequence
  Ebola virus siRNA sense strand
aagaaaaggcaggacuguaaa

SEQ ID NO: 19839 - RNA, 21 nt, Artificial Sequence
  Ebola virus siRNA sense strand
agaaaaggcaggacuguaaaa

SEQ ID NO: 19840 - RNA, 21 nt, Artificial Sequence
  Ebola virus siRNA sense strand
gaaaaggcaggacuguaaaau

SEQ ID NO: 19841 - RNA, 21 nt, Artificial Sequence
  Ebola virus siRNA sense strand
aaaaggcaggacuguaaaauc

SEQ ID NO: 19842 - RNA, 21 nt, Artificial Sequence
  Ebola virus siRNA sense strand
aaaggcaggacuguaaaauca

SEQ ID NO: 19843 - RNA, 21 nt, Artificial Sequence
  Ebola virus siRNA sense strand
aaggcaggacuguaaaaucag

SEQ ID NO: 19844 - RNA, 21 nt, Artificial Sequence
  Ebola virus siRNA sense strand
aggcaggacuguaaaaucaga

SEQ ID NO: 19845 - RNA, 21 nt, Artificial Sequence
  Ebola virus siRNA sense strand
ggcaggacuguaaaaucagaa

SEQ ID NO: 19846 - RNA, 21 nt, Artificial Sequence
  Ebola virus siRNA sense strand
gcaggacuguaaaaucagaaa

SEQ ID NO: 19847 - RNA, 21 nt, Artificial Sequence
  Ebola virus siRNA sense strand
caggacuguaaaaucagaaau

SEQ ID NO: 19848 - RNA, 21 nt, Artificial Sequence
  Ebola virus siRNA sense strand
aggacuguaaaaucagaaaua

SEQ ID NO: 19849 - RNA, 21 nt, Artificial Sequence
  Ebola virus siRNA sense strand
ggacuguaaaaucagaaauac

SEQ ID NO: 19850 - RNA, 21 nt, Artificial Sequence
  Ebola virus siRNA sense strand
gacuguaaaaucagaaauacc

SEQ ID NO: 19851 - RNA, 21 nt, Artificial Sequence
  Ebola virus siRNA sense strand
acuguaaaaucagaaauaccu

SEQ ID NO: 19852 - RNA, 21 nt, Artificial Sequence
  Ebola virus siRNA sense strand
cuguaaaaucagaaauaccuu

SEQ ID NO: 19853 - RNA, 21 nt, Artificial Sequence
  Ebola virus siRNA sense strand
uguaaaaucagaaauaccuuc

SEQ ID NO: 19854 - RNA, 21 nt, Artificial Sequence
  Ebola virus siRNA sense strand
guaaaaucagaaauaccuucu

SEQ ID NO: 19855 - RNA, 21 nt, Artificial Sequence
  Ebola virus siRNA sense strand
uaaaaucagaaauaccuucuu

SEQ ID NO: 19856 - RNA, 21 nt, Artificial Sequence
  Ebola virus siRNA sense strand
aaaaucagaaauaccuucuuu

SEQ ID NO: 19857 - RNA, 21 nt, Artificial Sequence
  Ebola virus siRNA sense strand
aaaucagaaauaccuucuuua

SEQ ID NO: 19858 - RNA, 21 nt, Artificial Sequence
  Ebola virus siRNA sense strand
aaucagaaauaccuucuuuac

SEQ ID NO: 19859 - RNA, 21 nt, Artificial Sequence
  Ebola virus siRNA sense strand
aucagaaauaccuucuuuaca

SEQ ID NO: 19860 - RNA, 21 nt, Artificial Sequence
  Ebola virus siRNA sense strand
ucagaaauaccuucuuuacaa

SEQ ID NO: 19861 - RNA, 21 nt, Artificial Sequence
  Ebola virus siRNA sense strand
cagaaauaccuucuuuacaau

SEQ ID NO: 19862 - RNA, 21 nt, Artificial Sequence
  Ebola virus siRNA sense strand
agaaauaccuucuuuacaaua

SEQ ID NO: 19863 - RNA, 21 nt, Artificial Sequence
  Ebola virus siRNA sense strand
gaaauaccuucuuuacaauau

SEQ ID NO: 19864 - RNA, 21 nt, Artificial Sequence
  Ebola virus siRNA sense strand
aaauaccuucuuuacaauaua

SEQ ID NO: 19865 - RNA, 21 nt, Artificial Sequence
  Ebola virus siRNA sense strand
aauaccuucuuuacaauauag

SEQ ID NO: 19866 - RNA, 21 nt, Artificial Sequence
  Ebola virus siRNA sense strand
auaccuucuuuacaauauagc

SEQ ID NO: 19867 - RNA, 21 nt, Artificial Sequence
  Ebola virus siRNA sense strand
uaccuucuuuacaauauagca

SEQ ID NO: 19868 - RNA, 21 nt, Artificial Sequence
  Ebola virus siRNA sense strand
accuucuuuacaauauagcag

SEQ ID NO: 19869 - RNA, 21 nt, Artificial Sequence
  Ebola virus siRNA sense strand
ccuucuuuacaauauagcaga

SEQ ID NO: 19870 - RNA, 21 nt, Artificial Sequence
  Ebola virus siRNA sense strand
cuucuuuacaauauagcagac

SEQ ID NO: 19871 - RNA, 21 nt, Artificial Sequence
  Ebola virus siRNA sense strand
uucuuuacaauauagcagacu

SEQ ID NO: 19872 - RNA, 21 nt, Artificial Sequence
  Ebola virus siRNA sense strand
ucuuuacaauauagcagacua

SEQ ID NO: 19873 - RNA, 21 nt, Artificial Sequence
  Ebola virus siRNA sense strand
cuuuacaauauagcagacuag

SEQ ID NO: 19874 - RNA, 21 nt, Artificial Sequence
  Ebola virus siRNA sense strand
uuuacaauauagcagacuaga

SEQ ID NO: 19875 - RNA, 21 nt, Artificial Sequence
  Ebola virus siRNA sense strand
uuacaauauagcagacuagau

SEQ ID NO: 19876 - RNA, 21 nt, Artificial Sequence
  Ebola virus siRNA sense strand
uacaauauagcagacuagaua

SEQ ID NO: 19877 - RNA, 21 nt, Artificial Sequence
  Ebola virus siRNA sense strand
acaauauagcagacuagauaa

SEQ ID NO: 19878 - RNA, 21 nt, Artificial Sequence
  Ebola virus siRNA sense strand
caauauagcagacuagauaau

SEQ ID NO: 19879 - RNA, 21 nt, Artificial Sequence
  Ebola virus siRNA sense strand
aauauagcagacuagauaaua

SEQ ID NO: 19880 - RNA, 21 nt, Artificial Sequence
  Ebola virus siRNA sense strand
auauagcagacuagauaauaa

SEQ ID NO: 19881 - RNA, 21 nt, Artificial Sequence
  Ebola virus siRNA sense strand
uauagcagacuagauaauaau

SEQ ID NO: 19882 - RNA, 21 nt, Artificial Sequence
  Ebola virus siRNA sense strand
auagcagacuagauaauaauc

SEQ ID NO: 19883 - RNA, 21 nt, Artificial Sequence
  Ebola virus siRNA sense strand
uagcagacuagauaauaaucu

SEQ ID NO: 19884 - RNA, 21 nt, Artificial Sequence
  Ebola virus siRNA sense strand
agcagacuagauaauaaucuu

SEQ ID NO: 19885 - RNA, 21 nt, Artificial Sequence
  Ebola virus siRNA sense strand
gcagacuagauaauaaucuuc

SEQ ID NO: 19886 - RNA, 21 nt, Artificial Sequence
  Ebola virus siRNA sense strand
cagacuagauaauaaucuucg

SEQ ID NO: 19887 - RNA, 21 nt, Artificial Sequence
  Ebola virus siRNA sense strand
agacuagauaauaaucuucgu

SEQ ID NO: 19888 - RNA, 21 nt, Artificial Sequence
  Ebola virus siRNA sense strand
gacuagauaauaaucuucgug

SEQ ID NO: 19889 - RNA, 21 nt, Artificial Sequence
  Ebola virus siRNA sense strand
acuagauaauaaucuucgugu

SEQ ID NO: 19890 - RNA, 21 nt, Artificial Sequence
  Ebola virus siRNA sense strand
cuagauaauaaucuucguguu

SEQ ID NO: 19891 - RNA, 21 nt, Artificial Sequence
  Ebola virus siRNA sense strand
uagauaauaaucuucguguua

SEQ ID NO: 19892 - RNA, 21 nt, Artificial Sequence
  Ebola virus siRNA sense strand
agauaauaaucuucguguuaa

SEQ ID NO: 19893 - RNA, 21 nt, Artificial Sequence
  Ebola virus siRNA sense strand
gauaauaaucuucguguuaau

SEQ ID NO: 19894 - RNA, 21 nt, Artificial Sequence
  Ebola virus siRNA sense strand
auaauaaucuucguguuaaug

SEQ ID NO: 19895 - RNA, 21 nt, Artificial Sequence
  Ebola virus siRNA sense strand
uaauaaucuucguguuaauga

SEQ ID NO: 19896 - RNA, 21 nt, Artificial Sequence
  Ebola virus siRNA sense strand
aauaaucuucguguuaaugau

SEQ ID NO: 19897 - RNA, 21 nt, Artificial Sequence
  Ebola virus siRNA sense strand
auaaucuucguguuaaugaua

SEQ ID NO: 19898 - RNA, 21 nt, Artificial Sequence
  Ebola virus siRNA sense strand
uaaucuucguguuaaugauaa

SEQ ID NO: 19899 - RNA, 21 nt, Artificial Sequence
  Ebola virus siRNA sense strand
aaucuucguguuaaugauaau

SEQ ID NO: 19900 - RNA, 21 nt, Artificial Sequence
  Ebola virus siRNA sense strand
aucuucguguuaaugauaauu

SEQ ID NO: 19901 - RNA, 21 nt, Artificial Sequence
  Ebola virus siRNA sense strand
ucuucguguuaaugauaauua

SEQ ID NO: 19902 - RNA, 21 nt, Artificial Sequence
  Ebola virus siRNA sense strand
cuucguguuaaugauaauuaa

SEQ ID NO: 19903 - RNA, 21 nt, Artificial Sequence
  Ebola virus siRNA sense strand
uucguguuaaugauaauuaag

SEQ ID NO: 19904 - RNA, 21 nt, Artificial Sequence
  Ebola virus siRNA sense strand
ucguguuaaugauaauuaaga

SEQ ID NO: 19905 - RNA, 21 nt, Artificial Sequence
  Ebola virus siRNA sense strand
cguguuaaugauaauuaagac

SEQ ID NO: 19906 - RNA, 21 nt, Artificial Sequence
  Ebola virus siRNA sense strand
guguuaaugauaauuaagaca

SEQ ID NO: 19907 - RNA, 21 nt, Artificial Sequence
  Ebola virus siRNA sense strand
uguuaaugauaauuaagacau

SEQ ID NO: 19908 - RNA, 21 nt, Artificial Sequence
  Ebola virus siRNA sense strand
guuaaugauaauuaagacauu

SEQ ID NO: 19909 - RNA, 21 nt, Artificial Sequence
  Ebola virus siRNA sense strand
uuaaugauaauuaagacauug

SEQ ID NO: 19910 - RNA, 21 nt, Artificial Sequence
  Ebola virus siRNA sense strand
uaaugauaauuaagacauuga

SEQ ID NO: 19911 - RNA, 21 nt, Artificial Sequence
  Ebola virus siRNA sense strand
aaugauaauuaagacauugac

SEQ ID NO: 19912 - RNA, 21 nt, Artificial Sequence
  Ebola virus siRNA sense strand
augauaauuaagacauugacc

SEQ ID NO: 19913 - RNA, 21 nt, Artificial Sequence
  Ebola virus siRNA sense strand
ugauaauuaagacauugacca

SEQ ID NO: 19914 - RNA, 21 nt, Artificial Sequence
  Ebola virus siRNA sense strand
gauaauuaagacauugaccac

SEQ ID NO: 19915 - RNA, 21 nt, Artificial Sequence
  Ebola virus siRNA sense strand
auaauuaagacauugaccacg

SEQ ID NO: 19916 - RNA, 21 nt, Artificial Sequence
  Ebola virus siRNA sense strand
uaauuaagacauugaccacgc

SEQ ID NO: 19917 - RNA, 21 nt, Artificial Sequence
  Ebola virus siRNA sense strand
aauuaagacauugaccacgcu

SEQ ID NO: 19918 - RNA, 21 nt, Artificial Sequence
  Ebola virus siRNA sense strand
auuaagacauugaccacgcuc

SEQ ID NO: 19919 - RNA, 21 nt, Artificial Sequence
  Ebola virus siRNA sense strand
uuaagacauugaccacgcuca

SEQ ID NO: 19920 - RNA, 21 nt, Artificial Sequence
  Ebola virus siRNA sense strand
uaagacauugaccacgcucau

SEQ ID NO: 19921 - RNA, 21 nt, Artificial Sequence
  Ebola virus siRNA sense strand
aagacauugaccacgcucauc

SEQ ID NO: 19922 - RNA, 21 nt, Artificial Sequence
  Ebola virus siRNA sense strand
agacauugaccacgcucauca

SEQ ID NO: 19923 - RNA, 21 nt, Artificial Sequence
  Ebola virus siRNA sense strand
gacauugaccacgcucaucag

SEQ ID NO: 19924 - RNA, 21 nt, Artificial Sequence
  Ebola virus siRNA sense strand
acauugaccacgcucaucaga

SEQ ID NO: 19925 - RNA, 21 nt, Artificial Sequence
  Ebola virus siRNA sense strand
cauugaccacgcucaucagaa

SEQ ID NO: 19926 - RNA, 21 nt, Artificial Sequence
  Ebola virus siRNA sense strand
auugaccacgcucaucagaag

SEQ ID NO: 19927 - RNA, 21 nt, Artificial Sequence
  Ebola virus siRNA sense strand
uugaccacgcucaucagaagg

SEQ ID NO: 19928 - RNA, 21 nt, Artificial Sequence
  Ebola virus siRNA sense strand
ugaccacgcucaucagaaggc

SEQ ID NO: 19929 - RNA, 21 nt, Artificial Sequence
  Ebola virus siRNA sense strand
gaccacgcucaucagaaggcu

SEQ ID NO: 19930 - RNA, 21 nt, Artificial Sequence
  Ebola virus siRNA sense strand
accacgcucaucagaaggcuc

SEQ ID NO: 19931 - RNA, 21 nt, Artificial Sequence
  Ebola virus siRNA sense strand
ccacgcucaucagaaggcucg

SEQ ID NO: 19932 - RNA, 21 nt, Artificial Sequence
  Ebola virus siRNA sense strand
cacgcucaucagaaggcucgc

SEQ ID NO: 19933 - RNA, 21 nt, Artificial Sequence
  Ebola virus siRNA sense strand
acgcucaucagaaggcucgcc

SEQ ID NO: 19934 - RNA, 21 nt, Artificial Sequence
  Ebola virus siRNA sense strand
cgcucaucagaaggcucgcca

SEQ ID NO: 19935 - RNA, 21 nt, Artificial Sequence
  Ebola virus siRNA sense strand
gcucaucagaaggcucgccag

SEQ ID NO: 19936 - RNA, 21 nt, Artificial Sequence
  Ebola virus siRNA sense strand
cucaucagaaggcucgccaga

SEQ ID NO: 19937 - RNA, 21 nt, Artificial Sequence
  Ebola virus siRNA sense strand
ucaucagaaggcucgccagaa

SEQ ID NO: 19938 - RNA, 21 nt, Artificial Sequence
  Ebola virus siRNA sense strand
caucagaaggcucgccagaau

SEQ ID NO: 19939 - RNA, 21 nt, Artificial Sequence
  Ebola virus siRNA sense strand
aucagaaggcucgccagaaua

SEQ ID NO: 19940 - RNA, 21 nt, Artificial Sequence
  Ebola virus siRNA sense strand
ucagaaggcucgccagaauaa

SEQ ID NO: 19941 - RNA, 21 nt, Artificial Sequence
  Ebola virus siRNA sense strand
cagaaggcucgccagaauaaa

SEQ ID NO: 19942 - RNA, 21 nt, Artificial Sequence
  Ebola virus siRNA sense strand
agaaggcucgccagaauaaac

SEQ ID NO: 19943 - RNA, 21 nt, Artificial Sequence
  Ebola virus siRNA sense strand
gaaggcucgccagaauaaacg

SEQ ID NO: 19944 - RNA, 21 nt, Artificial Sequence
  Ebola virus siRNA sense strand
aaggcucgccagaauaaacgu

SEQ ID NO: 19945 - RNA, 21 nt, Artificial Sequence
  Ebola virus siRNA sense strand
aggcucgccagaauaaacguu

SEQ ID NO: 19946 - RNA, 21 nt, Artificial Sequence
  Ebola virus siRNA sense strand
ggcucgccagaauaaacguug

SEQ ID NO: 19947 - RNA, 21 nt, Artificial Sequence
  Ebola virus siRNA sense strand
gcucgccagaauaaacguugc

SEQ ID NO: 19948 - RNA, 21 nt, Artificial Sequence
  Ebola virus siRNA sense strand
cucgccagaauaaacguugca

SEQ ID NO: 19949 - RNA, 21 nt, Artificial Sequence
  Ebola virus siRNA sense strand
ucgccagaauaaacguugcaa

SEQ ID NO: 19950 - RNA, 21 nt, Artificial Sequence
  Ebola virus siRNA sense strand
cgccagaauaaacguugcaaa

SEQ ID NO: 19951 - RNA, 21 nt, Artificial Sequence
  Ebola virus siRNA sense strand
gccagaauaaacguugcaaaa

SEQ ID NO: 19952 - RNA, 21 nt, Artificial Sequence
  Ebola virus siRNA sense strand
ccagaauaaacguugcaaaaa

SEQ ID NO: 19953 - RNA, 21 nt, Artificial Sequence
  Ebola virus siRNA sense strand
cagaauaaacguugcaaaaag

SEQ ID NO: 19954 - RNA, 21 nt, Artificial Sequence
  Ebola virus siRNA sense strand
agaauaaacguugcaaaaagg

SEQ ID NO: 19955 - RNA, 21 nt, Artificial Sequence
  Ebola virus siRNA sense strand
gaauaaacguugcaaaaagga

SEQ ID NO: 19956 - RNA, 21 nt, Artificial Sequence
  Ebola virus siRNA sense strand
aauaaacguugcaaaaaggau

SEQ ID NO: 19957 - RNA, 21 nt, Artificial Sequence
  Ebola virus siRNA sense strand
auaaacguugcaaaaaggauu

SEQ ID NO: 19958 - RNA, 21 nt, Artificial Sequence
  Ebola virus siRNA sense strand
uaaacguugcaaaaaggauuc

SEQ ID NO: 19959 - RNA, 21 nt, Artificial Sequence
  Ebola virus siRNA sense strand
aaacguugcaaaaaggauucc

SEQ ID NO: 19960 - RNA, 21 nt, Artificial Sequence
  Ebola virus siRNA sense strand
aacguugcaaaaaggauuccu

SEQ ID NO: 19961 - RNA, 21 nt, Artificial Sequence
  Ebola virus siRNA sense strand
acguugcaaaaaggauuccug

SEQ ID NO: 19962 - RNA, 21 nt, Artificial Sequence
  Ebola virus siRNA sense strand
cguugcaaaaaggauuccugg

SEQ ID NO: 19963 - RNA, 21 nt, Artificial Sequence
  Ebola virus siRNA sense strand
guugcaaaaaggauuccugga

SEQ ID NO: 19964 - RNA, 21 nt, Artificial Sequence
  Ebola virus siRNA sense strand
uugcaaaaaggauuccuggaa

SEQ ID NO: 19965 - RNA, 21 nt, Artificial Sequence
  Ebola virus siRNA sense strand
ugcaaaaaggauuccuggaaa

SEQ ID NO: 19966 - RNA, 21 nt, Artificial Sequence
  Ebola virus siRNA sense strand
gcaaaaaggauuccuggaaaa

SEQ ID NO: 19967 - RNA, 21 nt, Artificial Sequence
  Ebola virus siRNA sense strand
caaaaaggauuccuggaaaaa

SEQ ID NO: 19968 - RNA, 21 nt, Artificial Sequence
  Ebola virus siRNA sense strand
aaaaaggauuccuggaaaaau

SEQ ID NO: 19969 - RNA, 21 nt, Artificial Sequence
  Ebola virus siRNA sense strand
aaaaggauuccuggaaaaaug

SEQ ID NO: 19970 - RNA, 21 nt, Artificial Sequence
  Ebola virus siRNA sense strand
aaaggauuccuggaaaaaugg

SEQ ID NO: 19971 - RNA, 21 nt, Artificial Sequence
  Ebola virus siRNA sense strand
aaggauuccuggaaaaauggu

SEQ ID NO: 19972 - RNA, 21 nt, Artificial Sequence
  Ebola virus siRNA sense strand
aggauuccuggaaaaaugguc

SEQ ID NO: 19973 - RNA, 21 nt, Artificial Sequence
  Ebola virus siRNA sense strand
ggauuccuggaaaaauggucg

SEQ ID NO: 19974 - RNA, 21 nt, Artificial Sequence
  Ebola virus siRNA sense strand
gauuccuggaaaaauggucgc

SEQ ID NO: 19975 - RNA, 21 nt, Artificial Sequence
  Ebola virus siRNA sense strand
auuccuggaaaaauggucgca

SEQ ID NO: 19976 - RNA, 21 nt, Artificial Sequence
  Ebola virus siRNA sense strand
uuccuggaaaaauggucgcac

SEQ ID NO: 19977 - RNA, 21 nt, Artificial Sequence
  Ebola virus siRNA sense strand
uccuggaaaaauggucgcaca

SEQ ID NO: 19978 - RNA, 21 nt, Artificial Sequence
  Ebola virus siRNA sense strand
ccuggaaaaauggucgcacac

SEQ ID NO: 19979 - RNA, 21 nt, Artificial Sequence
  Ebola virus siRNA sense strand
cuggaaaaauggucgcacaca

SEQ ID NO: 19980 - RNA, 21 nt, Artificial Sequence
  Ebola virus siRNA sense strand
uggaaaaauggucgcacacaa

SEQ ID NO: 19981 - RNA, 21 nt, Artificial Sequence
  Ebola virus siRNA sense strand
ggaaaaauggucgcacacaaa

SEQ ID NO: 19982 - RNA, 21 nt, Artificial Sequence
  Ebola virus siRNA sense strand
gaaaaauggucgcacacaaaa

SEQ ID NO: 19983 - RNA, 21 nt, Artificial Sequence
  Ebola virus siRNA sense strand
aaaaauggucgcacacaaaaa

SEQ ID NO: 19984 - RNA, 21 nt, Artificial Sequence
  Ebola virus siRNA sense strand
aaaauggucgcacacaaaaau

SEQ ID NO: 19985 - RNA, 21 nt, Artificial Sequence
  Ebola virus siRNA sense strand
aaauggucgcacacaaaaauu

SEQ ID NO: 19986 - RNA, 21 nt, Artificial Sequence
  Ebola virus siRNA sense strand
aauggucgcacacaaaaauuu

SEQ ID NO: 19987 - RNA, 21 nt, Artificial Sequence
  Ebola virus siRNA sense strand
auggucgcacacaaaaauuua

SEQ ID NO: 19988 - RNA, 21 nt, Artificial Sequence
  Ebola virus siRNA sense strand
uggucgcacacaaaaauuuaa

SEQ ID NO: 19989 - RNA, 21 nt, Artificial Sequence
  Ebola virus siRNA sense strand
ggucgcacacaaaaauuuaaa

SEQ ID NO: 19990 - RNA, 21 nt, Artificial Sequence
  Ebola virus siRNA sense strand
gucgcacacaaaaauuuaaaa

SEQ ID NO: 19991 - RNA, 21 nt, Artificial Sequence
  Ebola virus siRNA sense strand
ucgcacacaaaaauuuaaaaa

SEQ ID NO: 19992 - RNA, 21 nt, Artificial Sequence
  Ebola virus siRNA sense strand
cgcacacaaaaauuuaaaaau

SEQ ID NO: 19993 - RNA, 21 nt, Artificial Sequence
  Ebola virus siRNA sense strand
gcacacaaaaauuuaaaaaua

SEQ ID NO: 19994 - RNA, 21 nt, Artificial Sequence
  Ebola virus siRNA sense strand
cacacaaaaauuuaaaaauaa

SEQ ID NO: 19995 - RNA, 21 nt, Artificial Sequence
  Ebola virus siRNA sense strand
acacaaaaauuuaaaaauaaa

SEQ ID NO: 19996 - RNA, 21 nt, Artificial Sequence
  Ebola virus siRNA sense strand
cacaaaaauuuaaaaauaaau

SEQ ID NO: 19997 - RNA, 21 nt, Artificial Sequence
  Ebola virus siRNA sense strand
acaaaaauuuaaaaauaaauc

SEQ ID NO: 19998 - RNA, 21 nt, Artificial Sequence
  Ebola virus siRNA sense strand
caaaaauuuaaaaauaaaucu

SEQ ID NO: 19999 - RNA, 21 nt, Artificial Sequence
  Ebola virus siRNA sense strand
aaaaauuuaaaaauaaaucua

SEQ ID NO: 20000 - RNA, 21 nt, Artificial Sequence
  Ebola virus siRNA sense strand
aaaauuuaaaaauaaaucuau

SEQ ID NO: 20001 - RNA, 21 nt, Artificial Sequence
  Ebola virus siRNA sense strand
aaauuuaaaaauaaaucuauu

SEQ ID NO: 20002 - RNA, 21 nt, Artificial Sequence
  Ebola virus siRNA sense strand
aauuuaaaaauaaaucuauuu

SEQ ID NO: 20003 - RNA, 21 nt, Artificial Sequence
  Ebola virus siRNA sense strand
auuuaaaaauaaaucuauuuc

SEQ ID NO: 20004 - RNA, 21 nt, Artificial Sequence
  Ebola virus siRNA sense strand
uuuaaaaauaaaucuauuucu

SEQ ID NO: 20005 - RNA, 21 nt, Artificial Sequence
  Ebola virus siRNA sense strand
uuaaaaauaaaucuauuucuu

SEQ ID NO: 20006 - RNA, 21 nt, Artificial Sequence
  Ebola virus siRNA sense strand
uaaaaauaaaucuauuucuuc

SEQ ID NO: 20007 - RNA, 21 nt, Artificial Sequence
  Ebola virus siRNA sense strand
aaaaauaaaucuauuucuucu

SEQ ID NO: 20008 - RNA, 21 nt, Artificial Sequence
  Ebola virus siRNA sense strand
aaaauaaaucuauuucuucuu

SEQ ID NO: 20009 - RNA, 21 nt, Artificial Sequence
  Ebola virus siRNA sense strand
aaauaaaucuauuucuucuuu

SEQ ID NO: 20010 - RNA, 21 nt, Artificial Sequence
  Ebola virus siRNA sense strand
aauaaaucuauuucuucuuuu

SEQ ID NO: 20011 - RNA, 21 nt, Artificial Sequence
  Ebola virus siRNA sense strand
auaaaucuauuucuucuuuuu

SEQ ID NO: 20012 - RNA, 21 nt, Artificial Sequence
  Ebola virus siRNA sense strand
uaaaucuauuucuucuuuuuu

SEQ ID NO: 20013 - RNA, 21 nt, Artificial Sequence
  Ebola virus siRNA sense strand
aaaucuauuucuucuuuuuug

SEQ ID NO: 20014 - RNA, 21 nt, Artificial Sequence
  Ebola virus siRNA sense strand
aaucuauuucuucuuuuuugu

SEQ ID NO: 20015 - RNA, 21 nt, Artificial Sequence
  Ebola virus siRNA sense strand
aucuauuucuucuuuuuugug

SEQ ID NO: 20016 - RNA, 21 nt, Artificial Sequence
  Ebola virus siRNA sense strand
ucuauuucuucuuuuuugugu

SEQ ID NO: 20017 - RNA, 21 nt, Artificial Sequence
  Ebola virus siRNA sense strand
cuauuucuucuuuuuugugug

SEQ ID NO: 20018 - RNA, 21 nt, Artificial Sequence
  Ebola virus siRNA sense strand
uauuucuucuuuuuugugugu

SEQ ID NO: 20019 - RNA, 21 nt, Artificial Sequence
  Ebola virus siRNA sense strand
auuucuucuuuuuuguguguc

SEQ ID NO: 20020 - RNA, 21 nt, Artificial Sequence
  Ebola virus siRNA sense strand
uuucuucuuuuuugugugucc

SEQ ID NO: 20021 - RNA, 21 nt, Artificial Sequence
  Ebola virus siRNA sense strand
uucuucuuuuuugugugucca

SEQ ID NO: 20022 - RNA, 21 nt, Artificial Sequence
  Marburg virus siRNA sense strand
gacacacaaaaacaagagaug

SEQ ID NO: 20023 - RNA, 21 nt, Artificial Sequence
  Marburg virus siRNA sense strand
acacacaaaaacaagagauga

SEQ ID NO: 20024 - RNA, 21 nt, Artificial Sequence
  Marburg virus siRNA sense strand
cacacaaaaacaagagaugau

SEQ ID NO: 20025 - RNA, 21 nt, Artificial Sequence
  Marburg virus siRNA sense strand
acacaaaaacaagagaugaug

SEQ ID NO: 20026 - RNA, 21 nt, Artificial Sequence
  Marburg virus siRNA sense strand
cacaaaaacaagagaugauga

SEQ ID NO: 20027 - RNA, 21 nt, Artificial Sequence
  Marburg virus siRNA sense strand
acaaaaacaagagaugaugau

SEQ ID NO: 20028 - RNA, 21 nt, Artificial Sequence
  Marburg virus siRNA sense strand
caaaaacaagagaugaugauu

SEQ ID NO: 20029 - RNA, 21 nt, Artificial Sequence
  Marburg virus siRNA sense strand
aaaaacaagagaugaugauuu

SEQ ID NO: 20030 - RNA, 21 nt, Artificial Sequence
  Marburg virus siRNA sense strand
aaaacaagagaugaugauuuu

SEQ ID NO: 20031 - RNA, 21 nt, Artificial Sequence
  Marburg virus siRNA sense strand
aaacaagagaugaugauuuug

SEQ ID NO: 20032 - RNA, 21 nt, Artificial Sequence
  Marburg virus siRNA sense strand
aacaagagaugaugauuuugu

SEQ ID NO: 20033 - RNA, 21 nt, Artificial Sequence
  Marburg virus siRNA sense strand
acaagagaugaugauuuugug

SEQ ID NO: 20034 - RNA, 21 nt, Artificial Sequence
  Marburg virus siRNA sense strand
caagagaugaugauuuugugu

SEQ ID NO: 20035 - RNA, 21 nt, Artificial Sequence
  Marburg virus siRNA sense strand
aagagaugaugauuuugugua

SEQ ID NO: 20036 - RNA, 21 nt, Artificial Sequence
  Marburg virus siRNA sense strand
agagaugaugauuuuguguau

SEQ ID NO: 20037 - RNA, 21 nt, Artificial Sequence
  Marburg virus siRNA sense strand
gagaugaugauuuuguguauc

SEQ ID NO: 20038 - RNA, 21 nt, Artificial Sequence
  Marburg virus siRNA sense strand
agaugaugauuuuguguauca

SEQ ID NO: 20039 - RNA, 21 nt, Artificial Sequence
  Marburg virus siRNA sense strand
gaugaugauuuuguguaucau

SEQ ID NO: 20040 - RNA, 21 nt, Artificial Sequence
  Marburg virus siRNA sense strand
augaugauuuuguguaucaua

SEQ ID NO: 20041 - RNA, 21 nt, Artificial Sequence
  Marburg virus siRNA sense strand
ugaugauuuuguguaucauau

SEQ ID NO: 20042 - RNA, 21 nt, Artificial Sequence
  Marburg virus siRNA sense strand
gaugauuuuguguaucauaua

SEQ ID NO: 20043 - RNA, 21 nt, Artificial Sequence
  Marburg virus siRNA sense strand
augauuuuguguaucauauaa

SEQ ID NO: 20044 - RNA, 21 nt, Artificial Sequence
  Marburg virus siRNA sense strand
ugauuuuguguaucauauaaa

SEQ ID NO: 20045 - RNA, 21 nt, Artificial Sequence
  Marburg virus siRNA sense strand
gauuuuguguaucauauaaau

SEQ ID NO: 20046 - RNA, 21 nt, Artificial Sequence
  Marburg virus siRNA sense strand
auuuuguguaucauauaaaua

SEQ ID NO: 20047 - RNA, 21 nt, Artificial Sequence
  Marburg virus siRNA sense strand
uuuuguguaucauauaaauaa

SEQ ID NO: 20048 - RNA, 21 nt, Artificial Sequence
  Marburg virus siRNA sense strand
uuuguguaucauauaaauaaa

SEQ ID NO: 20049 - RNA, 21 nt, Artificial Sequence
  Marburg virus siRNA sense strand
uuguguaucauauaaauaaag

SEQ ID NO: 20050 - RNA, 21 nt, Artificial Sequence
  Marburg virus siRNA sense strand
uguguaucauauaaauaaaga

SEQ ID NO: 20051 - RNA, 21 nt, Artificial Sequence
  Marburg virus siRNA sense strand
guguaucauauaaauaaagaa

SEQ ID NO: 20052 - RNA, 21 nt, Artificial Sequence
  Marburg virus siRNA sense strand
uguaucauauaaauaaagaag

SEQ ID NO: 20053 - RNA, 21 nt, Artificial Sequence
  Marburg virus siRNA sense strand
guaucauauaaauaaagaaga

SEQ ID NO: 20054 - RNA, 21 nt, Artificial Sequence
  Marburg virus siRNA sense strand
uaucauauaaauaaagaagaa

SEQ ID NO: 20055 - RNA, 21 nt, Artificial Sequence
  Marburg virus siRNA sense strand
aucauauaaauaaagaagaau

SEQ ID NO: 20056 - RNA, 21 nt, Artificial Sequence
  Marburg virus siRNA sense strand
ucauauaaauaaagaagaaua

SEQ ID NO: 20057 - RNA, 21 nt, Artificial Sequence
  Marburg virus siRNA sense strand
cauauaaauaaagaagaauau

SEQ ID NO: 20058 - RNA, 21 nt, Artificial Sequence
  Marburg virus siRNA sense strand
auauaaauaaagaagaauauu

SEQ ID NO: 20059 - RNA, 21 nt, Artificial Sequence
  Marburg virus siRNA sense strand
uauaaauaaagaagaauauua

SEQ ID NO: 20060 - RNA, 21 nt, Artificial Sequence
  Marburg virus siRNA sense strand
auaaauaaagaagaauauuaa

SEQ ID NO: 20061 - RNA, 21 nt, Artificial Sequence
  Marburg virus siRNA sense strand
uaaauaaagaagaauauuaac

SEQ ID NO: 20062 - RNA, 21 nt, Artificial Sequence
  Marburg virus siRNA sense strand
aaauaaagaagaauauuaaca

SEQ ID NO: 20063 - RNA, 21 nt, Artificial Sequence
  Marburg virus siRNA sense strand
aauaaagaagaauauuaacau

SEQ ID NO: 20064 - RNA, 21 nt, Artificial Sequence
  Marburg virus siRNA sense strand
auaaagaagaauauuaacauu

SEQ ID NO: 20065 - RNA, 21 nt, Artificial Sequence
  Marburg virus siRNA sense strand
uaaagaagaauauuaacauug

SEQ ID NO: 20066 - RNA, 21 nt, Artificial Sequence
  Marburg virus siRNA sense strand
aaagaagaauauuaacauuga

SEQ ID NO: 20067 - RNA, 21 nt, Artificial Sequence
  Marburg virus siRNA sense strand
aagaagaauauuaacauugac

SEQ ID NO: 20068 - RNA, 21 nt, Artificial Sequence
  Marburg virus siRNA sense strand
agaagaauauuaacauugaca

SEQ ID NO: 20069 - RNA, 21 nt, Artificial Sequence
  Marburg virus siRNA sense strand
gaagaauauuaacauugacau

SEQ ID NO: 20070 - RNA, 21 nt, Artificial Sequence
  Marburg virus siRNA sense strand
aagaauauuaacauugacauu

SEQ ID NO: 20071 - RNA, 21 nt, Artificial Sequence
  Marburg virus siRNA sense strand
agaauauuaacauugacauug

SEQ ID NO: 20072 - RNA, 21 nt, Artificial Sequence
  Marburg virus siRNA sense strand
gaauauuaacauugacauuga

SEQ ID NO: 20073 - RNA, 21 nt, Artificial Sequence
  Marburg virus siRNA sense strand
aauauuaacauugacauugag

SEQ ID NO: 20074 - RNA, 21 nt, Artificial Sequence
  Marburg virus siRNA sense strand
auauuaacauugacauugaga

SEQ ID NO: 20075 - RNA, 21 nt, Artificial Sequence
  Marburg virus siRNA sense strand
uauuaacauugacauugagac

SEQ ID NO: 20076 - RNA, 21 nt, Artificial Sequence
  Marburg virus siRNA sense strand
auuaacauugacauugagacu

SEQ ID NO: 20077 - RNA, 21 nt, Artificial Sequence
  Marburg virus siRNA sense strand
uuaacauugacauugagacuu

SEQ ID NO: 20078 - RNA, 21 nt, Artificial Sequence
  Marburg virus siRNA sense strand
uaacauugacauugagacuug

SEQ ID NO: 20079 - RNA, 21 nt, Artificial Sequence
  Marburg virus siRNA sense strand
aacauugacauugagacuugu

SEQ ID NO: 20080 - RNA, 21 nt, Artificial Sequence
  Marburg virus siRNA sense strand
acauugacauugagacuuguc

SEQ ID NO: 20081 - RNA, 21 nt, Artificial Sequence
  Marburg virus siRNA sense strand
cauugacauugagacuuguca

SEQ ID NO: 20082 - RNA, 21 nt, Artificial Sequence
  Marburg virus siRNA sense strand
auugacauugagacuugucag

SEQ ID NO: 20083 - RNA, 21 nt, Artificial Sequence
  Marburg virus siRNA sense strand
uugacauugagacuugucagu

SEQ ID NO: 20084 - RNA, 21 nt, Artificial Sequence
  Marburg virus siRNA sense strand
ugacauugagacuugucaguc

SEQ ID NO: 20085 - RNA, 21 nt, Artificial Sequence
  Marburg virus siRNA sense strand
gacauugagacuugucagucu

SEQ ID NO: 20086 - RNA, 21 nt, Artificial Sequence
  Marburg virus siRNA sense strand
acauugagacuugucagucug

SEQ ID NO: 20087 - RNA, 21 nt, Artificial Sequence
  Marburg virus siRNA sense strand
cauugagacuugucagucugu

SEQ ID NO: 20088 - RNA, 21 nt, Artificial Sequence
  Marburg virus siRNA sense strand
auugagacuugucagucuguu

SEQ ID NO: 20089 - RNA, 21 nt, Artificial Sequence
  Marburg virus siRNA sense strand
uugagacuugucagucuguua

SEQ ID NO: 20090 - RNA, 21 nt, Artificial Sequence
  Marburg virus siRNA sense strand
ugagacuugucagucuguuaa

SEQ ID NO: 20091 - RNA, 21 nt, Artificial Sequence
  Marburg virus siRNA sense strand
gagacuugucagucuguuaau

SEQ ID NO: 20092 - RNA, 21 nt, Artificial Sequence
  Marburg virus siRNA sense strand
agacuugucagucuguuaaua

SEQ ID NO: 20093 - RNA, 21 nt, Artificial Sequence
  Marburg virus siRNA sense strand
gacuugucagucuguuaauau

SEQ ID NO: 20094 - RNA, 21 nt, Artificial Sequence
  Marburg virus siRNA sense strand
acuugucagucuguuaauauu

SEQ ID NO: 20095 - RNA, 21 nt, Artificial Sequence
  Marburg virus siRNA sense strand
cuugucagucuguuaauauuc

SEQ ID NO: 20096 - RNA, 21 nt, Artificial Sequence
  Marburg virus siRNA sense strand
uugucagucuguuaauauucu

SEQ ID NO: 20097 - RNA, 21 nt, Artificial Sequence
  Marburg virus siRNA sense strand
ugucagucuguuaauauucuu

SEQ ID NO: 20098 - RNA, 21 nt, Artificial Sequence
  Marburg virus siRNA sense strand
gucagucuguuaauauucuug

SEQ ID NO: 20099 - RNA, 21 nt, Artificial Sequence
  Marburg virus siRNA sense strand
ucagucuguuaauauucuuga

SEQ ID NO: 20100 - RNA, 21 nt, Artificial Sequence
  Marburg virus siRNA sense strand
cagucuguuaauauucuugaa

SEQ ID NO: 20101 - RNA, 21 nt, Artificial Sequence
  Marburg virus siRNA sense strand
agucuguuaauauucuugaaa

SEQ ID NO: 20102 - RNA, 21 nt, Artificial Sequence
  Marburg virus siRNA sense strand
gucuguuaauauucuugaaaa

SEQ ID NO: 20103 - RNA, 21 nt, Artificial Sequence
  Marburg virus siRNA sense strand
ucuguuaauauucuugaaaag

SEQ ID NO: 20104 - RNA, 21 nt, Artificial Sequence
  Marburg virus siRNA sense strand
cuguuaauauucuugaaaaga

SEQ ID NO: 20105 - RNA, 21 nt, Artificial Sequence
  Marburg virus siRNA sense strand
uguuaauauucuugaaaagau

SEQ ID NO: 20106 - RNA, 21 nt, Artificial Sequence
  Marburg virus siRNA sense strand
guuaauauucuugaaaagaug

SEQ ID NO: 20107 - RNA, 21 nt, Artificial Sequence
  Marburg virus siRNA sense strand
uuaauauucuugaaaagaugg

SEQ ID NO: 20108 - RNA, 21 nt, Artificial Sequence
  Marburg virus siRNA sense strand
uaauauucuugaaaagaugga

SEQ ID NO: 20109 - RNA, 21 nt, Artificial Sequence
  Marburg virus siRNA sense strand
aauauucuugaaaagauggau

SEQ ID NO: 20110 - RNA, 21 nt, Artificial Sequence
  Marburg virus siRNA sense strand
auauucuugaaaagauggauu

SEQ ID NO: 20111 - RNA, 21 nt, Artificial Sequence
  Marburg virus siRNA sense strand
uauucuugaaaagauggauuu

SEQ ID NO: 20112 - RNA, 21 nt, Artificial Sequence
  Marburg virus siRNA sense strand
auucuugaaaagauggauuua

SEQ ID NO: 20113 - RNA, 21 nt, Artificial Sequence
  Marburg virus siRNA sense strand
uucuugaaaagauggauuuac

SEQ ID NO: 20114 - RNA, 21 nt, Artificial Sequence
  Marburg virus siRNA sense strand
ucuugaaaagauggauuuaca

SEQ ID NO: 20115 - RNA, 21 nt, Artificial Sequence
  Marburg virus siRNA sense strand
cuugaaaagauggauuuacau

SEQ ID NO: 20116 - RNA, 21 nt, Artificial Sequence
  Marburg virus siRNA sense strand
uugaaaagauggauuuacaua

SEQ ID NO: 20117 - RNA, 21 nt, Artificial Sequence
  Marburg virus siRNA sense strand
ugaaaagauggauuuacauag

SEQ ID NO: 20118 - RNA, 21 nt, Artificial Sequence
  Marburg virus siRNA sense strand
gaaaagauggauuuacauagc

SEQ ID NO: 20119 - RNA, 21 nt, Artificial Sequence
  Marburg virus siRNA sense strand
aaaagauggauuuacauagcu

SEQ ID NO: 20120 - RNA, 21 nt, Artificial Sequence
  Marburg virus siRNA sense strand
aaagauggauuuacauagcuu

SEQ ID NO: 20121 - RNA, 21 nt, Artificial Sequence
  Marburg virus siRNA sense strand
aagauggauuuacauagcuug

SEQ ID NO: 20122 - RNA, 21 nt, Artificial Sequence
  Marburg virus siRNA sense strand
agauggauuuacauagcuugu

SEQ ID NO: 20123 - RNA, 21 nt, Artificial Sequence
  Marburg virus siRNA sense strand
gauggauuuacauagcuuguu

SEQ ID NO: 20124 - RNA, 21 nt, Artificial Sequence
  Marburg virus siRNA sense strand
auggauuuacauagcuuguua

SEQ ID NO: 20125 - RNA, 21 nt, Artificial Sequence
  Marburg virus siRNA sense strand
uggauuuacauagcuuguuag

SEQ ID NO: 20126 - RNA, 21 nt, Artificial Sequence
  Marburg virus siRNA sense strand
ggauuuacauagcuuguuaga

SEQ ID NO: 20127 - RNA, 21 nt, Artificial Sequence
  Marburg virus siRNA sense strand
gauuuacauagcuuguuagag

SEQ ID NO: 20128 - RNA, 21 nt, Artificial Sequence
  Marburg virus siRNA sense strand
auuuacauagcuuguuagagu

SEQ ID NO: 20129 - RNA, 21 nt, Artificial Sequence
  Marburg virus siRNA sense strand
uuuacauagcuuguuagaguu

SEQ ID NO: 20130 - RNA, 21 nt, Artificial Sequence
  Marburg virus siRNA sense strand
uuacauagcuuguuagaguug

SEQ ID NO: 20131 - RNA, 21 nt, Artificial Sequence
  Marburg virus siRNA sense strand
uacauagcuuguuagaguugg

SEQ ID NO: 20132 - RNA, 21 nt, Artificial Sequence
  Marburg virus siRNA sense strand
acauagcuuguuagaguuggg

SEQ ID NO: 20133 - RNA, 21 nt, Artificial Sequence
  Marburg virus siRNA sense strand
cauagcuuguuagaguugggu

SEQ ID NO: 20134 - RNA, 21 nt, Artificial Sequence
  Marburg virus siRNA sense strand
auagcuuguuagaguugggua

SEQ ID NO: 20135 - RNA, 21 nt, Artificial Sequence
  Marburg virus siRNA sense strand
uagcuuguuagaguuggguac

SEQ ID NO: 20136 - RNA, 21 nt, Artificial Sequence
  Marburg virus siRNA sense strand
agcuuguuagaguuggguaca

SEQ ID NO: 20137 - RNA, 21 nt, Artificial Sequence
  Marburg virus siRNA sense strand
gcuuguuagaguuggguacaa

SEQ ID NO: 20138 - RNA, 21 nt, Artificial Sequence
  Marburg virus siRNA sense strand
cuuguuagaguuggguacaaa

SEQ ID NO: 20139 - RNA, 21 nt, Artificial Sequence
  Marburg virus siRNA sense strand
uuguuagaguuggguacaaaa

SEQ ID NO: 20140 - RNA, 21 nt, Artificial Sequence
  Marburg virus siRNA sense strand
uguuagaguuggguacaaaac

SEQ ID NO: 20141 - RNA, 21 nt, Artificial Sequence
  Marburg virus siRNA sense strand
guuagaguuggguacaaaacc

SEQ ID NO: 20142 - RNA, 21 nt, Artificial Sequence
  Marburg virus siRNA sense strand
uuagaguuggguacaaaaccc

SEQ ID NO: 20143 - RNA, 21 nt, Artificial Sequence
  Marburg virus siRNA sense strand
uagaguuggguacaaaaccca

SEQ ID NO: 20144 - RNA, 21 nt, Artificial Sequence
  Marburg virus siRNA sense strand
agaguuggguacaaaacccac

SEQ ID NO: 20145 - RNA, 21 nt, Artificial Sequence
  Marburg virus siRNA sense strand
gaguuggguacaaaacccacu

SEQ ID NO: 20146 - RNA, 21 nt, Artificial Sequence
  Marburg virus siRNA sense strand
aguuggguacaaaacccacug

SEQ ID NO: 20147 - RNA, 21 nt, Artificial Sequence
  Marburg virus siRNA sense strand
guuggguacaaaacccacugc

SEQ ID NO: 20148 - RNA, 21 nt, Artificial Sequence
  Marburg virus siRNA sense strand
uuggguacaaaacccacugcc

SEQ ID NO: 20149 - RNA, 21 nt, Artificial Sequence
  Marburg virus siRNA sense strand
uggguacaaaacccacugccc

SEQ ID NO: 20150 - RNA, 21 nt, Artificial Sequence
  Marburg virus siRNA sense strand
ggguacaaaacccacugcccc

SEQ ID NO: 20151 - RNA, 21 nt, Artificial Sequence
  Marburg virus siRNA sense strand
gguacaaaacccacugccccu

SEQ ID NO: 20152 - RNA, 21 nt, Artificial Sequence
  Marburg virus siRNA sense strand
guacaaaacccacugccccuc

SEQ ID NO: 20153 - RNA, 21 nt, Artificial Sequence
  Marburg virus siRNA sense strand
uacaaaacccacugccccuca

SEQ ID NO: 20154 - RNA, 21 nt, Artificial Sequence
  Marburg virus siRNA sense strand
acaaaacccacugccccucau

SEQ ID NO: 20155 - RNA, 21 nt, Artificial Sequence
  Marburg virus siRNA sense strand
caaaacccacugccccucaug

SEQ ID NO: 20156 - RNA, 21 nt, Artificial Sequence
  Marburg virus siRNA sense strand
aaaacccacugccccucaugu

SEQ ID NO: 20157 - RNA, 21 nt, Artificial Sequence
  Marburg virus siRNA sense strand
aaacccacugccccucauguu

SEQ ID NO: 20158 - RNA, 21 nt, Artificial Sequence
  Marburg virus siRNA sense strand
aacccacugccccucauguuc

SEQ ID NO: 20159 - RNA, 21 nt, Artificial Sequence
  Marburg virus siRNA sense strand
acccacugccccucauguucg

SEQ ID NO: 20160 - RNA, 21 nt, Artificial Sequence
  Marburg virus siRNA sense strand
cccacugccccucauguucgu

SEQ ID NO: 20161 - RNA, 21 nt, Artificial Sequence
  Marburg virus siRNA sense strand
ccacugccccucauguucgua

SEQ ID NO: 20162 - RNA, 21 nt, Artificial Sequence
  Marburg virus siRNA sense strand
cacugccccucauguucguaa

SEQ ID NO: 20163 - RNA, 21 nt, Artificial Sequence
  Marburg virus siRNA sense strand
acugccccucauguucguaau

SEQ ID NO: 20164 - RNA, 21 nt, Artificial Sequence
  Marburg virus siRNA sense strand
cugccccucauguucguaaua

SEQ ID NO: 20165 - RNA, 21 nt, Artificial Sequence
  Marburg virus siRNA sense strand
ugccccucauguucguaauaa

SEQ ID NO: 20166 - RNA, 21 nt, Artificial Sequence
  Marburg virus siRNA sense strand
gccccucauguucguaauaag

SEQ ID NO: 20167 - RNA, 21 nt, Artificial Sequence
  Marburg virus siRNA sense strand
ccccucauguucguaauaaga

SEQ ID NO: 20168 - RNA, 21 nt, Artificial Sequence
  Marburg virus siRNA sense strand
cccucauguucguaauaagaa

SEQ ID NO: 20169 - RNA, 21 nt, Artificial Sequence
  Marburg virus siRNA sense strand
ccucauguucguaauaagaag

SEQ ID NO: 20170 - RNA, 21 nt, Artificial Sequence
  Marburg virus siRNA sense strand
cucauguucguaauaagaagg

SEQ ID NO: 20171 - RNA, 21 nt, Artificial Sequence
  Marburg virus siRNA sense strand
ucauguucguaauaagaaggu

SEQ ID NO: 20172 - RNA, 21 nt, Artificial Sequence
  Marburg virus siRNA sense strand
cauguucguaauaagaaggug

SEQ ID NO: 20173 - RNA, 21 nt, Artificial Sequence
  Marburg virus siRNA sense strand
auguucguaauaagaagguga

SEQ ID NO: 20174 - RNA, 21 nt, Artificial Sequence
  Marburg virus siRNA sense strand
uguucguaauaagaaggugau

SEQ ID NO: 20175 - RNA, 21 nt, Artificial Sequence
  Marburg virus siRNA sense strand
guucguaauaagaaggugaua

SEQ ID NO: 20176 - RNA, 21 nt, Artificial Sequence
  Marburg virus siRNA sense strand
uucguaauaagaaggugauau

SEQ ID NO: 20177 - RNA, 21 nt, Artificial Sequence
  Marburg virus siRNA sense strand
ucguaauaagaaggugauauu

SEQ ID NO: 20178 - RNA, 21 nt, Artificial Sequence
  Marburg virus siRNA sense strand
cguaauaagaaggugauauua

SEQ ID NO: 20179 - RNA, 21 nt, Artificial Sequence
  Marburg virus siRNA sense strand
guaauaagaaggugauauuau

SEQ ID NO: 20180 - RNA, 21 nt, Artificial Sequence
  Marburg virus siRNA sense strand
uaauaagaaggugauauuauu

SEQ ID NO: 20181 - RNA, 21 nt, Artificial Sequence
  Marburg virus siRNA sense strand
aauaagaaggugauauuauuu

SEQ ID NO: 20182 - RNA, 21 nt, Artificial Sequence
  Marburg virus siRNA sense strand
auaagaaggugauauuauuug

SEQ ID NO: 20183 - RNA, 21 nt, Artificial Sequence
  Marburg virus siRNA sense strand
uaagaaggugauauuauuuga

SEQ ID NO: 20184 - RNA, 21 nt, Artificial Sequence
  Marburg virus siRNA sense strand
aagaaggugauauuauuugac

SEQ ID NO: 20185 - RNA, 21 nt, Artificial Sequence
  Marburg virus siRNA sense strand
agaaggugauauuauuugaca

SEQ ID NO: 20186 - RNA, 21 nt, Artificial Sequence
  Marburg virus siRNA sense strand
gaaggugauauuauuugacac

SEQ ID NO: 20187 - RNA, 21 nt, Artificial Sequence
  Marburg virus siRNA sense strand
aaggugauauuauuugacaca

SEQ ID NO: 20188 - RNA, 21 nt, Artificial Sequence
  Marburg virus siRNA sense strand
aggugauauuauuugacacaa

SEQ ID NO: 20189 - RNA, 21 nt, Artificial Sequence
  Marburg virus siRNA sense strand
ggugauauuauuugacacaaa

SEQ ID NO: 20190 - RNA, 21 nt, Artificial Sequence
  Marburg virus siRNA sense strand
gugauauuauuugacacaaau

SEQ ID NO: 20191 - RNA, 21 nt, Artificial Sequence
  Marburg virus siRNA sense strand
ugauauuauuugacacaaauc

SEQ ID NO: 20192 - RNA, 21 nt, Artificial Sequence
  Marburg virus siRNA sense strand
gauauuauuugacacaaauca

SEQ ID NO: 20193 - RNA, 21 nt, Artificial Sequence
  Marburg virus siRNA sense strand
auauuauuugacacaaaucau

SEQ ID NO: 20194 - RNA, 21 nt, Artificial Sequence
  Marburg virus siRNA sense strand
uauuauuugacacaaaucauc

SEQ ID NO: 20195 - RNA, 21 nt, Artificial Sequence
  Marburg virus siRNA sense strand
auuauuugacacaaaucauca

SEQ ID NO: 20196 - RNA, 21 nt, Artificial Sequence
  Marburg virus siRNA sense strand
uuauuugacacaaaucaucag

SEQ ID NO: 20197 - RNA, 21 nt, Artificial Sequence
  Marburg virus siRNA sense strand
uauuugacacaaaucaucagg

SEQ ID NO: 20198 - RNA, 21 nt, Artificial Sequence
  Marburg virus siRNA sense strand
auuugacacaaaucaucaggu

SEQ ID NO: 20199 - RNA, 21 nt, Artificial Sequence
  Marburg virus siRNA sense strand
uuugacacaaaucaucagguu

SEQ ID NO: 20200 - RNA, 21 nt, Artificial Sequence
  Marburg virus siRNA sense strand
uugacacaaaucaucagguua

SEQ ID NO: 20201 - RNA, 21 nt, Artificial Sequence
  Marburg virus siRNA sense strand
ugacacaaaucaucagguuag

SEQ ID NO: 20202 - RNA, 21 nt, Artificial Sequence
  Marburg virus siRNA sense strand
gacacaaaucaucagguuagu

SEQ ID NO: 20203 - RNA, 21 nt, Artificial Sequence
  Marburg virus siRNA sense strand
acacaaaucaucagguuagua

SEQ ID NO: 20204 - RNA, 21 nt, Artificial Sequence
  Marburg virus siRNA sense strand
cacaaaucaucagguuaguau

SEQ ID NO: 20205 - RNA, 21 nt, Artificial Sequence
  Marburg virus siRNA sense strand
acaaaucaucagguuaguauc

SEQ ID NO: 20206 - RNA, 21 nt, Artificial Sequence
  Marburg virus siRNA sense strand
caaaucaucagguuaguaucu

SEQ ID NO: 20207 - RNA, 21 nt, Artificial Sequence
  Marburg virus siRNA sense strand
aaaucaucagguuaguaucug

SEQ ID NO: 20208 - RNA, 21 nt, Artificial Sequence
  Marburg virus siRNA sense strand
aaucaucagguuaguaucugu

SEQ ID NO: 20209 - RNA, 21 nt, Artificial Sequence
  Marburg virus siRNA sense strand
aucaucagguuaguaucugua

SEQ ID NO: 20210 - RNA, 21 nt, Artificial Sequence
  Marburg virus siRNA sense strand
ucaucagguuaguaucuguaa

SEQ ID NO: 20211 - RNA, 21 nt, Artificial Sequence
  Marburg virus siRNA sense strand
caucagguuaguaucuguaau

SEQ ID NO: 20212 - RNA, 21 nt, Artificial Sequence
  Marburg virus siRNA sense strand
aucagguuaguaucuguaauc

SEQ ID NO: 20213 - RNA, 21 nt, Artificial Sequence
  Marburg virus siRNA sense strand
ucagguuaguaucuguaauca

SEQ ID NO: 20214 - RNA, 21 nt, Artificial Sequence
  Marburg virus siRNA sense strand
cagguuaguaucuguaaucag

SEQ ID NO: 20215 - RNA, 21 nt, Artificial Sequence
  Marburg virus siRNA sense strand
agguuaguaucuguaaucaga

SEQ ID NO: 20216 - RNA, 21 nt, Artificial Sequence
  Marburg virus siRNA sense strand
gguuaguaucuguaaucagau

SEQ ID NO: 20217 - RNA, 21 nt, Artificial Sequence
  Marburg virus siRNA sense strand
guuaguaucuguaaucagaua

SEQ ID NO: 20218 - RNA, 21 nt, Artificial Sequence
  Marburg virus siRNA sense strand
uuaguaucuguaaucagauaa

SEQ ID NO: 20219 - RNA, 21 nt, Artificial Sequence
  Marburg virus siRNA sense strand
uaguaucuguaaucagauaau

SEQ ID NO: 20220 - RNA, 21 nt, Artificial Sequence
  Marburg virus siRNA sense strand
aguaucuguaaucagauaaua

SEQ ID NO: 20221 - RNA, 21 nt, Artificial Sequence
  Marburg virus siRNA sense strand
guaucuguaaucagauaauag

SEQ ID NO: 20222 - RNA, 21 nt, Artificial Sequence
  Marburg virus siRNA sense strand
uaucuguaaucagauaauaga

SEQ ID NO: 20223 - RNA, 21 nt, Artificial Sequence
  Marburg virus siRNA sense strand
aucuguaaucagauaauagau

SEQ ID NO: 20224 - RNA, 21 nt, Artificial Sequence
  Marburg virus siRNA sense strand
ucuguaaucagauaauagaug

SEQ ID NO: 20225 - RNA, 21 nt, Artificial Sequence
  Marburg virus siRNA sense strand
cuguaaucagauaauagaugc

SEQ ID NO: 20226 - RNA, 21 nt, Artificial Sequence
  Marburg virus siRNA sense strand
uguaaucagauaauagaugca

SEQ ID NO: 20227 - RNA, 21 nt, Artificial Sequence
  Marburg virus siRNA sense strand
guaaucagauaauagaugcaa

SEQ ID NO: 20228 - RNA, 21 nt, Artificial Sequence
  Marburg virus siRNA sense strand
uaaucagauaauagaugcaau

SEQ ID NO: 20229 - RNA, 21 nt, Artificial Sequence
  Marburg virus siRNA sense strand
aaucagauaauagaugcaaua

SEQ ID NO: 20230 - RNA, 21 nt, Artificial Sequence
  Marburg virus siRNA sense strand
aucagauaauagaugcaauaa

SEQ ID NO: 20231 - RNA, 21 nt, Artificial Sequence
  Marburg virus siRNA sense strand
ucagauaauagaugcaauaaa

SEQ ID NO: 20232 - RNA, 21 nt, Artificial Sequence
  Marburg virus siRNA sense strand
cagauaauagaugcaauaaac

SEQ ID NO: 20233 - RNA, 21 nt, Artificial Sequence
  Marburg virus siRNA sense strand
agauaauagaugcaauaaacu

SEQ ID NO: 20234 - RNA, 21 nt, Artificial Sequence
  Marburg virus siRNA sense strand
gauaauagaugcaauaaacuc

SEQ ID NO: 20235 - RNA, 21 nt, Artificial Sequence
  Marburg virus siRNA sense strand
auaauagaugcaauaaacuca

SEQ ID NO: 20236 - RNA, 21 nt, Artificial Sequence
  Marburg virus siRNA sense strand
uaauagaugcaauaaacucag

SEQ ID NO: 20237 - RNA, 21 nt, Artificial Sequence
  Marburg virus siRNA sense strand
aauagaugcaauaaacucagg

SEQ ID NO: 20238 - RNA, 21 nt, Artificial Sequence
  Marburg virus siRNA sense strand
auagaugcaauaaacucaggg

SEQ ID NO: 20239 - RNA, 21 nt, Artificial Sequence
  Marburg virus siRNA sense strand
uagaugcaauaaacucaggga

SEQ ID NO: 20240 - RNA, 21 nt, Artificial Sequence
  Marburg virus siRNA sense strand
agaugcaauaaacucagggau

SEQ ID NO: 20241 - RNA, 21 nt, Artificial Sequence
  Marburg virus siRNA sense strand
gaugcaauaaacucagggauu

SEQ ID NO: 20242 - RNA, 21 nt, Artificial Sequence
  Marburg virus siRNA sense strand
augcaauaaacucagggauug

SEQ ID NO: 20243 - RNA, 21 nt, Artificial Sequence
  Marburg virus siRNA sense strand
ugcaauaaacucagggauuga

SEQ ID NO: 20244 - RNA, 21 nt, Artificial Sequence
  Marburg virus siRNA sense strand
gcaauaaacucagggauugau

SEQ ID NO: 20245 - RNA, 21 nt, Artificial Sequence
  Marburg virus siRNA sense strand
caauaaacucagggauugauc

SEQ ID NO: 20246 - RNA, 21 nt, Artificial Sequence
  Marburg virus siRNA sense strand
aauaaacucagggauugaucu

SEQ ID NO: 20247 - RNA, 21 nt, Artificial Sequence
  Marburg virus siRNA sense strand
auaaacucagggauugaucuu

SEQ ID NO: 20248 - RNA, 21 nt, Artificial Sequence
  Marburg virus siRNA sense strand
uaaacucagggauugaucuug

SEQ ID NO: 20249 - RNA, 21 nt, Artificial Sequence
  Marburg virus siRNA sense strand
aaacucagggauugaucuugg

SEQ ID NO: 20250 - RNA, 21 nt, Artificial Sequence
  Marburg virus siRNA sense strand
aacucagggauugaucuugga

SEQ ID NO: 20251 - RNA, 21 nt, Artificial Sequence
  Marburg virus siRNA sense strand
acucagggauugaucuuggag

SEQ ID NO: 20252 - RNA, 21 nt, Artificial Sequence
  Marburg virus siRNA sense strand
cucagggauugaucuuggaga

SEQ ID NO: 20253 - RNA, 21 nt, Artificial Sequence
  Marburg virus siRNA sense strand
ucagggauugaucuuggagau

SEQ ID NO: 20254 - RNA, 21 nt, Artificial Sequence
  Marburg virus siRNA sense strand
cagggauugaucuuggagauc

SEQ ID NO: 20255 - RNA, 21 nt, Artificial Sequence
  Marburg virus siRNA sense strand
agggauugaucuuggagaucu

SEQ ID NO: 20256 - RNA, 21 nt, Artificial Sequence
  Marburg virus siRNA sense strand
gggauugaucuuggagaucuu

SEQ ID NO: 20257 - RNA, 21 nt, Artificial Sequence
  Marburg virus siRNA sense strand
ggauugaucuuggagaucuuc

SEQ ID NO: 20258 - RNA, 21 nt, Artificial Sequence
  Marburg virus siRNA sense strand
gauugaucuuggagaucuucu

SEQ ID NO: 20259 - RNA, 21 nt, Artificial Sequence
  Marburg virus siRNA sense strand
auugaucuuggagaucuucua

SEQ ID NO: 20260 - RNA, 21 nt, Artificial Sequence
  Marburg virus siRNA sense strand
uugaucuuggagaucuucuag

SEQ ID NO: 20261 - RNA, 21 nt, Artificial Sequence
  Marburg virus siRNA sense strand
ugaucuuggagaucuucuaga

SEQ ID NO: 20262 - RNA, 21 nt, Artificial Sequence
  Marburg virus siRNA sense strand
gaucuuggagaucuucuagaa

SEQ ID NO: 20263 - RNA, 21 nt, Artificial Sequence
  Marburg virus siRNA sense strand
aucuuggagaucuucuagaag

SEQ ID NO: 20264 - RNA, 21 nt, Artificial Sequence
  Marburg virus siRNA sense strand
ucuuggagaucuucuagaagg

SEQ ID NO: 20265 - RNA, 21 nt, Artificial Sequence
  Marburg virus siRNA sense strand
cuuggagaucuucuagaaggg

SEQ ID NO: 20266 - RNA, 21 nt, Artificial Sequence
  Marburg virus siRNA sense strand
uuggagaucuucuagaagggg

SEQ ID NO: 20267 - RNA, 21 nt, Artificial Sequence
  Marburg virus siRNA sense strand
uggagaucuucuagaaggggg

SEQ ID NO: 20268 - RNA, 21 nt, Artificial Sequence
  Marburg virus siRNA sense strand
ggagaucuucuagaagggggu

SEQ ID NO: 20269 - RNA, 21 nt, Artificial Sequence
  Marburg virus siRNA sense strand
gagaucuucuagaaggggguu

SEQ ID NO: 20270 - RNA, 21 nt, Artificial Sequence
  Marburg virus siRNA sense strand
agaucuucuagaaggggguuu

SEQ ID NO: 20271 - RNA, 21 nt, Artificial Sequence
  Marburg virus siRNA sense strand
gaucuucuagaaggggguuug

SEQ ID NO: 20272 - RNA, 21 nt, Artificial Sequence
  Marburg virus siRNA sense strand
aucuucuagaaggggguuugc

SEQ ID NO: 20273 - RNA, 21 nt, Artificial Sequence
  Marburg virus siRNA sense strand
ucuucuagaaggggguuugcu

SEQ ID NO: 20274 - RNA, 21 nt, Artificial Sequence
  Marburg virus siRNA sense strand
cuucuagaaggggguuugcug

SEQ ID NO: 20275 - RNA, 21 nt, Artificial Sequence
  Marburg virus siRNA sense strand
uucuagaaggggguuugcuga

SEQ ID NO: 20276 - RNA, 21 nt, Artificial Sequence
  Marburg virus siRNA sense strand
ucuagaaggggguuugcugac

SEQ ID NO: 20277 - RNA, 21 nt, Artificial Sequence
  Marburg virus siRNA sense strand
cuagaaggggguuugcugacg

SEQ ID NO: 20278 - RNA, 21 nt, Artificial Sequence
  Marburg virus siRNA sense strand
uagaaggggguuugcugacgu

SEQ ID NO: 20279 - RNA, 21 nt, Artificial Sequence
  Marburg virus siRNA sense strand
agaaggggguuugcugacguu

SEQ ID NO: 20280 - RNA, 21 nt, Artificial Sequence
  Marburg virus siRNA sense strand
gaaggggguuugcugacguug

SEQ ID NO: 20281 - RNA, 21 nt, Artificial Sequence
  Marburg virus siRNA sense strand
aaggggguuugcugacguugu

SEQ ID NO: 20282 - RNA, 21 nt, Artificial Sequence
  Marburg virus siRNA sense strand
aggggguuugcugacguugug

SEQ ID NO: 20283 - RNA, 21 nt, Artificial Sequence
  Marburg virus siRNA sense strand
ggggguuugcugacguugugu

SEQ ID NO: 20284 - RNA, 21 nt, Artificial Sequence
  Marburg virus siRNA sense strand
gggguuugcugacguugugug

SEQ ID NO: 20285 - RNA, 21 nt, Artificial Sequence
  Marburg virus siRNA sense strand
ggguuugcugacguugugugu

SEQ ID NO: 20286 - RNA, 21 nt, Artificial Sequence
  Marburg virus siRNA sense strand
gguuugcugacguuguguguu

SEQ ID NO: 20287 - RNA, 21 nt, Artificial Sequence
  Marburg virus siRNA sense strand
guuugcugacguuguguguug

SEQ ID NO: 20288 - RNA, 21 nt, Artificial Sequence
  Marburg virus siRNA sense strand
uuugcugacguuguguguuga

SEQ ID NO: 20289 - RNA, 21 nt, Artificial Sequence
  Marburg virus siRNA sense strand
uugcugacguuguguguugaa

SEQ ID NO: 20290 - RNA, 21 nt, Artificial Sequence
  Marburg virus siRNA sense strand
ugcugacguuguguguugaac

SEQ ID NO: 20291 - RNA, 21 nt, Artificial Sequence
  Marburg virus siRNA sense strand
gcugacguuguguguugaaca

SEQ ID NO: 20292 - RNA, 21 nt, Artificial Sequence
  Marburg virus siRNA sense strand
cugacguuguguguugaacau

SEQ ID NO: 20293 - RNA, 21 nt, Artificial Sequence
  Marburg virus siRNA sense strand
ugacguuguguguugaacauu

SEQ ID NO: 20294 - RNA, 21 nt, Artificial Sequence
  Marburg virus siRNA sense strand
gacguuguguguugaacauua

SEQ ID NO: 20295 - RNA, 21 nt, Artificial Sequence
  Marburg virus siRNA sense strand
acguuguguguugaacauuac

SEQ ID NO: 20296 - RNA, 21 nt, Artificial Sequence
  Marburg virus siRNA sense strand
cguuguguguugaacauuacu

SEQ ID NO: 20297 - RNA, 21 nt, Artificial Sequence
  Marburg virus siRNA sense strand
guuguguguugaacauuacua

SEQ ID NO: 20298 - RNA, 21 nt, Artificial Sequence
  Marburg virus siRNA sense strand
uuguguguugaacauuacuau

SEQ ID NO: 20299 - RNA, 21 nt, Artificial Sequence
  Marburg virus siRNA sense strand
uguguguugaacauuacuaua

SEQ ID NO: 20300 - RNA, 21 nt, Artificial Sequence
  Marburg virus siRNA sense strand
guguguugaacauuacuauaa

SEQ ID NO: 20301 - RNA, 21 nt, Artificial Sequence
  Marburg virus siRNA sense strand
uguguugaacauuacuauaau

SEQ ID NO: 20302 - RNA, 21 nt, Artificial Sequence
  Marburg virus siRNA sense strand
guguugaacauuacuauaauu

SEQ ID NO: 20303 - RNA, 21 nt, Artificial Sequence
  Marburg virus siRNA sense strand
uguugaacauuacuauaauuc

SEQ ID NO: 20304 - RNA, 21 nt, Artificial Sequence
  Marburg virus siRNA sense strand
guugaacauuacuauaauucc

SEQ ID NO: 20305 - RNA, 21 nt, Artificial Sequence
  Marburg virus siRNA sense strand
uugaacauuacuauaauuccg

SEQ ID NO: 20306 - RNA, 21 nt, Artificial Sequence
  Marburg virus siRNA sense strand
ugaacauuacuauaauuccga

SEQ ID NO: 20307 - RNA, 21 nt, Artificial Sequence
  Marburg virus siRNA sense strand
gaacauuacuauaauuccgau

SEQ ID NO: 20308 - RNA, 21 nt, Artificial Sequence
  Marburg virus siRNA sense strand
aacauuacuauaauuccgaua

SEQ ID NO: 20309 - RNA, 21 nt, Artificial Sequence
  Marburg virus siRNA sense strand
acauuacuauaauuccgauaa

SEQ ID NO: 20310 - RNA, 21 nt, Artificial Sequence
  Marburg virus siRNA sense strand
cauuacuauaauuccgauaaa

SEQ ID NO: 20311 - RNA, 21 nt, Artificial Sequence
  Marburg virus siRNA sense strand
auuacuauaauuccgauaaag

SEQ ID NO: 20312 - RNA, 21 nt, Artificial Sequence
  Marburg virus siRNA sense strand
uuacuauaauuccgauaaaga

SEQ ID NO: 20313 - RNA, 21 nt, Artificial Sequence
  Marburg virus siRNA sense strand
uacuauaauuccgauaaagau

SEQ ID NO: 20314 - RNA, 21 nt, Artificial Sequence
  Marburg virus siRNA sense strand
acuauaauuccgauaaagaua

SEQ ID NO: 20315 - RNA, 21 nt, Artificial Sequence
  Marburg virus siRNA sense strand
cuauaauuccgauaaagauaa

SEQ ID NO: 20316 - RNA, 21 nt, Artificial Sequence
  Marburg virus siRNA sense strand
uauaauuccgauaaagauaaa

SEQ ID NO: 20317 - RNA, 21 nt, Artificial Sequence
  Marburg virus siRNA sense strand
auaauuccgauaaagauaaau

SEQ ID NO: 20318 - RNA, 21 nt, Artificial Sequence
  Marburg virus siRNA sense strand
uaauuccgauaaagauaaauu

SEQ ID NO: 20319 - RNA, 21 nt, Artificial Sequence
  Marburg virus siRNA sense strand
aauuccgauaaagauaaauuc

SEQ ID NO: 20320 - RNA, 21 nt, Artificial Sequence
  Marburg virus siRNA sense strand
auuccgauaaagauaaauuca

SEQ ID NO: 20321 - RNA, 21 nt, Artificial Sequence
  Marburg virus siRNA sense strand
uuccgauaaagauaaauucaa

SEQ ID NO: 20322 - RNA, 21 nt, Artificial Sequence
  Marburg virus siRNA sense strand
uccgauaaagauaaauucaac

SEQ ID NO: 20323 - RNA, 21 nt, Artificial Sequence
  Marburg virus siRNA sense strand
ccgauaaagauaaauucaaca

SEQ ID NO: 20324 - RNA, 21 nt, Artificial Sequence
  Marburg virus siRNA sense strand
cgauaaagauaaauucaacac

SEQ ID NO: 20325 - RNA, 21 nt, Artificial Sequence
  Marburg virus siRNA sense strand
gauaaagauaaauucaacaca

SEQ ID NO: 20326 - RNA, 21 nt, Artificial Sequence
  Marburg virus siRNA sense strand
auaaagauaaauucaacacaa

SEQ ID NO: 20327 - RNA, 21 nt, Artificial Sequence
  Marburg virus siRNA sense strand
uaaagauaaauucaacacaag

SEQ ID NO: 20328 - RNA, 21 nt, Artificial Sequence
  Marburg virus siRNA sense strand
aaagauaaauucaacacaagu

SEQ ID NO: 20329 - RNA, 21 nt, Artificial Sequence
  Marburg virus siRNA sense strand
aagauaaauucaacacaaguc

SEQ ID NO: 20330 - RNA, 21 nt, Artificial Sequence
  Marburg virus siRNA sense strand
agauaaauucaacacaagucc

SEQ ID NO: 20331 - RNA, 21 nt, Artificial Sequence
  Marburg virus siRNA sense strand
gauaaauucaacacaaguccu

SEQ ID NO: 20332 - RNA, 21 nt, Artificial Sequence
  Marburg virus siRNA sense strand
auaaauucaacacaaguccua

SEQ ID NO: 20333 - RNA, 21 nt, Artificial Sequence
  Marburg virus siRNA sense strand
uaaauucaacacaaguccuau

SEQ ID NO: 20334 - RNA, 21 nt, Artificial Sequence
  Marburg virus siRNA sense strand
aaauucaacacaaguccuauc

SEQ ID NO: 20335 - RNA, 21 nt, Artificial Sequence
  Marburg virus siRNA sense strand
aauucaacacaaguccuaucg

SEQ ID NO: 20336 - RNA, 21 nt, Artificial Sequence
  Marburg virus siRNA sense strand
auucaacacaaguccuaucgc

SEQ ID NO: 20337 - RNA, 21 nt, Artificial Sequence
  Marburg virus siRNA sense strand
uucaacacaaguccuaucgca

SEQ ID NO: 20338 - RNA, 21 nt, Artificial Sequence
  Marburg virus siRNA sense strand
ucaacacaaguccuaucgcaa

SEQ ID NO: 20339 - RNA, 21 nt, Artificial Sequence
  Marburg virus siRNA sense strand
caacacaaguccuaucgcaaa

SEQ ID NO: 20340 - RNA, 21 nt, Artificial Sequence
  Marburg virus siRNA sense strand
aacacaaguccuaucgcaaaa

SEQ ID NO: 20341 - RNA, 21 nt, Artificial Sequence
  Marburg virus siRNA sense strand
acacaaguccuaucgcaaaau

SEQ ID NO: 20342 - RNA, 21 nt, Artificial Sequence
  Marburg virus siRNA sense strand
cacaaguccuaucgcaaaaua

SEQ ID NO: 20343 - RNA, 21 nt, Artificial Sequence
  Marburg virus siRNA sense strand
acaaguccuaucgcaaaauac

SEQ ID NO: 20344 - RNA, 21 nt, Artificial Sequence
  Marburg virus siRNA sense strand
caaguccuaucgcaaaauacu

SEQ ID NO: 20345 - RNA, 21 nt, Artificial Sequence
  Marburg virus siRNA sense strand
aaguccuaucgcaaaauacuu

SEQ ID NO: 20346 - RNA, 21 nt, Artificial Sequence
  Marburg virus siRNA sense strand
aguccuaucgcaaaauacuug

SEQ ID NO: 20347 - RNA, 21 nt, Artificial Sequence
  Marburg virus siRNA sense strand
guccuaucgcaaaauacuugc

SEQ ID NO: 20348 - RNA, 21 nt, Artificial Sequence
  Marburg virus siRNA sense strand
uccuaucgcaaaauacuugcg

SEQ ID NO: 20349 - RNA, 21 nt, Artificial Sequence
  Marburg virus siRNA sense strand
ccuaucgcaaaauacuugcgu

SEQ ID NO: 20350 - RNA, 21 nt, Artificial Sequence
  Marburg virus siRNA sense strand
cuaucgcaaaauacuugcgug

SEQ ID NO: 20351 - RNA, 21 nt, Artificial Sequence
  Marburg virus siRNA sense strand
uaucgcaaaauacuugcguga

SEQ ID NO: 20352 - RNA, 21 nt, Artificial Sequence
  Marburg virus siRNA sense strand
aucgcaaaauacuugcgugau

SEQ ID NO: 20353 - RNA, 21 nt, Artificial Sequence
  Marburg virus siRNA sense strand
ucgcaaaauacuugcgugaug

SEQ ID NO: 20354 - RNA, 21 nt, Artificial Sequence
  Marburg virus siRNA sense strand
cgcaaaauacuugcgugaugc

SEQ ID NO: 20355 - RNA, 21 nt, Artificial Sequence
  Marburg virus siRNA sense strand
gcaaaauacuugcgugaugcg

SEQ ID NO: 20356 - RNA, 21 nt, Artificial Sequence
  Marburg virus siRNA sense strand
caaaauacuugcgugaugcgg

SEQ ID NO: 20357 - RNA, 21 nt, Artificial Sequence
  Marburg virus siRNA sense strand
aaaauacuugcgugaugcggg

SEQ ID NO: 20358 - RNA, 21 nt, Artificial Sequence
  Marburg virus siRNA sense strand
aaauacuugcgugaugcgggc

SEQ ID NO: 20359 - RNA, 21 nt, Artificial Sequence
  Marburg virus siRNA sense strand
aauacuugcgugaugcgggcu

SEQ ID NO: 20360 - RNA, 21 nt, Artificial Sequence
  Marburg virus siRNA sense strand
auacuugcgugaugcgggcua

SEQ ID NO: 20361 - RNA, 21 nt, Artificial Sequence
  Marburg virus siRNA sense strand
uacuugcgugaugcgggcuau

SEQ ID NO: 20362 - RNA, 21 nt, Artificial Sequence
  Marburg virus siRNA sense strand
acuugcgugaugcgggcuaug

SEQ ID NO: 20363 - RNA, 21 nt, Artificial Sequence
  Marburg virus siRNA sense strand
cuugcgugaugcgggcuauga

SEQ ID NO: 20364 - RNA, 21 nt, Artificial Sequence
  Marburg virus siRNA sense strand
uugcgugaugcgggcuaugag

SEQ ID NO: 20365 - RNA, 21 nt, Artificial Sequence
  Marburg virus siRNA sense strand
ugcgugaugcgggcuaugagu

SEQ ID NO: 20366 - RNA, 21 nt, Artificial Sequence
  Marburg virus siRNA sense strand
gcgugaugcgggcuaugaguu

SEQ ID NO: 20367 - RNA, 21 nt, Artificial Sequence
  Marburg virus siRNA sense strand
cgugaugcgggcuaugaguuu

SEQ ID NO: 20368 - RNA, 21 nt, Artificial Sequence
  Marburg virus siRNA sense strand
gugaugcgggcuaugaguuug

SEQ ID NO: 20369 - RNA, 21 nt, Artificial Sequence
  Marburg virus siRNA sense strand
ugaugcgggcuaugaguuuga

SEQ ID NO: 20370 - RNA, 21 nt, Artificial Sequence
  Marburg virus siRNA sense strand
gaugcgggcuaugaguuugau

SEQ ID NO: 20371 - RNA, 21 nt, Artificial Sequence
  Marburg virus siRNA sense strand
augcgggcuaugaguuugaug

SEQ ID NO: 20372 - RNA, 21 nt, Artificial Sequence
  Marburg virus siRNA sense strand
ugcgggcuaugaguuugaugu

SEQ ID NO: 20373 - RNA, 21 nt, Artificial Sequence
  Marburg virus siRNA sense strand
gcgggcuaugaguuugauguc

SEQ ID NO: 20374 - RNA, 21 nt, Artificial Sequence
  Marburg virus siRNA sense strand
cgggcuaugaguuugaugucg

SEQ ID NO: 20375 - RNA, 21 nt, Artificial Sequence
  Marburg virus siRNA sense strand
gggcuaugaguuugaugucgu

SEQ ID NO: 20376 - RNA, 21 nt, Artificial Sequence
  Marburg virus siRNA sense strand
ggcuaugaguuugaugucguc

SEQ ID NO: 20377 - RNA, 21 nt, Artificial Sequence
  Marburg virus siRNA sense strand
gcuaugaguuugaugucguca

SEQ ID NO: 20378 - RNA, 21 nt, Artificial Sequence
  Marburg virus siRNA sense strand
cuaugaguuugaugucgucaa

SEQ ID NO: 20379 - RNA, 21 nt, Artificial Sequence
  Marburg virus siRNA sense strand
uaugaguuugaugucgucaag

SEQ ID NO: 20380 - RNA, 21 nt, Artificial Sequence
  Marburg virus siRNA sense strand
augaguuugaugucgucaaga

SEQ ID NO: 20381 - RNA, 21 nt, Artificial Sequence
  Marburg virus siRNA sense strand
ugaguuugaugucgucaagaa

SEQ ID NO: 20382 - RNA, 21 nt, Artificial Sequence
  Marburg virus siRNA sense strand
gaguuugaugucgucaagaau

SEQ ID NO: 20383 - RNA, 21 nt, Artificial Sequence
  Marburg virus siRNA sense strand
aguuugaugucgucaagaaug

SEQ ID NO: 20384 - RNA, 21 nt, Artificial Sequence
  Marburg virus siRNA sense strand
guuugaugucgucaagaaugc

SEQ ID NO: 20385 - RNA, 21 nt, Artificial Sequence
  Marburg virus siRNA sense strand
uuugaugucgucaagaaugca

SEQ ID NO: 20386 - RNA, 21 nt, Artificial Sequence
  Marburg virus siRNA sense strand
uugaugucgucaagaaugcag

SEQ ID NO: 20387 - RNA, 21 nt, Artificial Sequence
  Marburg virus siRNA sense strand
ugaugucgucaagaaugcaga

SEQ ID NO: 20388 - RNA, 21 nt, Artificial Sequence
  Marburg virus siRNA sense strand
gaugucgucaagaaugcagau

SEQ ID NO: 20389 - RNA, 21 nt, Artificial Sequence
  Marburg virus siRNA sense strand
augucgucaagaaugcagaug

SEQ ID NO: 20390 - RNA, 21 nt, Artificial Sequence
  Marburg virus siRNA sense strand
ugucgucaagaaugcagaugc

SEQ ID NO: 20391 - RNA, 21 nt, Artificial Sequence
  Marburg virus siRNA sense strand
gucgucaagaaugcagaugca

SEQ ID NO: 20392 - RNA, 21 nt, Artificial Sequence
  Marburg virus siRNA sense strand
ucgucaagaaugcagaugcaa

SEQ ID NO: 20393 - RNA, 21 nt, Artificial Sequence
  Marburg virus siRNA sense strand
cgucaagaaugcagaugcaac

SEQ ID NO: 20394 - RNA, 21 nt, Artificial Sequence
  Marburg virus siRNA sense strand
gucaagaaugcagaugcaacc

SEQ ID NO: 20395 - RNA, 21 nt, Artificial Sequence
  Marburg virus siRNA sense strand
ucaagaaugcagaugcaaccc

SEQ ID NO: 20396 - RNA, 21 nt, Artificial Sequence
  Marburg virus siRNA sense strand
caagaaugcagaugcaacccg

SEQ ID NO: 20397 - RNA, 21 nt, Artificial Sequence
  Marburg virus siRNA sense strand
aagaaugcagaugcaacccgc

SEQ ID NO: 20398 - RNA, 21 nt, Artificial Sequence
  Marburg virus siRNA sense strand
agaaugcagaugcaacccgcu

SEQ ID NO: 20399 - RNA, 21 nt, Artificial Sequence
  Marburg virus siRNA sense strand
gaaugcagaugcaacccgcuu

SEQ ID NO: 20400 - RNA, 21 nt, Artificial Sequence
  Marburg virus siRNA sense strand
aaugcagaugcaacccgcuuu

SEQ ID NO: 20401 - RNA, 21 nt, Artificial Sequence
  Marburg virus siRNA sense strand
augcagaugcaacccgcuuuc

SEQ ID NO: 20402 - RNA, 21 nt, Artificial Sequence
  Marburg virus siRNA sense strand
ugcagaugcaacccgcuuucu

SEQ ID NO: 20403 - RNA, 21 nt, Artificial Sequence
  Marburg virus siRNA sense strand
gcagaugcaacccgcuuucug

SEQ ID NO: 20404 - RNA, 21 nt, Artificial Sequence
  Marburg virus siRNA sense strand
cagaugcaacccgcuuucugg

SEQ ID NO: 20405 - RNA, 21 nt, Artificial Sequence
  Marburg virus siRNA sense strand
agaugcaacccgcuuucugga

SEQ ID NO: 20406 - RNA, 21 nt, Artificial Sequence
  Marburg virus siRNA sense strand
gaugcaacccgcuuucuggau

SEQ ID NO: 20407 - RNA, 21 nt, Artificial Sequence
  Marburg virus siRNA sense strand
augcaacccgcuuucuggaug

SEQ ID NO: 20408 - RNA, 21 nt, Artificial Sequence
  Marburg virus siRNA sense strand
ugcaacccgcuuucuggaugu

SEQ ID NO: 20409 - RNA, 21 nt, Artificial Sequence
  Marburg virus siRNA sense strand
gcaacccgcuuucuggaugug

SEQ ID NO: 20410 - RNA, 21 nt, Artificial Sequence
  Marburg virus siRNA sense strand
caacccgcuuucuggauguga

SEQ ID NO: 20411 - RNA, 21 nt, Artificial Sequence
  Marburg virus siRNA sense strand
aacccgcuuucuggaugugau

SEQ ID NO: 20412 - RNA, 21 nt, Artificial Sequence
  Marburg virus siRNA sense strand
acccgcuuucuggaugugauu

SEQ ID NO: 20413 - RNA, 21 nt, Artificial Sequence
  Marburg virus siRNA sense strand
cccgcuuucuggaugugauuc

SEQ ID NO: 20414 - RNA, 21 nt, Artificial Sequence
  Marburg virus siRNA sense strand
ccgcuuucuggaugugauucc

SEQ ID NO: 20415 - RNA, 21 nt, Artificial Sequence
  Marburg virus siRNA sense strand
cgcuuucuggaugugauuccu

SEQ ID NO: 20416 - RNA, 21 nt, Artificial Sequence
  Marburg virus siRNA sense strand
gcuuucuggaugugauuccua

SEQ ID NO: 20417 - RNA, 21 nt, Artificial Sequence
  Marburg virus siRNA sense strand
cuuucuggaugugauuccuaa

SEQ ID NO: 20418 - RNA, 21 nt, Artificial Sequence
  Marburg virus siRNA sense strand
uuucuggaugugauuccuaac

SEQ ID NO: 20419 - RNA, 21 nt, Artificial Sequence
  Marburg virus siRNA sense strand
uucuggaugugauuccuaacg

SEQ ID NO: 20420 - RNA, 21 nt, Artificial Sequence
  Marburg virus siRNA sense strand
ucuggaugugauuccuaacga

SEQ ID NO: 20421 - RNA, 21 nt, Artificial Sequence
  Marburg virus siRNA sense strand
cuggaugugauuccuaacgaa

SEQ ID NO: 20422 - RNA, 21 nt, Artificial Sequence
  Marburg virus siRNA sense strand
uggaugugauuccuaacgaac

SEQ ID NO: 20423 - RNA, 21 nt, Artificial Sequence
  Marburg virus siRNA sense strand
ggaugugauuccuaacgaacc

SEQ ID NO: 20424 - RNA, 21 nt, Artificial Sequence
  Marburg virus siRNA sense strand
gaugugauuccuaacgaaccu

SEQ ID NO: 20425 - RNA, 21 nt, Artificial Sequence
  Marburg virus siRNA sense strand
augugauuccuaacgaaccuc

SEQ ID NO: 20426 - RNA, 21 nt, Artificial Sequence
  Marburg virus siRNA sense strand
ugugauuccuaacgaaccuca

SEQ ID NO: 20427 - RNA, 21 nt, Artificial Sequence
  Marburg virus siRNA sense strand
gugauuccuaacgaaccucau

SEQ ID NO: 20428 - RNA, 21 nt, Artificial Sequence
  Marburg virus siRNA sense strand
ugauuccuaacgaaccucauu

SEQ ID NO: 20429 - RNA, 21 nt, Artificial Sequence
  Marburg virus siRNA sense strand
gauuccuaacgaaccucauua

SEQ ID NO: 20430 - RNA, 21 nt, Artificial Sequence
  Marburg virus siRNA sense strand
auuccuaacgaaccucauuac

SEQ ID NO: 20431 - RNA, 21 nt, Artificial Sequence
  Marburg virus siRNA sense strand
uuccuaacgaaccucauuaca

SEQ ID NO: 20432 - RNA, 21 nt, Artificial Sequence
  Marburg virus siRNA sense strand
uccuaacgaaccucauuacag

SEQ ID NO: 20433 - RNA, 21 nt, Artificial Sequence
  Marburg virus siRNA sense strand
ccuaacgaaccucauuacagu

SEQ ID NO: 20434 - RNA, 21 nt, Artificial Sequence
  Marburg virus siRNA sense strand
cuaacgaaccucauuacaguc

SEQ ID NO: 20435 - RNA, 21 nt, Artificial Sequence
  Marburg virus siRNA sense strand
uaacgaaccucauuacagucc

SEQ ID NO: 20436 - RNA, 21 nt, Artificial Sequence
  Marburg virus siRNA sense strand
aacgaaccucauuacaguccu

SEQ ID NO: 20437 - RNA, 21 nt, Artificial Sequence
  Marburg virus siRNA sense strand
acgaaccucauuacaguccuu

SEQ ID NO: 20438 - RNA, 21 nt, Artificial Sequence
  Marburg virus siRNA sense strand
cgaaccucauuacaguccuuu

SEQ ID NO: 20439 - RNA, 21 nt, Artificial Sequence
  Marburg virus siRNA sense strand
gaaccucauuacaguccuuua

SEQ ID NO: 20440 - RNA, 21 nt, Artificial Sequence
  Marburg virus siRNA sense strand
aaccucauuacaguccuuuaa

SEQ ID NO: 20441 - RNA, 21 nt, Artificial Sequence
  Marburg virus siRNA sense strand
accucauuacaguccuuuaau

SEQ ID NO: 20442 - RNA, 21 nt, Artificial Sequence
  Marburg virus siRNA sense strand
ccucauuacaguccuuuaauu

SEQ ID NO: 20443 - RNA, 21 nt, Artificial Sequence
  Marburg virus siRNA sense strand
cucauuacaguccuuuaauuu

SEQ ID NO: 20444 - RNA, 21 nt, Artificial Sequence
  Marburg virus siRNA sense strand
ucauuacaguccuuuaauuuu

SEQ ID NO: 20445 - RNA, 21 nt, Artificial Sequence
  Marburg virus siRNA sense strand
cauuacaguccuuuaauuuug

SEQ ID NO: 20446 - RNA, 21 nt, Artificial Sequence
  Marburg virus siRNA sense strand
auuacaguccuuuaauuuugg

SEQ ID NO: 20447 - RNA, 21 nt, Artificial Sequence
  Marburg virus siRNA sense strand
uuacaguccuuuaauuuuggc

SEQ ID NO: 20448 - RNA, 21 nt, Artificial Sequence
  Marburg virus siRNA sense strand
uacaguccuuuaauuuuggcc

SEQ ID NO: 20449 - RNA, 21 nt, Artificial Sequence
  Marburg virus siRNA sense strand
acaguccuuuaauuuuggccc

SEQ ID NO: 20450 - RNA, 21 nt, Artificial Sequence
  Marburg virus siRNA sense strand
caguccuuuaauuuuggcccu

SEQ ID NO: 20451 - RNA, 21 nt, Artificial Sequence
  Marburg virus siRNA sense strand
aguccuuuaauuuuggcccuu

SEQ ID NO: 20452 - RNA, 21 nt, Artificial Sequence
  Marburg virus siRNA sense strand
guccuuuaauuuuggcccuua

SEQ ID NO: 20453 - RNA, 21 nt, Artificial Sequence
  Marburg virus siRNA sense strand
uccuuuaauuuuggcccuuaa

SEQ ID NO: 20454 - RNA, 21 nt, Artificial Sequence
  Marburg virus siRNA sense strand
ccuuuaauuuuggcccuuaag

SEQ ID NO: 20455 - RNA, 21 nt, Artificial Sequence
  Marburg virus siRNA sense strand
cuuuaauuuuggcccuuaaga

SEQ ID NO: 20456 - RNA, 21 nt, Artificial Sequence
  Marburg virus siRNA sense strand
uuuaauuuuggcccuuaagac

SEQ ID NO: 20457 - RNA, 21 nt, Artificial Sequence
  Marburg virus siRNA sense strand
uuaauuuuggcccuuaagaca

SEQ ID NO: 20458 - RNA, 21 nt, Artificial Sequence
  Marburg virus siRNA sense strand
uaauuuuggcccuuaagacau

SEQ ID NO: 20459 - RNA, 21 nt, Artificial Sequence
  Marburg virus siRNA sense strand
aauuuuggcccuuaagacauu

SEQ ID NO: 20460 - RNA, 21 nt, Artificial Sequence
  Marburg virus siRNA sense strand
auuuuggcccuuaagacauug

SEQ ID NO: 20461 - RNA, 21 nt, Artificial Sequence
  Marburg virus siRNA sense strand
uuuuggcccuuaagacauugg

SEQ ID NO: 20462 - RNA, 21 nt, Artificial Sequence
  Marburg virus siRNA sense strand
uuuggcccuuaagacauugga

SEQ ID NO: 20463 - RNA, 21 nt, Artificial Sequence
  Marburg virus siRNA sense strand
uuggcccuuaagacauuggaa

SEQ ID NO: 20464 - RNA, 21 nt, Artificial Sequence
  Marburg virus siRNA sense strand
uggcccuuaagacauuggaaa

SEQ ID NO: 20465 - RNA, 21 nt, Artificial Sequence
  Marburg virus siRNA sense strand
ggcccuuaagacauuggaaag

SEQ ID NO: 20466 - RNA, 21 nt, Artificial Sequence
  Marburg virus siRNA sense strand
gcccuuaagacauuggaaagu

SEQ ID NO: 20467 - RNA, 21 nt, Artificial Sequence
  Marburg virus siRNA sense strand
cccuuaagacauuggaaagua

SEQ ID NO: 20468 - RNA, 21 nt, Artificial Sequence
  Marburg virus siRNA sense strand
ccuuaagacauuggaaaguac

SEQ ID NO: 20469 - RNA, 21 nt, Artificial Sequence
  Marburg virus siRNA sense strand
cuuaagacauuggaaaguacu

SEQ ID NO: 20470 - RNA, 21 nt, Artificial Sequence
  Marburg virus siRNA sense strand
uuaagacauuggaaaguacug

SEQ ID NO: 20471 - RNA, 21 nt, Artificial Sequence
  Marburg virus siRNA sense strand
uaagacauuggaaaguacuga

SEQ ID NO: 20472 - RNA, 21 nt, Artificial Sequence
  Marburg virus siRNA sense strand
aagacauuggaaaguacugaa

SEQ ID NO: 20473 - RNA, 21 nt, Artificial Sequence
  Marburg virus siRNA sense strand
agacauuggaaaguacugaau

SEQ ID NO: 20474 - RNA, 21 nt, Artificial Sequence
  Marburg virus siRNA sense strand
gacauuggaaaguacugaauc

SEQ ID NO: 20475 - RNA, 21 nt, Artificial Sequence
  Marburg virus siRNA sense strand
acauuggaaaguacugaaucu

SEQ ID NO: 20476 - RNA, 21 nt, Artificial Sequence
  Marburg virus siRNA sense strand
cauuggaaaguacugaaucuc

SEQ ID NO: 20477 - RNA, 21 nt, Artificial Sequence
  Marburg virus siRNA sense strand
auuggaaaguacugaaucuca

SEQ ID NO: 20478 - RNA, 21 nt, Artificial Sequence
  Marburg virus siRNA sense strand
uuggaaaguacugaaucucag

SEQ ID NO: 20479 - RNA, 21 nt, Artificial Sequence
  Marburg virus siRNA sense strand
uggaaaguacugaaucucaga

SEQ ID NO: 20480 - RNA, 21 nt, Artificial Sequence
  Marburg virus siRNA sense strand
ggaaaguacugaaucucagag

SEQ ID NO: 20481 - RNA, 21 nt, Artificial Sequence
  Marburg virus siRNA sense strand
gaaaguacugaaucucagagg

SEQ ID NO: 20482 - RNA, 21 nt, Artificial Sequence
  Marburg virus siRNA sense strand
aaaguacugaaucucagaggg

SEQ ID NO: 20483 - RNA, 21 nt, Artificial Sequence
  Marburg virus siRNA sense strand
aaguacugaaucucagagggg

SEQ ID NO: 20484 - RNA, 21 nt, Artificial Sequence
  Marburg virus siRNA sense strand
aguacugaaucucagaggggg

SEQ ID NO: 20485 - RNA, 21 nt, Artificial Sequence
  Marburg virus siRNA sense strand
guacugaaucucagaggggga

SEQ ID NO: 20486 - RNA, 21 nt, Artificial Sequence
  Marburg virus siRNA sense strand
uacugaaucucagagggggag

SEQ ID NO: 20487 - RNA, 21 nt, Artificial Sequence
  Marburg virus siRNA sense strand
acugaaucucagagggggaga

SEQ ID NO: 20488 - RNA, 21 nt, Artificial Sequence
  Marburg virus siRNA sense strand
cugaaucucagagggggagaa

SEQ ID NO: 20489 - RNA, 21 nt, Artificial Sequence
  Marburg virus siRNA sense strand
ugaaucucagagggggagaau

SEQ ID NO: 20490 - RNA, 21 nt, Artificial Sequence
  Marburg virus siRNA sense strand
gaaucucagagggggagaauu

SEQ ID NO: 20491 - RNA, 21 nt, Artificial Sequence
  Marburg virus siRNA sense strand
aaucucagagggggagaauug

SEQ ID NO: 20492 - RNA, 21 nt, Artificial Sequence
  Marburg virus siRNA sense strand
aucucagagggggagaauugg

SEQ ID NO: 20493 - RNA, 21 nt, Artificial Sequence
  Marburg virus siRNA sense strand
ucucagagggggagaauuggg

SEQ ID NO: 20494 - RNA, 21 nt, Artificial Sequence
  Marburg virus siRNA sense strand
cucagagggggagaauugggc

SEQ ID NO: 20495 - RNA, 21 nt, Artificial Sequence
  Marburg virus siRNA sense strand
ucagagggggagaauugggcu

SEQ ID NO: 20496 - RNA, 21 nt, Artificial Sequence
  Marburg virus siRNA sense strand
cagagggggagaauugggcuc

SEQ ID NO: 20497 - RNA, 21 nt, Artificial Sequence
  Marburg virus siRNA sense strand
agagggggagaauugggcucu

SEQ ID NO: 20498 - RNA, 21 nt, Artificial Sequence
  Marburg virus siRNA sense strand
gagggggagaauugggcucuu

SEQ ID NO: 20499 - RNA, 21 nt, Artificial Sequence
  Marburg virus siRNA sense strand
agggggagaauugggcucuuu

SEQ ID NO: 20500 - RNA, 21 nt, Artificial Sequence
  Marburg virus siRNA sense strand
gggggagaauugggcucuuuu

SEQ ID NO: 20501 - RNA, 21 nt, Artificial Sequence
  Marburg virus siRNA sense strand
ggggagaauugggcucuuuuu

SEQ ID NO: 20502 - RNA, 21 nt, Artificial Sequence
  Marburg virus siRNA sense strand
gggagaauugggcucuuuuug

SEQ ID NO: 20503 - RNA, 21 nt, Artificial Sequence
  Marburg virus siRNA sense strand
ggagaauugggcucuuuuugu

SEQ ID NO: 20504 - RNA, 21 nt, Artificial Sequence
  Marburg virus siRNA sense strand
gagaauugggcucuuuuuguc

SEQ ID NO: 20505 - RNA, 21 nt, Artificial Sequence
  Marburg virus siRNA sense strand
agaauugggcucuuuuuguca

SEQ ID NO: 20506 - RNA, 21 nt, Artificial Sequence
  Marburg virus siRNA sense strand
gaauugggcucuuuuugucau

SEQ ID NO: 20507 - RNA, 21 nt, Artificial Sequence
  Marburg virus siRNA sense strand
aauugggcucuuuuugucauu

SEQ ID NO: 20508 - RNA, 21 nt, Artificial Sequence
  Marburg virus siRNA sense strand
auugggcucuuuuugucauuu

SEQ ID NO: 20509 - RNA, 21 nt, Artificial Sequence
  Marburg virus siRNA sense strand
uugggcucuuuuugucauuuu

SEQ ID NO: 20510 - RNA, 21 nt, Artificial Sequence
  Marburg virus siRNA sense strand
ugggcucuuuuugucauuuug

SEQ ID NO: 20511 - RNA, 21 nt, Artificial Sequence
  Marburg virus siRNA sense strand
gggcucuuuuugucauuuugc

SEQ ID NO: 20512 - RNA, 21 nt, Artificial Sequence
  Marburg virus siRNA sense strand
ggcucuuuuugucauuuugca

SEQ ID NO: 20513 - RNA, 21 nt, Artificial Sequence
  Marburg virus siRNA sense strand
gcucuuuuugucauuuugcag

SEQ ID NO: 20514 - RNA, 21 nt, Artificial Sequence
  Marburg virus siRNA sense strand
cucuuuuugucauuuugcagu

SEQ ID NO: 20515 - RNA, 21 nt, Artificial Sequence
  Marburg virus siRNA sense strand
ucuuuuugucauuuugcaguc

SEQ ID NO: 20516 - RNA, 21 nt, Artificial Sequence
  Marburg virus siRNA sense strand
cuuuuugucauuuugcagucu

SEQ ID NO: 20517 - RNA, 21 nt, Artificial Sequence
  Marburg virus siRNA sense strand
uuuuugucauuuugcagucuu

SEQ ID NO: 20518 - RNA, 21 nt, Artificial Sequence
  Marburg virus siRNA sense strand
uuuugucauuuugcagucuuu

SEQ ID NO: 20519 - RNA, 21 nt, Artificial Sequence
  Marburg virus siRNA sense strand
uuugucauuuugcagucuuuu

SEQ ID NO: 20520 - RNA, 21 nt, Artificial Sequence
  Marburg virus siRNA sense strand
uugucauuuugcagucuuuuu

SEQ ID NO: 20521 - RNA, 21 nt, Artificial Sequence
  Marburg virus siRNA sense strand
ugucauuuugcagucuuuuuc

SEQ ID NO: 20522 - RNA, 21 nt, Artificial Sequence
  Marburg virus siRNA sense strand
gucauuuugcagucuuuuucu

SEQ ID NO: 20523 - RNA, 21 nt, Artificial Sequence
  Marburg virus siRNA sense strand
ucauuuugcagucuuuuucuc

SEQ ID NO: 20524 - RNA, 21 nt, Artificial Sequence
  Marburg virus siRNA sense strand
cauuuugcagucuuuuucucc

SEQ ID NO: 20525 - RNA, 21 nt, Artificial Sequence
  Marburg virus siRNA sense strand
auuuugcagucuuuuucuccc

SEQ ID NO: 20526 - RNA, 21 nt, Artificial Sequence
  Marburg virus siRNA sense strand
uuuugcagucuuuuucucccg

SEQ ID NO: 20527 - RNA, 21 nt, Artificial Sequence
  Marburg virus siRNA sense strand
uuugcagucuuuuucucccga

SEQ ID NO: 20528 - RNA, 21 nt, Artificial Sequence
  Marburg virus siRNA sense strand
uugcagucuuuuucucccgaa

SEQ ID NO: 20529 - RNA, 21 nt, Artificial Sequence
  Marburg virus siRNA sense strand
ugcagucuuuuucucccgaaa

SEQ ID NO: 20530 - RNA, 21 nt, Artificial Sequence
  Marburg virus siRNA sense strand
gcagucuuuuucucccgaaac

SEQ ID NO: 20531 - RNA, 21 nt, Artificial Sequence
  Marburg virus siRNA sense strand
cagucuuuuucucccgaaacu

SEQ ID NO: 20532 - RNA, 21 nt, Artificial Sequence
  Marburg virus siRNA sense strand
agucuuuuucucccgaaacuu

SEQ ID NO: 20533 - RNA, 21 nt, Artificial Sequence
  Marburg virus siRNA sense strand
gucuuuuucucccgaaacuug

SEQ ID NO: 20534 - RNA, 21 nt, Artificial Sequence
  Marburg virus siRNA sense strand
ucuuuuucucccgaaacuugu

SEQ ID NO: 20535 - RNA, 21 nt, Artificial Sequence
  Marburg virus siRNA sense strand
cuuuuucucccgaaacuuguu

SEQ ID NO: 20536 - RNA, 21 nt, Artificial Sequence
  Marburg virus siRNA sense strand
uuuuucucccgaaacuuguug

SEQ ID NO: 20537 - RNA, 21 nt, Artificial Sequence
  Marburg virus siRNA sense strand
uuuucucccgaaacuuguugu

SEQ ID NO: 20538 - RNA, 21 nt, Artificial Sequence
  Marburg virus siRNA sense strand
uuucucccgaaacuuguuguc

SEQ ID NO: 20539 - RNA, 21 nt, Artificial Sequence
  Marburg virus siRNA sense strand
uucucccgaaacuuguugucg

SEQ ID NO: 20540 - RNA, 21 nt, Artificial Sequence
  Marburg virus siRNA sense strand
ucucccgaaacuuguugucgg

SEQ ID NO: 20541 - RNA, 21 nt, Artificial Sequence
  Marburg virus siRNA sense strand
cucccgaaacuuguugucgga

SEQ ID NO: 20542 - RNA, 21 nt, Artificial Sequence
  Marburg virus siRNA sense strand
ucccgaaacuuguugucggag

SEQ ID NO: 20543 - RNA, 21 nt, Artificial Sequence
  Marburg virus siRNA sense strand
cccgaaacuuguugucggaga

SEQ ID NO: 20544 - RNA, 21 nt, Artificial Sequence
  Marburg virus siRNA sense strand
ccgaaacuuguugucggagau

SEQ ID NO: 20545 - RNA, 21 nt, Artificial Sequence
  Marburg virus siRNA sense strand
cgaaacuuguugucggagauc

SEQ ID NO: 20546 - RNA, 21 nt, Artificial Sequence
  Marburg virus siRNA sense strand
gaaacuuguugucggagaucg

SEQ ID NO: 20547 - RNA, 21 nt, Artificial Sequence
  Marburg virus siRNA sense strand
aaacuuguugucggagaucgg

SEQ ID NO: 20548 - RNA, 21 nt, Artificial Sequence
  Marburg virus siRNA sense strand
aacuuguugucggagaucggg

SEQ ID NO: 20549 - RNA, 21 nt, Artificial Sequence
  Marburg virus siRNA sense strand
acuuguugucggagaucgggc

SEQ ID NO: 20550 - RNA, 21 nt, Artificial Sequence
  Marburg virus siRNA sense strand
cuuguugucggagaucgggcu

SEQ ID NO: 20551 - RNA, 21 nt, Artificial Sequence
  Marburg virus siRNA sense strand
uuguugucggagaucgggcua

SEQ ID NO: 20552 - RNA, 21 nt, Artificial Sequence
  Marburg virus siRNA sense strand
uguugucggagaucgggcuag

SEQ ID NO: 20553 - RNA, 21 nt, Artificial Sequence
  Marburg virus siRNA sense strand
guugucggagaucgggcuagu

SEQ ID NO: 20554 - RNA, 21 nt, Artificial Sequence
  Marburg virus siRNA sense strand
uugucggagaucgggcuagua

SEQ ID NO: 20555 - RNA, 21 nt, Artificial Sequence
  Marburg virus siRNA sense strand
ugucggagaucgggcuaguau

SEQ ID NO: 20556 - RNA, 21 nt, Artificial Sequence
  Marburg virus siRNA sense strand
gucggagaucgggcuaguauc

SEQ ID NO: 20557 - RNA, 21 nt, Artificial Sequence
  Marburg virus siRNA sense strand
ucggagaucgggcuaguaucg

SEQ ID NO: 20558 - RNA, 21 nt, Artificial Sequence
  Marburg virus siRNA sense strand
cggagaucgggcuaguaucga

SEQ ID NO: 20559 - RNA, 21 nt, Artificial Sequence
  Marburg virus siRNA sense strand
ggagaucgggcuaguaucgaa

SEQ ID NO: 20560 - RNA, 21 nt, Artificial Sequence
  Marburg virus siRNA sense strand
gagaucgggcuaguaucgaaa

SEQ ID NO: 20561 - RNA, 21 nt, Artificial Sequence
  Marburg virus siRNA sense strand
agaucgggcuaguaucgaaaa

SEQ ID NO: 20562 - RNA, 21 nt, Artificial Sequence
  Marburg virus siRNA sense strand
gaucgggcuaguaucgaaaag

SEQ ID NO: 20563 - RNA, 21 nt, Artificial Sequence
  Marburg virus siRNA sense strand
aucgggcuaguaucgaaaagg

SEQ ID NO: 20564 - RNA, 21 nt, Artificial Sequence
  Marburg virus siRNA sense strand
ucgggcuaguaucgaaaaggc

SEQ ID NO: 20565 - RNA, 21 nt, Artificial Sequence
  Marburg virus siRNA sense strand
cgggcuaguaucgaaaaggcu

SEQ ID NO: 20566 - RNA, 21 nt, Artificial Sequence
  Marburg virus siRNA sense strand
gggcuaguaucgaaaaggcuu

SEQ ID NO: 20567 - RNA, 21 nt, Artificial Sequence
  Marburg virus siRNA sense strand
ggcuaguaucgaaaaggcuuu

SEQ ID NO: 20568 - RNA, 21 nt, Artificial Sequence
  Marburg virus siRNA sense strand
gcuaguaucgaaaaggcuuua

SEQ ID NO: 20569 - RNA, 21 nt, Artificial Sequence
  Marburg virus siRNA sense strand
cuaguaucgaaaaggcuuuaa

SEQ ID NO: 20570 - RNA, 21 nt, Artificial Sequence
  Marburg virus siRNA sense strand
uaguaucgaaaaggcuuuaag

SEQ ID NO: 20571 - RNA, 21 nt, Artificial Sequence
  Marburg virus siRNA sense strand
aguaucgaaaaggcuuuaaga

SEQ ID NO: 20572 - RNA, 21 nt, Artificial Sequence
  Marburg virus siRNA sense strand
guaucgaaaaggcuuuaagac

SEQ ID NO: 20573 - RNA, 21 nt, Artificial Sequence
  Marburg virus siRNA sense strand
uaucgaaaaggcuuuaagaca

SEQ ID NO: 20574 - RNA, 21 nt, Artificial Sequence
  Marburg virus siRNA sense strand
aucgaaaaggcuuuaagacaa

SEQ ID NO: 20575 - RNA, 21 nt, Artificial Sequence
  Marburg virus siRNA sense strand
ucgaaaaggcuuuaagacaag

SEQ ID NO: 20576 - RNA, 21 nt, Artificial Sequence
  Marburg virus siRNA sense strand
cgaaaaggcuuuaagacaagu

SEQ ID NO: 20577 - RNA, 21 nt, Artificial Sequence
  Marburg virus siRNA sense strand
gaaaaggcuuuaagacaagua

SEQ ID NO: 20578 - RNA, 21 nt, Artificial Sequence
  Marburg virus siRNA sense strand
aaaaggcuuuaagacaaguaa

SEQ ID NO: 20579 - RNA, 21 nt, Artificial Sequence
  Marburg virus siRNA sense strand
aaaggcuuuaagacaaguaac

SEQ ID NO: 20580 - RNA, 21 nt, Artificial Sequence
  Marburg virus siRNA sense strand
aaggcuuuaagacaaguaaca

SEQ ID NO: 20581 - RNA, 21 nt, Artificial Sequence
  Marburg virus siRNA sense strand
aggcuuuaagacaaguaacag

SEQ ID NO: 20582 - RNA, 21 nt, Artificial Sequence
  Marburg virus siRNA sense strand
ggcuuuaagacaaguaacagu

SEQ ID NO: 20583 - RNA, 21 nt, Artificial Sequence
  Marburg virus siRNA sense strand
gcuuuaagacaaguaacagua

SEQ ID NO: 20584 - RNA, 21 nt, Artificial Sequence
  Marburg virus siRNA sense strand
cuuuaagacaaguaacaguac

SEQ ID NO: 20585 - RNA, 21 nt, Artificial Sequence
  Marburg virus siRNA sense strand
uuuaagacaaguaacaguaca

SEQ ID NO: 20586 - RNA, 21 nt, Artificial Sequence
  Marburg virus siRNA sense strand
uuaagacaaguaacaguacau

SEQ ID NO: 20587 - RNA, 21 nt, Artificial Sequence
  Marburg virus siRNA sense strand
uaagacaaguaacaguacauc

SEQ ID NO: 20588 - RNA, 21 nt, Artificial Sequence
  Marburg virus siRNA sense strand
aagacaaguaacaguacauca

SEQ ID NO: 20589 - RNA, 21 nt, Artificial Sequence
  Marburg virus siRNA sense strand
agacaaguaacaguacaucaa

SEQ ID NO: 20590 - RNA, 21 nt, Artificial Sequence
  Marburg virus siRNA sense strand
gacaaguaacaguacaucaag

SEQ ID NO: 20591 - RNA, 21 nt, Artificial Sequence
  Marburg virus siRNA sense strand
acaaguaacaguacaucaaga

SEQ ID NO: 20592 - RNA, 21 nt, Artificial Sequence
  Marburg virus siRNA sense strand
caaguaacaguacaucaagaa

SEQ ID NO: 20593 - RNA, 21 nt, Artificial Sequence
  Marburg virus siRNA sense strand
aaguaacaguacaucaagaac

SEQ ID NO: 20594 - RNA, 21 nt, Artificial Sequence
  Marburg virus siRNA sense strand
aguaacaguacaucaagaaca

SEQ ID NO: 20595 - RNA, 21 nt, Artificial Sequence
  Marburg virus siRNA sense strand
guaacaguacaucaagaacag

SEQ ID NO: 20596 - RNA, 21 nt, Artificial Sequence
  Marburg virus siRNA sense strand
uaacaguacaucaagaacagg

SEQ ID NO: 20597 - RNA, 21 nt, Artificial Sequence
  Marburg virus siRNA sense strand
aacaguacaucaagaacaggg

SEQ ID NO: 20598 - RNA, 21 nt, Artificial Sequence
  Marburg virus siRNA sense strand
acaguacaucaagaacagggg

SEQ ID NO: 20599 - RNA, 21 nt, Artificial Sequence
  Marburg virus siRNA sense strand
caguacaucaagaacagggga

SEQ ID NO: 20600 - RNA, 21 nt, Artificial Sequence
  Marburg virus siRNA sense strand
aguacaucaagaacaggggau

SEQ ID NO: 20601 - RNA, 21 nt, Artificial Sequence
  Marburg virus siRNA sense strand
guacaucaagaacaggggauc

SEQ ID NO: 20602 - RNA, 21 nt, Artificial Sequence
  Marburg virus siRNA sense strand
uacaucaagaacaggggaucg

SEQ ID NO: 20603 - RNA, 21 nt, Artificial Sequence
  Marburg virus siRNA sense strand
acaucaagaacaggggaucgu

SEQ ID NO: 20604 - RNA, 21 nt, Artificial Sequence
  Marburg virus siRNA sense strand
caucaagaacaggggaucguc

SEQ ID NO: 20605 - RNA, 21 nt, Artificial Sequence
  Marburg virus siRNA sense strand
aucaagaacaggggaucguca

SEQ ID NO: 20606 - RNA, 21 nt, Artificial Sequence
  Marburg virus siRNA sense strand
ucaagaacaggggaucgucac

SEQ ID NO: 20607 - RNA, 21 nt, Artificial Sequence
  Marburg virus siRNA sense strand
caagaacaggggaucgucaca

SEQ ID NO: 20608 - RNA, 21 nt, Artificial Sequence
  Marburg virus siRNA sense strand
aagaacaggggaucgucacau

SEQ ID NO: 20609 - RNA, 21 nt, Artificial Sequence
  Marburg virus siRNA sense strand
agaacaggggaucgucacaua

SEQ ID NO: 20610 - RNA, 21 nt, Artificial Sequence
  Marburg virus siRNA sense strand
gaacaggggaucgucacauac

SEQ ID NO: 20611 - RNA, 21 nt, Artificial Sequence
  Marburg virus siRNA sense strand
aacaggggaucgucacauacc

SEQ ID NO: 20612 - RNA, 21 nt, Artificial Sequence
  Marburg virus siRNA sense strand
acaggggaucgucacauaccc

SEQ ID NO: 20613 - RNA, 21 nt, Artificial Sequence
  Marburg virus siRNA sense strand
caggggaucgucacauacccu

SEQ ID NO: 20614 - RNA, 21 nt, Artificial Sequence
  Marburg virus siRNA sense strand
aggggaucgucacauacccua

SEQ ID NO: 20615 - RNA, 21 nt, Artificial Sequence
  Marburg virus siRNA sense strand
ggggaucgucacauacccuaa

SEQ ID NO: 20616 - RNA, 21 nt, Artificial Sequence
  Marburg virus siRNA sense strand
gggaucgucacauacccuaau

SEQ ID NO: 20617 - RNA, 21 nt, Artificial Sequence
  Marburg virus siRNA sense strand
ggaucgucacauacccuaauc

SEQ ID NO: 20618 - RNA, 21 nt, Artificial Sequence
  Marburg virus siRNA sense strand
gaucgucacauacccuaauca

SEQ ID NO: 20619 - RNA, 21 nt, Artificial Sequence
  Marburg virus siRNA sense strand
aucgucacauacccuaaucac

SEQ ID NO: 20620 - RNA, 21 nt, Artificial Sequence
  Marburg virus siRNA sense strand
ucgucacauacccuaaucacu

SEQ ID NO: 20621 - RNA, 21 nt, Artificial Sequence
  Marburg virus siRNA sense strand
cgucacauacccuaaucacug

SEQ ID NO: 20622 - RNA, 21 nt, Artificial Sequence
  Marburg virus siRNA sense strand
gucacauacccuaaucacugg

SEQ ID NO: 20623 - RNA, 21 nt, Artificial Sequence
  Marburg virus siRNA sense strand
ucacauacccuaaucacuggc

SEQ ID NO: 20624 - RNA, 21 nt, Artificial Sequence
  Marburg virus siRNA sense strand
cacauacccuaaucacuggcu

SEQ ID NO: 20625 - RNA, 21 nt, Artificial Sequence
  Marburg virus siRNA sense strand
acauacccuaaucacuggcuu

SEQ ID NO: 20626 - RNA, 21 nt, Artificial Sequence
  Marburg virus siRNA sense strand
cauacccuaaucacuggcuua

SEQ ID NO: 20627 - RNA, 21 nt, Artificial Sequence
  Marburg virus siRNA sense strand
auacccuaaucacuggcuuac

SEQ ID NO: 20628 - RNA, 21 nt, Artificial Sequence
  Marburg virus siRNA sense strand
uacccuaaucacuggcuuacu

SEQ ID NO: 20629 - RNA, 21 nt, Artificial Sequence
  Marburg virus siRNA sense strand
acccuaaucacuggcuuacua

SEQ ID NO: 20630 - RNA, 21 nt, Artificial Sequence
  Marburg virus siRNA sense strand
cccuaaucacuggcuuacuac

SEQ ID NO: 20631 - RNA, 21 nt, Artificial Sequence
  Marburg virus siRNA sense strand
ccuaaucacuggcuuacuaca

SEQ ID NO: 20632 - RNA, 21 nt, Artificial Sequence
  Marburg virus siRNA sense strand
cuaaucacuggcuuacuacag

SEQ ID NO: 20633 - RNA, 21 nt, Artificial Sequence
  Marburg virus siRNA sense strand
uaaucacuggcuuacuacagg

SEQ ID NO: 20634 - RNA, 21 nt, Artificial Sequence
  Marburg virus siRNA sense strand
aaucacuggcuuacuacaggc

SEQ ID NO: 20635 - RNA, 21 nt, Artificial Sequence
  Marburg virus siRNA sense strand
aucacuggcuuacuacaggcc

SEQ ID NO: 20636 - RNA, 21 nt, Artificial Sequence
  Marburg virus siRNA sense strand
ucacuggcuuacuacaggcca

SEQ ID NO: 20637 - RNA, 21 nt, Artificial Sequence
  Marburg virus siRNA sense strand
cacuggcuuacuacaggccau

SEQ ID NO: 20638 - RNA, 21 nt, Artificial Sequence
  Marburg virus siRNA sense strand
acuggcuuacuacaggccaua

SEQ ID NO: 20639 - RNA, 21 nt, Artificial Sequence
  Marburg virus siRNA sense strand
cuggcuuacuacaggccauau

SEQ ID NO: 20640 - RNA, 21 nt, Artificial Sequence
  Marburg virus siRNA sense strand
uggcuuacuacaggccauaug

SEQ ID NO: 20641 - RNA, 21 nt, Artificial Sequence
  Marburg virus siRNA sense strand
ggcuuacuacaggccauauga

SEQ ID NO: 20642 - RNA, 21 nt, Artificial Sequence
  Marburg virus siRNA sense strand
gcuuacuacaggccauaugaa

SEQ ID NO: 20643 - RNA, 21 nt, Artificial Sequence
  Marburg virus siRNA sense strand
cuuacuacaggccauaugaaa

SEQ ID NO: 20644 - RNA, 21 nt, Artificial Sequence
  Marburg virus siRNA sense strand
uuacuacaggccauaugaaag

SEQ ID NO: 20645 - RNA, 21 nt, Artificial Sequence
  Marburg virus siRNA sense strand
uacuacaggccauaugaaagu

SEQ ID NO: 20646 - RNA, 21 nt, Artificial Sequence
  Marburg virus siRNA sense strand
acuacaggccauaugaaagua

SEQ ID NO: 20647 - RNA, 21 nt, Artificial Sequence
  Marburg virus siRNA sense strand
cuacaggccauaugaaaguaa

SEQ ID NO: 20648 - RNA, 21 nt, Artificial Sequence
  Marburg virus siRNA sense strand
uacaggccauaugaaaguaau

SEQ ID NO: 20649 - RNA, 21 nt, Artificial Sequence
  Marburg virus siRNA sense strand
acaggccauaugaaaguaauu

SEQ ID NO: 20650 - RNA, 21 nt, Artificial Sequence
  Marburg virus siRNA sense strand
caggccauaugaaaguaauuu

SEQ ID NO: 20651 - RNA, 21 nt, Artificial Sequence
  Marburg virus siRNA sense strand
aggccauaugaaaguaauuuu

SEQ ID NO: 20652 - RNA, 21 nt, Artificial Sequence
  Marburg virus siRNA sense strand
ggccauaugaaaguaauuuuu

SEQ ID NO: 20653 - RNA, 21 nt, Artificial Sequence
  Marburg virus siRNA sense strand
gccauaugaaaguaauuuuug

SEQ ID NO: 20654 - RNA, 21 nt, Artificial Sequence
  Marburg virus siRNA sense strand
ccauaugaaaguaauuuuugg

SEQ ID NO: 20655 - RNA, 21 nt, Artificial Sequence
  Marburg virus siRNA sense strand
cauaugaaaguaauuuuuggg

SEQ ID NO: 20656 - RNA, 21 nt, Artificial Sequence
  Marburg virus siRNA sense strand
auaugaaaguaauuuuuggga

SEQ ID NO: 20657 - RNA, 21 nt, Artificial Sequence
  Marburg virus siRNA sense strand
uaugaaaguaauuuuugggau

SEQ ID NO: 20658 - RNA, 21 nt, Artificial Sequence
  Marburg virus siRNA sense strand
augaaaguaauuuuugggauu

SEQ ID NO: 20659 - RNA, 21 nt, Artificial Sequence
  Marburg virus siRNA sense strand
ugaaaguaauuuuugggauuu

SEQ ID NO: 20660 - RNA, 21 nt, Artificial Sequence
  Marburg virus siRNA sense strand
gaaaguaauuuuugggauuuu

SEQ ID NO: 20661 - RNA, 21 nt, Artificial Sequence
  Marburg virus siRNA sense strand
aaaguaauuuuugggauuuug

SEQ ID NO: 20662 - RNA, 21 nt, Artificial Sequence
  Marburg virus siRNA sense strand
aaguaauuuuugggauuuuga

SEQ ID NO: 20663 - RNA, 21 nt, Artificial Sequence
  Marburg virus siRNA sense strand
aguaauuuuugggauuuugag

SEQ ID NO: 20664 - RNA, 21 nt, Artificial Sequence
  Marburg virus siRNA sense strand
guaauuuuugggauuuugagg

SEQ ID NO: 20665 - RNA, 21 nt, Artificial Sequence
  Marburg virus siRNA sense strand
uaauuuuugggauuuugaggu

SEQ ID NO: 20666 - RNA, 21 nt, Artificial Sequence
  Marburg virus siRNA sense strand
aauuuuugggauuuugagguc

SEQ ID NO: 20667 - RNA, 21 nt, Artificial Sequence
  Marburg virus siRNA sense strand
auuuuugggauuuugaggucu

SEQ ID NO: 20668 - RNA, 21 nt, Artificial Sequence
  Marburg virus siRNA sense strand
uuuuugggauuuugaggucua

SEQ ID NO: 20669 - RNA, 21 nt, Artificial Sequence
  Marburg virus siRNA sense strand
uuuugggauuuugaggucuag

SEQ ID NO: 20670 - RNA, 21 nt, Artificial Sequence
  Marburg virus siRNA sense strand
uuugggauuuugaggucuagc

SEQ ID NO: 20671 - RNA, 21 nt, Artificial Sequence
  Marburg virus siRNA sense strand
uugggauuuugaggucuagcu

SEQ ID NO: 20672 - RNA, 21 nt, Artificial Sequence
  Marburg virus siRNA sense strand
ugggauuuugaggucuagcuu

SEQ ID NO: 20673 - RNA, 21 nt, Artificial Sequence
  Marburg virus siRNA sense strand
gggauuuugaggucuagcuuu

SEQ ID NO: 20674 - RNA, 21 nt, Artificial Sequence
  Marburg virus siRNA sense strand
ggauuuugaggucuagcuuua

SEQ ID NO: 20675 - RNA, 21 nt, Artificial Sequence
  Marburg virus siRNA sense strand
gauuuugaggucuagcuuuau

SEQ ID NO: 20676 - RNA, 21 nt, Artificial Sequence
  Marburg virus siRNA sense strand
auuuugaggucuagcuuuauc

SEQ ID NO: 20677 - RNA, 21 nt, Artificial Sequence
  Marburg virus siRNA sense strand
uuuugaggucuagcuuuaucu

SEQ ID NO: 20678 - RNA, 21 nt, Artificial Sequence
  Marburg virus siRNA sense strand
uuugaggucuagcuuuaucuu

SEQ ID NO: 20679 - RNA, 21 nt, Artificial Sequence
  Marburg virus siRNA sense strand
uugaggucuagcuuuaucuua

SEQ ID NO: 20680 - RNA, 21 nt, Artificial Sequence
  Marburg virus siRNA sense strand
ugaggucuagcuuuaucuuaa

SEQ ID NO: 20681 - RNA, 21 nt, Artificial Sequence
  Marburg virus siRNA sense strand
gaggucuagcuuuaucuuaaa

SEQ ID NO: 20682 - RNA, 21 nt, Artificial Sequence
  Marburg virus siRNA sense strand
aggucuagcuuuaucuuaaaa

SEQ ID NO: 20683 - RNA, 21 nt, Artificial Sequence
  Marburg virus siRNA sense strand
ggucuagcuuuaucuuaaaau

SEQ ID NO: 20684 - RNA, 21 nt, Artificial Sequence
  Marburg virus siRNA sense strand
gucuagcuuuaucuuaaaauu

SEQ ID NO: 20685 - RNA, 21 nt, Artificial Sequence
  Marburg virus siRNA sense strand
ucuagcuuuaucuuaaaauuu

SEQ ID NO: 20686 - RNA, 21 nt, Artificial Sequence
  Marburg virus siRNA sense strand
cuagcuuuaucuuaaaauuug

SEQ ID NO: 20687 - RNA, 21 nt, Artificial Sequence
  Marburg virus siRNA sense strand
uagcuuuaucuuaaaauuugu

SEQ ID NO: 20688 - RNA, 21 nt, Artificial Sequence
  Marburg virus siRNA sense strand
agcuuuaucuuaaaauuugug

SEQ ID NO: 20689 - RNA, 21 nt, Artificial Sequence
  Marburg virus siRNA sense strand
gcuuuaucuuaaaauuugugu

SEQ ID NO: 20690 - RNA, 21 nt, Artificial Sequence
  Marburg virus siRNA sense strand
cuuuaucuuaaaauuuguguu

SEQ ID NO: 20691 - RNA, 21 nt, Artificial Sequence
  Marburg virus siRNA sense strand
uuuaucuuaaaauuuguguua

SEQ ID NO: 20692 - RNA, 21 nt, Artificial Sequence
  Marburg virus siRNA sense strand
uuaucuuaaaauuuguguuaa

SEQ ID NO: 20693 - RNA, 21 nt, Artificial Sequence
  Marburg virus siRNA sense strand
uaucuuaaaauuuguguuaau

SEQ ID NO: 20694 - RNA, 21 nt, Artificial Sequence
  Marburg virus siRNA sense strand
aucuuaaaauuuguguuaauu

SEQ ID NO: 20695 - RNA, 21 nt, Artificial Sequence
  Marburg virus siRNA sense strand
ucuuaaaauuuguguuaauuc

SEQ ID NO: 20696 - RNA, 21 nt, Artificial Sequence
  Marburg virus siRNA sense strand
cuuaaaauuuguguuaauuca

SEQ ID NO: 20697 - RNA, 21 nt, Artificial Sequence
  Marburg virus siRNA sense strand
uuaaaauuuguguuaauucau

SEQ ID NO: 20698 - RNA, 21 nt, Artificial Sequence
  Marburg virus siRNA sense strand
uaaaauuuguguuaauucauc

SEQ ID NO: 20699 - RNA, 21 nt, Artificial Sequence
  Marburg virus siRNA sense strand
aaaauuuguguuaauucauca

SEQ ID NO: 20700 - RNA, 21 nt, Artificial Sequence
  Marburg virus siRNA sense strand
aaauuuguguuaauucaucaa

SEQ ID NO: 20701 - RNA, 21 nt, Artificial Sequence
  Marburg virus siRNA sense strand
aauuuguguuaauucaucaag

SEQ ID NO: 20702 - RNA, 21 nt, Artificial Sequence
  Marburg virus siRNA sense strand
auuuguguuaauucaucaagg

SEQ ID NO: 20703 - RNA, 21 nt, Artificial Sequence
  Marburg virus siRNA sense strand
uuuguguuaauucaucaagga

SEQ ID NO: 20704 - RNA, 21 nt, Artificial Sequence
  Marburg virus siRNA sense strand
uuguguuaauucaucaaggag

SEQ ID NO: 20705 - RNA, 21 nt, Artificial Sequence
  Marburg virus siRNA sense strand
uguguuaauucaucaaggagu

SEQ ID NO: 20706 - RNA, 21 nt, Artificial Sequence
  Marburg virus siRNA sense strand
guguuaauucaucaaggagua

SEQ ID NO: 20707 - RNA, 21 nt, Artificial Sequence
  Marburg virus siRNA sense strand
uguuaauucaucaaggaguaa

SEQ ID NO: 20708 - RNA, 21 nt, Artificial Sequence
  Marburg virus siRNA sense strand
guuaauucaucaaggaguaaa

SEQ ID NO: 20709 - RNA, 21 nt, Artificial Sequence
  Marburg virus siRNA sense strand
uuaauucaucaaggaguaaau

SEQ ID NO: 20710 - RNA, 21 nt, Artificial Sequence
  Marburg virus siRNA sense strand
uaauucaucaaggaguaaauu

SEQ ID NO: 20711 - RNA, 21 nt, Artificial Sequence
  Marburg virus siRNA sense strand
aauucaucaaggaguaaauuu

SEQ ID NO: 20712 - RNA, 21 nt, Artificial Sequence
  Marburg virus siRNA sense strand
auucaucaaggaguaaauuug

SEQ ID NO: 20713 - RNA, 21 nt, Artificial Sequence
  Marburg virus siRNA sense strand
uucaucaaggaguaaauuugg

SEQ ID NO: 20714 - RNA, 21 nt, Artificial Sequence
  Marburg virus siRNA sense strand
ucaucaaggaguaaauuuggu

SEQ ID NO: 20715 - RNA, 21 nt, Artificial Sequence
  Marburg virus siRNA sense strand
caucaaggaguaaauuuggug

SEQ ID NO: 20716 - RNA, 21 nt, Artificial Sequence
  Marburg virus siRNA sense strand
aucaaggaguaaauuugguga

SEQ ID NO: 20717 - RNA, 21 nt, Artificial Sequence
  Marburg virus siRNA sense strand
ucaaggaguaaauuuggugac

SEQ ID NO: 20718 - RNA, 21 nt, Artificial Sequence
  Marburg virus siRNA sense strand
caaggaguaaauuuggugaca

SEQ ID NO: 20719 - RNA, 21 nt, Artificial Sequence
  Marburg virus siRNA sense strand
aaggaguaaauuuggugacag

SEQ ID NO: 20720 - RNA, 21 nt, Artificial Sequence
  Marburg virus siRNA sense strand
aggaguaaauuuggugacagg

SEQ ID NO: 20721 - RNA, 21 nt, Artificial Sequence
  Marburg virus siRNA sense strand
ggaguaaauuuggugacaggu

SEQ ID NO: 20722 - RNA, 21 nt, Artificial Sequence
  Marburg virus siRNA sense strand
gaguaaauuuggugacagguc

SEQ ID NO: 20723 - RNA, 21 nt, Artificial Sequence
  Marburg virus siRNA sense strand
aguaaauuuggugacagguca

SEQ ID NO: 20724 - RNA, 21 nt, Artificial Sequence
  Marburg virus siRNA sense strand
guaaauuuggugacaggucau

SEQ ID NO: 20725 - RNA, 21 nt, Artificial Sequence
  Marburg virus siRNA sense strand
uaaauuuggugacaggucaug

SEQ ID NO: 20726 - RNA, 21 nt, Artificial Sequence
  Marburg virus siRNA sense strand
aaauuuggugacaggucauga

SEQ ID NO: 20727 - RNA, 21 nt, Artificial Sequence
  Marburg virus siRNA sense strand
aauuuggugacaggucaugau

SEQ ID NO: 20728 - RNA, 21 nt, Artificial Sequence
  Marburg virus siRNA sense strand
auuuggugacaggucaugaug

SEQ ID NO: 20729 - RNA, 21 nt, Artificial Sequence
  Marburg virus siRNA sense strand
uuuggugacaggucaugaugc

SEQ ID NO: 20730 - RNA, 21 nt, Artificial Sequence
  Marburg virus siRNA sense strand
uuggugacaggucaugaugcc

SEQ ID NO: 20731 - RNA, 21 nt, Artificial Sequence
  Marburg virus siRNA sense strand
uggugacaggucaugaugccu

SEQ ID NO: 20732 - RNA, 21 nt, Artificial Sequence
  Marburg virus siRNA sense strand
ggugacaggucaugaugccua

SEQ ID NO: 20733 - RNA, 21 nt, Artificial Sequence
  Marburg virus siRNA sense strand
gugacaggucaugaugccuau

SEQ ID NO: 20734 - RNA, 21 nt, Artificial Sequence
  Marburg virus siRNA sense strand
ugacaggucaugaugccuaug

SEQ ID NO: 20735 - RNA, 21 nt, Artificial Sequence
  Marburg virus siRNA sense strand
gacaggucaugaugccuauga

SEQ ID NO: 20736 - RNA, 21 nt, Artificial Sequence
  Marburg virus siRNA sense strand
acaggucaugaugccuaugac

SEQ ID NO: 20737 - RNA, 21 nt, Artificial Sequence
  Marburg virus siRNA sense strand
caggucaugaugccuaugaca

SEQ ID NO: 20738 - RNA, 21 nt, Artificial Sequence
  Marburg virus siRNA sense strand
aggucaugaugccuaugacag

SEQ ID NO: 20739 - RNA, 21 nt, Artificial Sequence
  Marburg virus siRNA sense strand
ggucaugaugccuaugacagu

SEQ ID NO: 20740 - RNA, 21 nt, Artificial Sequence
  Marburg virus siRNA sense strand
gucaugaugccuaugacagua

SEQ ID NO: 20741 - RNA, 21 nt, Artificial Sequence
  Marburg virus siRNA sense strand
ucaugaugccuaugacaguau

SEQ ID NO: 20742 - RNA, 21 nt, Artificial Sequence
  Marburg virus siRNA sense strand
caugaugccuaugacaguauc

SEQ ID NO: 20743 - RNA, 21 nt, Artificial Sequence
  Marburg virus siRNA sense strand
augaugccuaugacaguauca

SEQ ID NO: 20744 - RNA, 21 nt, Artificial Sequence
  Marburg virus siRNA sense strand
ugaugccuaugacaguaucau

SEQ ID NO: 20745 - RNA, 21 nt, Artificial Sequence
  Marburg virus siRNA sense strand
gaugccuaugacaguaucauu

SEQ ID NO: 20746 - RNA, 21 nt, Artificial Sequence
  Marburg virus siRNA sense strand
augccuaugacaguaucauua

SEQ ID NO: 20747 - RNA, 21 nt, Artificial Sequence
  Marburg virus siRNA sense strand
ugccuaugacaguaucauuag

SEQ ID NO: 20748 - RNA, 21 nt, Artificial Sequence
  Marburg virus siRNA sense strand
gccuaugacaguaucauuagu

SEQ ID NO: 20749 - RNA, 21 nt, Artificial Sequence
  Marburg virus siRNA sense strand
ccuaugacaguaucauuagua

SEQ ID NO: 20750 - RNA, 21 nt, Artificial Sequence
  Marburg virus siRNA sense strand
cuaugacaguaucauuaguaa

SEQ ID NO: 20751 - RNA, 21 nt, Artificial Sequence
  Marburg virus siRNA sense strand
uaugacaguaucauuaguaau

SEQ ID NO: 20752 - RNA, 21 nt, Artificial Sequence
  Marburg virus siRNA sense strand
augacaguaucauuaguaauu

SEQ ID NO: 20753 - RNA, 21 nt, Artificial Sequence
  Marburg virus siRNA sense strand
ugacaguaucauuaguaauuc

SEQ ID NO: 20754 - RNA, 21 nt, Artificial Sequence
  Marburg virus siRNA sense strand
gacaguaucauuaguaauuca

SEQ ID NO: 20755 - RNA, 21 nt, Artificial Sequence
  Marburg virus siRNA sense strand
acaguaucauuaguaauucag

SEQ ID NO: 20756 - RNA, 21 nt, Artificial Sequence
  Marburg virus siRNA sense strand
caguaucauuaguaauucagu

SEQ ID NO: 20757 - RNA, 21 nt, Artificial Sequence
  Marburg virus siRNA sense strand
aguaucauuaguaauucagua

SEQ ID NO: 20758 - RNA, 21 nt, Artificial Sequence
  Marburg virus siRNA sense strand
guaucauuaguaauucaguag

SEQ ID NO: 20759 - RNA, 21 nt, Artificial Sequence
  Marburg virus siRNA sense strand
uaucauuaguaauucaguagg

SEQ ID NO: 20760 - RNA, 21 nt, Artificial Sequence
  Marburg virus siRNA sense strand
aucauuaguaauucaguaggu

SEQ ID NO: 20761 - RNA, 21 nt, Artificial Sequence
  Marburg virus siRNA sense strand
ucauuaguaauucaguagguc

SEQ ID NO: 20762 - RNA, 21 nt, Artificial Sequence
  Marburg virus siRNA sense strand
cauuaguaauucaguagguca

SEQ ID NO: 20763 - RNA, 21 nt, Artificial Sequence
  Marburg virus siRNA sense strand
auuaguaauucaguaggucaa

SEQ ID NO: 20764 - RNA, 21 nt, Artificial Sequence
  Marburg virus siRNA sense strand
uuaguaauucaguaggucaaa

SEQ ID NO: 20765 - RNA, 21 nt, Artificial Sequence
  Marburg virus siRNA sense strand
uaguaauucaguaggucaaac

SEQ ID NO: 20766 - RNA, 21 nt, Artificial Sequence
  Marburg virus siRNA sense strand
aguaauucaguaggucaaacu

SEQ ID NO: 20767 - RNA, 21 nt, Artificial Sequence
  Marburg virus siRNA sense strand
guaauucaguaggucaaacua

SEQ ID NO: 20768 - RNA, 21 nt, Artificial Sequence
  Marburg virus siRNA sense strand
uaauucaguaggucaaacuag

SEQ ID NO: 20769 - RNA, 21 nt, Artificial Sequence
  Marburg virus siRNA sense strand
aauucaguaggucaaacuaga

SEQ ID NO: 20770 - RNA, 21 nt, Artificial Sequence
  Marburg virus siRNA sense strand
auucaguaggucaaacuagau

SEQ ID NO: 20771 - RNA, 21 nt, Artificial Sequence
  Marburg virus siRNA sense strand
uucaguaggucaaacuagauu

SEQ ID NO: 20772 - RNA, 21 nt, Artificial Sequence
  Marburg virus siRNA sense strand
ucaguaggucaaacuagauuc

SEQ ID NO: 20773 - RNA, 21 nt, Artificial Sequence
  Marburg virus siRNA sense strand
caguaggucaaacuagauucu

SEQ ID NO: 20774 - RNA, 21 nt, Artificial Sequence
  Marburg virus siRNA sense strand
aguaggucaaacuagauucuc

SEQ ID NO: 20775 - RNA, 21 nt, Artificial Sequence
  Marburg virus siRNA sense strand
guaggucaaacuagauucuca

SEQ ID NO: 20776 - RNA, 21 nt, Artificial Sequence
  Marburg virus siRNA sense strand
uaggucaaacuagauucucag

SEQ ID NO: 20777 - RNA, 21 nt, Artificial Sequence
  Marburg virus siRNA sense strand
aggucaaacuagauucucagg

SEQ ID NO: 20778 - RNA, 21 nt, Artificial Sequence
  Marburg virus siRNA sense strand
ggucaaacuagauucucagga

SEQ ID NO: 20779 - RNA, 21 nt, Artificial Sequence
  Marburg virus siRNA sense strand
gucaaacuagauucucaggac

SEQ ID NO: 20780 - RNA, 21 nt, Artificial Sequence
  Marburg virus siRNA sense strand
ucaaacuagauucucaggacu

SEQ ID NO: 20781 - RNA, 21 nt, Artificial Sequence
  Marburg virus siRNA sense strand
caaacuagauucucaggacuu

SEQ ID NO: 20782 - RNA, 21 nt, Artificial Sequence
  Marburg virus siRNA sense strand
aaacuagauucucaggacuuc

SEQ ID NO: 20783 - RNA, 21 nt, Artificial Sequence
  Marburg virus siRNA sense strand
aacuagauucucaggacuucu

SEQ ID NO: 20784 - RNA, 21 nt, Artificial Sequence
  Marburg virus siRNA sense strand
acuagauucucaggacuucuu

SEQ ID NO: 20785 - RNA, 21 nt, Artificial Sequence
  Marburg virus siRNA sense strand
cuagauucucaggacuucuua

SEQ ID NO: 20786 - RNA, 21 nt, Artificial Sequence
  Marburg virus siRNA sense strand
uagauucucaggacuucuuau

SEQ ID NO: 20787 - RNA, 21 nt, Artificial Sequence
  Marburg virus siRNA sense strand
agauucucaggacuucuuauu

SEQ ID NO: 20788 - RNA, 21 nt, Artificial Sequence
  Marburg virus siRNA sense strand
gauucucaggacuucuuauug

SEQ ID NO: 20789 - RNA, 21 nt, Artificial Sequence
  Marburg virus siRNA sense strand
auucucaggacuucuuauugu

SEQ ID NO: 20790 - RNA, 21 nt, Artificial Sequence
  Marburg virus siRNA sense strand
uucucaggacuucuuauugug

SEQ ID NO: 20791 - RNA, 21 nt, Artificial Sequence
  Marburg virus siRNA sense strand
ucucaggacuucuuauuguga

SEQ ID NO: 20792 - RNA, 21 nt, Artificial Sequence
  Marburg virus siRNA sense strand
cucaggacuucuuauugugaa

SEQ ID NO: 20793 - RNA, 21 nt, Artificial Sequence
  Marburg virus siRNA sense strand
ucaggacuucuuauugugaaa

SEQ ID NO: 20794 - RNA, 21 nt, Artificial Sequence
  Marburg virus siRNA sense strand
caggacuucuuauugugaaaa

SEQ ID NO: 20795 - RNA, 21 nt, Artificial Sequence
  Marburg virus siRNA sense strand
aggacuucuuauugugaaaac

SEQ ID NO: 20796 - RNA, 21 nt, Artificial Sequence
  Marburg virus siRNA sense strand
ggacuucuuauugugaaaaca

SEQ ID NO: 20797 - RNA, 21 nt, Artificial Sequence
  Marburg virus siRNA sense strand
gacuucuuauugugaaaacag

SEQ ID NO: 20798 - RNA, 21 nt, Artificial Sequence
  Marburg virus siRNA sense strand
acuucuuauugugaaaacagu

SEQ ID NO: 20799 - RNA, 21 nt, Artificial Sequence
  Marburg virus siRNA sense strand
cuucuuauugugaaaacaguu

SEQ ID NO: 20800 - RNA, 21 nt, Artificial Sequence
  Marburg virus siRNA sense strand
uucuuauugugaaaacaguuc

SEQ ID NO: 20801 - RNA, 21 nt, Artificial Sequence
  Marburg virus siRNA sense strand
ucuuauugugaaaacaguucu

SEQ ID NO: 20802 - RNA, 21 nt, Artificial Sequence
  Marburg virus siRNA sense strand
cuuauugugaaaacaguucuu

SEQ ID NO: 20803 - RNA, 21 nt, Artificial Sequence
  Marburg virus siRNA sense strand
uuauugugaaaacaguucuug

SEQ ID NO: 20804 - RNA, 21 nt, Artificial Sequence
  Marburg virus siRNA sense strand
uauugugaaaacaguucuuga

SEQ ID NO: 20805 - RNA, 21 nt, Artificial Sequence
  Marburg virus siRNA sense strand
auugugaaaacaguucuugag

SEQ ID NO: 20806 - RNA, 21 nt, Artificial Sequence
  Marburg virus siRNA sense strand
uugugaaaacaguucuugagu

SEQ ID NO: 20807 - RNA, 21 nt, Artificial Sequence
  Marburg virus siRNA sense strand
ugugaaaacaguucuugaguu

SEQ ID NO: 20808 - RNA, 21 nt, Artificial Sequence
  Marburg virus siRNA sense strand
gugaaaacaguucuugaguuc

SEQ ID NO: 20809 - RNA, 21 nt, Artificial Sequence
  Marburg virus siRNA sense strand
ugaaaacaguucuugaguuca

SEQ ID NO: 20810 - RNA, 21 nt, Artificial Sequence
  Marburg virus siRNA sense strand
gaaaacaguucuugaguucau

SEQ ID NO: 20811 - RNA, 21 nt, Artificial Sequence
  Marburg virus siRNA sense strand
aaaacaguucuugaguucauc

SEQ ID NO: 20812 - RNA, 21 nt, Artificial Sequence
  Marburg virus siRNA sense strand
aaacaguucuugaguucaucu

SEQ ID NO: 20813 - RNA, 21 nt, Artificial Sequence
  Marburg virus siRNA sense strand
aacaguucuugaguucaucuu

SEQ ID NO: 20814 - RNA, 21 nt, Artificial Sequence
  Marburg virus siRNA sense strand
acaguucuugaguucaucuug

SEQ ID NO: 20815 - RNA, 21 nt, Artificial Sequence
  Marburg virus siRNA sense strand
caguucuugaguucaucuugc

SEQ ID NO: 20816 - RNA, 21 nt, Artificial Sequence
  Marburg virus siRNA sense strand
aguucuugaguucaucuugca

SEQ ID NO: 20817 - RNA, 21 nt, Artificial Sequence
  Marburg virus siRNA sense strand
guucuugaguucaucuugcaa

SEQ ID NO: 20818 - RNA, 21 nt, Artificial Sequence
  Marburg virus siRNA sense strand
uucuugaguucaucuugcaaa

SEQ ID NO: 20819 - RNA, 21 nt, Artificial Sequence
  Marburg virus siRNA sense strand
ucuugaguucaucuugcaaaa

SEQ ID NO: 20820 - RNA, 21 nt, Artificial Sequence
  Marburg virus siRNA sense strand
cuugaguucaucuugcaaaaa

SEQ ID NO: 20821 - RNA, 21 nt, Artificial Sequence
  Marburg virus siRNA sense strand
uugaguucaucuugcaaaaaa

SEQ ID NO: 20822 - RNA, 21 nt, Artificial Sequence
  Marburg virus siRNA sense strand
ugaguucaucuugcaaaaaac

SEQ ID NO: 20823 - RNA, 21 nt, Artificial Sequence
  Marburg virus siRNA sense strand
gaguucaucuugcaaaaaacu

SEQ ID NO: 20824 - RNA, 21 nt, Artificial Sequence
  Marburg virus siRNA sense strand
aguucaucuugcaaaaaacug

SEQ ID NO: 20825 - RNA, 21 nt, Artificial Sequence
  Marburg virus siRNA sense strand
guucaucuugcaaaaaacuga

SEQ ID NO: 20826 - RNA, 21 nt, Artificial Sequence
  Marburg virus siRNA sense strand
uucaucuugcaaaaaacugau

SEQ ID NO: 20827 - RNA, 21 nt, Artificial Sequence
  Marburg virus siRNA sense strand
ucaucuugcaaaaaacugauu

SEQ ID NO: 20828 - RNA, 21 nt, Artificial Sequence
  Marburg virus siRNA sense strand
caucuugcaaaaaacugauuc

SEQ ID NO: 20829 - RNA, 21 nt, Artificial Sequence
  Marburg virus siRNA sense strand
aucuugcaaaaaacugauuca

SEQ ID NO: 20830 - RNA, 21 nt, Artificial Sequence
  Marburg virus siRNA sense strand
ucuugcaaaaaacugauucag

SEQ ID NO: 20831 - RNA, 21 nt, Artificial Sequence
  Marburg virus siRNA sense strand
cuugcaaaaaacugauucagg

SEQ ID NO: 20832 - RNA, 21 nt, Artificial Sequence
  Marburg virus siRNA sense strand
uugcaaaaaacugauucaggg

SEQ ID NO: 20833 - RNA, 21 nt, Artificial Sequence
  Marburg virus siRNA sense strand
ugcaaaaaacugauucagggg

SEQ ID NO: 20834 - RNA, 21 nt, Artificial Sequence
  Marburg virus siRNA sense strand
gcaaaaaacugauucaggggu

SEQ ID NO: 20835 - RNA, 21 nt, Artificial Sequence
  Marburg virus siRNA sense strand
caaaaaacugauucaggggug

SEQ ID NO: 20836 - RNA, 21 nt, Artificial Sequence
  Marburg virus siRNA sense strand
aaaaaacugauucagggguga

SEQ ID NO: 20837 - RNA, 21 nt, Artificial Sequence
  Marburg virus siRNA sense strand
aaaaacugauucaggggugac

SEQ ID NO: 20838 - RNA, 21 nt, Artificial Sequence
  Marburg virus siRNA sense strand
aaaacugauucaggggugaca

SEQ ID NO: 20839 - RNA, 21 nt, Artificial Sequence
  Marburg virus siRNA sense strand
aaacugauucaggggugacac

SEQ ID NO: 20840 - RNA, 21 nt, Artificial Sequence
  Marburg virus siRNA sense strand
aacugauucaggggugacacu

SEQ ID NO: 20841 - RNA, 21 nt, Artificial Sequence
  Marburg virus siRNA sense strand
acugauucaggggugacacua

SEQ ID NO: 20842 - RNA, 21 nt, Artificial Sequence
  Marburg virus siRNA sense strand
cugauucaggggugacacuac

SEQ ID NO: 20843 - RNA, 21 nt, Artificial Sequence
  Marburg virus siRNA sense strand
ugauucaggggugacacuaca

SEQ ID NO: 20844 - RNA, 21 nt, Artificial Sequence
  Marburg virus siRNA sense strand
gauucaggggugacacuacau

SEQ ID NO: 20845 - RNA, 21 nt, Artificial Sequence
  Marburg virus siRNA sense strand
auucaggggugacacuacauc

SEQ ID NO: 20846 - RNA, 21 nt, Artificial Sequence
  Marburg virus siRNA sense strand
uucaggggugacacuacaucc

SEQ ID NO: 20847 - RNA, 21 nt, Artificial Sequence
  Marburg virus siRNA sense strand
ucaggggugacacuacauccu

SEQ ID NO: 20848 - RNA, 21 nt, Artificial Sequence
  Marburg virus siRNA sense strand
caggggugacacuacauccuu

SEQ ID NO: 20849 - RNA, 21 nt, Artificial Sequence
  Marburg virus siRNA sense strand
aggggugacacuacauccuuu

SEQ ID NO: 20850 - RNA, 21 nt, Artificial Sequence
  Marburg virus siRNA sense strand
ggggugacacuacauccuuug

SEQ ID NO: 20851 - RNA, 21 nt, Artificial Sequence
  Marburg virus siRNA sense strand
gggugacacuacauccuuugg

SEQ ID NO: 20852 - RNA, 21 nt, Artificial Sequence
  Marburg virus siRNA sense strand
ggugacacuacauccuuuggu

SEQ ID NO: 20853 - RNA, 21 nt, Artificial Sequence
  Marburg virus siRNA sense strand
gugacacuacauccuuuggug

SEQ ID NO: 20854 - RNA, 21 nt, Artificial Sequence
  Marburg virus siRNA sense strand
ugacacuacauccuuuggugc

SEQ ID NO: 20855 - RNA, 21 nt, Artificial Sequence
  Marburg virus siRNA sense strand
gacacuacauccuuuggugcg

SEQ ID NO: 20856 - RNA, 21 nt, Artificial Sequence
  Marburg virus siRNA sense strand
acacuacauccuuuggugcgg

SEQ ID NO: 20857 - RNA, 21 nt, Artificial Sequence
  Marburg virus siRNA sense strand
cacuacauccuuuggugcgga

SEQ ID NO: 20858 - RNA, 21 nt, Artificial Sequence
  Marburg virus siRNA sense strand
acuacauccuuuggugcggac

SEQ ID NO: 20859 - RNA, 21 nt, Artificial Sequence
  Marburg virus siRNA sense strand
cuacauccuuuggugcggacc

SEQ ID NO: 20860 - RNA, 21 nt, Artificial Sequence
  Marburg virus siRNA sense strand
uacauccuuuggugcggaccu

SEQ ID NO: 20861 - RNA, 21 nt, Artificial Sequence
  Marburg virus siRNA sense strand
acauccuuuggugcggaccuc

SEQ ID NO: 20862 - RNA, 21 nt, Artificial Sequence
  Marburg virus siRNA sense strand
cauccuuuggugcggaccucc

SEQ ID NO: 20863 - RNA, 21 nt, Artificial Sequence
  Marburg virus siRNA sense strand
auccuuuggugcggaccucca

SEQ ID NO: 20864 - RNA, 21 nt, Artificial Sequence
  Marburg virus siRNA sense strand
uccuuuggugcggaccuccaa

SEQ ID NO: 20865 - RNA, 21 nt, Artificial Sequence
  Marburg virus siRNA sense strand
ccuuuggugcggaccuccaaa

SEQ ID NO: 20866 - RNA, 21 nt, Artificial Sequence
  Marburg virus siRNA sense strand
cuuuggugcggaccuccaaag

SEQ ID NO: 20867 - RNA, 21 nt, Artificial Sequence
  Marburg virus siRNA sense strand
uuuggugcggaccuccaaagu

SEQ ID NO: 20868 - RNA, 21 nt, Artificial Sequence
  Marburg virus siRNA sense strand
uuggugcggaccuccaaagua

SEQ ID NO: 20869 - RNA, 21 nt, Artificial Sequence
  Marburg virus siRNA sense strand
uggugcggaccuccaaaguaa

SEQ ID NO: 20870 - RNA, 21 nt, Artificial Sequence
  Marburg virus siRNA sense strand
ggugcggaccuccaaaguaaa

SEQ ID NO: 20871 - RNA, 21 nt, Artificial Sequence
  Marburg virus siRNA sense strand
gugcggaccuccaaaguaaaa

SEQ ID NO: 20872 - RNA, 21 nt, Artificial Sequence
  Marburg virus siRNA sense strand
ugcggaccuccaaaguaaaaa

SEQ ID NO: 20873 - RNA, 21 nt, Artificial Sequence
  Marburg virus siRNA sense strand
gcggaccuccaaaguaaaaaa

SEQ ID NO: 20874 - RNA, 21 nt, Artificial Sequence
  Marburg virus siRNA sense strand
cggaccuccaaaguaaaaaau

SEQ ID NO: 20875 - RNA, 21 nt, Artificial Sequence
  Marburg virus siRNA sense strand
ggaccuccaaaguaaaaaaug

SEQ ID NO: 20876 - RNA, 21 nt, Artificial Sequence
  Marburg virus siRNA sense strand
gaccuccaaaguaaaaaauga

SEQ ID NO: 20877 - RNA, 21 nt, Artificial Sequence
  Marburg virus siRNA sense strand
accuccaaaguaaaaaaugaa

SEQ ID NO: 20878 - RNA, 21 nt, Artificial Sequence
  Marburg virus siRNA sense strand
ccuccaaaguaaaaaaugaag

SEQ ID NO: 20879 - RNA, 21 nt, Artificial Sequence
  Marburg virus siRNA sense strand
cuccaaaguaaaaaaugaagu

SEQ ID NO: 20880 - RNA, 21 nt, Artificial Sequence
  Marburg virus siRNA sense strand
uccaaaguaaaaaaugaaguu

SEQ ID NO: 20881 - RNA, 21 nt, Artificial Sequence
  Marburg virus siRNA sense strand
ccaaaguaaaaaaugaaguug

SEQ ID NO: 20882 - RNA, 21 nt, Artificial Sequence
  Marburg virus siRNA sense strand
caaaguaaaaaaugaaguugc

SEQ ID NO: 20883 - RNA, 21 nt, Artificial Sequence
  Marburg virus siRNA sense strand
aaaguaaaaaaugaaguugcu

SEQ ID NO: 20884 - RNA, 21 nt, Artificial Sequence
  Marburg virus siRNA sense strand
aaguaaaaaaugaaguugcua

SEQ ID NO: 20885 - RNA, 21 nt, Artificial Sequence
  Marburg virus siRNA sense strand
aguaaaaaaugaaguugcuag

SEQ ID NO: 20886 - RNA, 21 nt, Artificial Sequence
  Marburg virus siRNA sense strand
guaaaaaaugaaguugcuagu

SEQ ID NO: 20887 - RNA, 21 nt, Artificial Sequence
  Marburg virus siRNA sense strand
uaaaaaaugaaguugcuaguu

SEQ ID NO: 20888 - RNA, 21 nt, Artificial Sequence
  Marburg virus siRNA sense strand
aaaaaaugaaguugcuaguuu

SEQ ID NO: 20889 - RNA, 21 nt, Artificial Sequence
  Marburg virus siRNA sense strand
aaaaaugaaguugcuaguuuc

SEQ ID NO: 20890 - RNA, 21 nt, Artificial Sequence
  Marburg virus siRNA sense strand
aaaaugaaguugcuaguuuca

SEQ ID NO: 20891 - RNA, 21 nt, Artificial Sequence
  Marburg virus siRNA sense strand
aaaugaaguugcuaguuucaa

SEQ ID NO: 20892 - RNA, 21 nt, Artificial Sequence
  Marburg virus siRNA sense strand
aaugaaguugcuaguuucaag

SEQ ID NO: 20893 - RNA, 21 nt, Artificial Sequence
  Marburg virus siRNA sense strand
augaaguugcuaguuucaagc

SEQ ID NO: 20894 - RNA, 21 nt, Artificial Sequence
  Marburg virus siRNA sense strand
ugaaguugcuaguuucaagca

SEQ ID NO: 20895 - RNA, 21 nt, Artificial Sequence
  Marburg virus siRNA sense strand
gaaguugcuaguuucaagcag

SEQ ID NO: 20896 - RNA, 21 nt, Artificial Sequence
  Marburg virus siRNA sense strand
aaguugcuaguuucaagcagg

SEQ ID NO: 20897 - RNA, 21 nt, Artificial Sequence
  Marburg virus siRNA sense strand
aguugcuaguuucaagcaggc

SEQ ID NO: 20898 - RNA, 21 nt, Artificial Sequence
  Marburg virus siRNA sense strand
guugcuaguuucaagcaggcg

SEQ ID NO: 20899 - RNA, 21 nt, Artificial Sequence
  Marburg virus siRNA sense strand
uugcuaguuucaagcaggcgu

SEQ ID NO: 20900 - RNA, 21 nt, Artificial Sequence
  Marburg virus siRNA sense strand
ugcuaguuucaagcaggcguu

SEQ ID NO: 20901 - RNA, 21 nt, Artificial Sequence
  Marburg virus siRNA sense strand
gcuaguuucaagcaggcguug

SEQ ID NO: 20902 - RNA, 21 nt, Artificial Sequence
  Marburg virus siRNA sense strand
cuaguuucaagcaggcguuga

SEQ ID NO: 20903 - RNA, 21 nt, Artificial Sequence
  Marburg virus siRNA sense strand
uaguuucaagcaggcguugag

SEQ ID NO: 20904 - RNA, 21 nt, Artificial Sequence
  Marburg virus siRNA sense strand
aguuucaagcaggcguugagc

SEQ ID NO: 20905 - RNA, 21 nt, Artificial Sequence
  Marburg virus siRNA sense strand
guuucaagcaggcguugagca

SEQ ID NO: 20906 - RNA, 21 nt, Artificial Sequence
  Marburg virus siRNA sense strand
uuucaagcaggcguugagcaa

SEQ ID NO: 20907 - RNA, 21 nt, Artificial Sequence
  Marburg virus siRNA sense strand
uucaagcaggcguugagcaac

SEQ ID NO: 20908 - RNA, 21 nt, Artificial Sequence
  Marburg virus siRNA sense strand
ucaagcaggcguugagcaacc

SEQ ID NO: 20909 - RNA, 21 nt, Artificial Sequence
  Marburg virus siRNA sense strand
caagcaggcguugagcaaccu

SEQ ID NO: 20910 - RNA, 21 nt, Artificial Sequence
  Marburg virus siRNA sense strand
aagcaggcguugagcaaccua

SEQ ID NO: 20911 - RNA, 21 nt, Artificial Sequence
  Marburg virus siRNA sense strand
agcaggcguugagcaaccuag

SEQ ID NO: 20912 - RNA, 21 nt, Artificial Sequence
  Marburg virus siRNA sense strand
gcaggcguugagcaaccuagc

SEQ ID NO: 20913 - RNA, 21 nt, Artificial Sequence
  Marburg virus siRNA sense strand
caggcguugagcaaccuagcc

SEQ ID NO: 20914 - RNA, 21 nt, Artificial Sequence
  Marburg virus siRNA sense strand
aggcguugagcaaccuagccc

SEQ ID NO: 20915 - RNA, 21 nt, Artificial Sequence
  Marburg virus siRNA sense strand
ggcguugagcaaccuagcccg

SEQ ID NO: 20916 - RNA, 21 nt, Artificial Sequence
  Marburg virus siRNA sense strand
gcguugagcaaccuagcccga

SEQ ID NO: 20917 - RNA, 21 nt, Artificial Sequence
  Marburg virus siRNA sense strand
cguugagcaaccuagcccgac

SEQ ID NO: 20918 - RNA, 21 nt, Artificial Sequence
  Marburg virus siRNA sense strand
guugagcaaccuagcccgaca

SEQ ID NO: 20919 - RNA, 21 nt, Artificial Sequence
  Marburg virus siRNA sense strand
uugagcaaccuagcccgacau

SEQ ID NO: 20920 - RNA, 21 nt, Artificial Sequence
  Marburg virus siRNA sense strand
ugagcaaccuagcccgacaug

SEQ ID NO: 20921 - RNA, 21 nt, Artificial Sequence
  Marburg virus siRNA sense strand
gagcaaccuagcccgacaugg

SEQ ID NO: 20922 - RNA, 21 nt, Artificial Sequence
  Marburg virus siRNA sense strand
agcaaccuagcccgacaugga

SEQ ID NO: 20923 - RNA, 21 nt, Artificial Sequence
  Marburg virus siRNA sense strand
gcaaccuagcccgacauggag

SEQ ID NO: 20924 - RNA, 21 nt, Artificial Sequence
  Marburg virus siRNA sense strand
caaccuagcccgacauggaga

SEQ ID NO: 20925 - RNA, 21 nt, Artificial Sequence
  Marburg virus siRNA sense strand
aaccuagcccgacauggagaa

SEQ ID NO: 20926 - RNA, 21 nt, Artificial Sequence
  Marburg virus siRNA sense strand
accuagcccgacauggagaau

SEQ ID NO: 20927 - RNA, 21 nt, Artificial Sequence
  Marburg virus siRNA sense strand
ccuagcccgacauggagaaua

SEQ ID NO: 20928 - RNA, 21 nt, Artificial Sequence
  Marburg virus siRNA sense strand
cuagcccgacauggagaauac

SEQ ID NO: 20929 - RNA, 21 nt, Artificial Sequence
  Marburg virus siRNA sense strand
uagcccgacauggagaauacg

SEQ ID NO: 20930 - RNA, 21 nt, Artificial Sequence
  Marburg virus siRNA sense strand
agcccgacauggagaauacgc

SEQ ID NO: 20931 - RNA, 21 nt, Artificial Sequence
  Marburg virus siRNA sense strand
gcccgacauggagaauacgca

SEQ ID NO: 20932 - RNA, 21 nt, Artificial Sequence
  Marburg virus siRNA sense strand
cccgacauggagaauacgcac

SEQ ID NO: 20933 - RNA, 21 nt, Artificial Sequence
  Marburg virus siRNA sense strand
ccgacauggagaauacgcacc

SEQ ID NO: 20934 - RNA, 21 nt, Artificial Sequence
  Marburg virus siRNA sense strand
cgacauggagaauacgcaccg

SEQ ID NO: 20935 - RNA, 21 nt, Artificial Sequence
  Marburg virus siRNA sense strand
gacauggagaauacgcaccgu

SEQ ID NO: 20936 - RNA, 21 nt, Artificial Sequence
  Marburg virus siRNA sense strand
acauggagaauacgcaccguu

SEQ ID NO: 20937 - RNA, 21 nt, Artificial Sequence
  Marburg virus siRNA sense strand
cauggagaauacgcaccguuc

SEQ ID NO: 20938 - RNA, 21 nt, Artificial Sequence
  Marburg virus siRNA sense strand
auggagaauacgcaccguucg

SEQ ID NO: 20939 - RNA, 21 nt, Artificial Sequence
  Marburg virus siRNA sense strand
uggagaauacgcaccguucgc

SEQ ID NO: 20940 - RNA, 21 nt, Artificial Sequence
  Marburg virus siRNA sense strand
ggagaauacgcaccguucgca

SEQ ID NO: 20941 - RNA, 21 nt, Artificial Sequence
  Marburg virus siRNA sense strand
gagaauacgcaccguucgcac

SEQ ID NO: 20942 - RNA, 21 nt, Artificial Sequence
  Marburg virus siRNA sense strand
agaauacgcaccguucgcacg

SEQ ID NO: 20943 - RNA, 21 nt, Artificial Sequence
  Marburg virus siRNA sense strand
gaauacgcaccguucgcacgg

SEQ ID NO: 20944 - RNA, 21 nt, Artificial Sequence
  Marburg virus siRNA sense strand
aauacgcaccguucgcacggg

SEQ ID NO: 20945 - RNA, 21 nt, Artificial Sequence
  Marburg virus siRNA sense strand
auacgcaccguucgcacgggu

SEQ ID NO: 20946 - RNA, 21 nt, Artificial Sequence
  Marburg virus siRNA sense strand
uacgcaccguucgcacggguu

SEQ ID NO: 20947 - RNA, 21 nt, Artificial Sequence
  Marburg virus siRNA sense strand
acgcaccguucgcacggguuc

SEQ ID NO: 20948 - RNA, 21 nt, Artificial Sequence
  Marburg virus siRNA sense strand
cgcaccguucgcacggguucu

SEQ ID NO: 20949 - RNA, 21 nt, Artificial Sequence
  Marburg virus siRNA sense strand
gcaccguucgcacggguucug

SEQ ID NO: 20950 - RNA, 21 nt, Artificial Sequence
  Marburg virus siRNA sense strand
caccguucgcacggguucuga

SEQ ID NO: 20951 - RNA, 21 nt, Artificial Sequence
  Marburg virus siRNA sense strand
accguucgcacggguucugaa

SEQ ID NO: 20952 - RNA, 21 nt, Artificial Sequence
  Marburg virus siRNA sense strand
ccguucgcacggguucugaau

SEQ ID NO: 20953 - RNA, 21 nt, Artificial Sequence
  Marburg virus siRNA sense strand
cguucgcacggguucugaauu

SEQ ID NO: 20954 - RNA, 21 nt, Artificial Sequence
  Marburg virus siRNA sense strand
guucgcacggguucugaauuu

SEQ ID NO: 20955 - RNA, 21 nt, Artificial Sequence
  Marburg virus siRNA sense strand
uucgcacggguucugaauuua

SEQ ID NO: 20956 - RNA, 21 nt, Artificial Sequence
  Marburg virus siRNA sense strand
ucgcacggguucugaauuuau

SEQ ID NO: 20957 - RNA, 21 nt, Artificial Sequence
  Marburg virus siRNA sense strand
cgcacggguucugaauuuauc

SEQ ID NO: 20958 - RNA, 21 nt, Artificial Sequence
  Marburg virus siRNA sense strand
gcacggguucugaauuuauca

SEQ ID NO: 20959 - RNA, 21 nt, Artificial Sequence
  Marburg virus siRNA sense strand
cacggguucugaauuuaucag

SEQ ID NO: 20960 - RNA, 21 nt, Artificial Sequence
  Marburg virus siRNA sense strand
acggguucugaauuuaucagg

SEQ ID NO: 20961 - RNA, 21 nt, Artificial Sequence
  Marburg virus siRNA sense strand
cggguucugaauuuaucaggg

SEQ ID NO: 20962 - RNA, 21 nt, Artificial Sequence
  Marburg virus siRNA sense strand
ggguucugaauuuaucaggga

SEQ ID NO: 20963 - RNA, 21 nt, Artificial Sequence
  Marburg virus siRNA sense strand
gguucugaauuuaucagggau

SEQ ID NO: 20964 - RNA, 21 nt, Artificial Sequence
  Marburg virus siRNA sense strand
guucugaauuuaucagggauu

SEQ ID NO: 20965 - RNA, 21 nt, Artificial Sequence
  Marburg virus siRNA sense strand
uucugaauuuaucagggauua

SEQ ID NO: 20966 - RNA, 21 nt, Artificial Sequence
  Marburg virus siRNA sense strand
ucugaauuuaucagggauuaa

SEQ ID NO: 20967 - RNA, 21 nt, Artificial Sequence
  Marburg virus siRNA sense strand
cugaauuuaucagggauuaac

SEQ ID NO: 20968 - RNA, 21 nt, Artificial Sequence
  Marburg virus siRNA sense strand
ugaauuuaucagggauuaaca

SEQ ID NO: 20969 - RNA, 21 nt, Artificial Sequence
  Marburg virus siRNA sense strand
gaauuuaucagggauuaacaa

SEQ ID NO: 20970 - RNA, 21 nt, Artificial Sequence
  Marburg virus siRNA sense strand
aauuuaucagggauuaacaac

SEQ ID NO: 20971 - RNA, 21 nt, Artificial Sequence
  Marburg virus siRNA sense strand
auuuaucagggauuaacaacc

SEQ ID NO: 20972 - RNA, 21 nt, Artificial Sequence
  Marburg virus siRNA sense strand
uuuaucagggauuaacaaccu

SEQ ID NO: 20973 - RNA, 21 nt, Artificial Sequence
  Marburg virus siRNA sense strand
uuaucagggauuaacaaccuc

SEQ ID NO: 20974 - RNA, 21 nt, Artificial Sequence
  Marburg virus siRNA sense strand
uaucagggauuaacaaccucg

SEQ ID NO: 20975 - RNA, 21 nt, Artificial Sequence
  Marburg virus siRNA sense strand
aucagggauuaacaaccucga

SEQ ID NO: 20976 - RNA, 21 nt, Artificial Sequence
  Marburg virus siRNA sense strand
ucagggauuaacaaccucgaa

SEQ ID NO: 20977 - RNA, 21 nt, Artificial Sequence
  Marburg virus siRNA sense strand
cagggauuaacaaccucgaac

SEQ ID NO: 20978 - RNA, 21 nt, Artificial Sequence
  Marburg virus siRNA sense strand
agggauuaacaaccucgaaca

SEQ ID NO: 20979 - RNA, 21 nt, Artificial Sequence
  Marburg virus siRNA sense strand
gggauuaacaaccucgaacau

SEQ ID NO: 20980 - RNA, 21 nt, Artificial Sequence
  Marburg virus siRNA sense strand
ggauuaacaaccucgaacaug

SEQ ID NO: 20981 - RNA, 21 nt, Artificial Sequence
  Marburg virus siRNA sense strand
gauuaacaaccucgaacaugg

SEQ ID NO: 20982 - RNA, 21 nt, Artificial Sequence
  Marburg virus siRNA sense strand
auuaacaaccucgaacaugga

SEQ ID NO: 20983 - RNA, 21 nt, Artificial Sequence
  Marburg virus siRNA sense strand
uuaacaaccucgaacauggac

SEQ ID NO: 20984 - RNA, 21 nt, Artificial Sequence
  Marburg virus siRNA sense strand
uaacaaccucgaacauggacu

SEQ ID NO: 20985 - RNA, 21 nt, Artificial Sequence
  Marburg virus siRNA sense strand
aacaaccucgaacauggacuc

SEQ ID NO: 20986 - RNA, 21 nt, Artificial Sequence
  Marburg virus siRNA sense strand
acaaccucgaacauggacucu

SEQ ID NO: 20987 - RNA, 21 nt, Artificial Sequence
  Marburg virus siRNA sense strand
caaccucgaacauggacucua

SEQ ID NO: 20988 - RNA, 21 nt, Artificial Sequence
  Marburg virus siRNA sense strand
aaccucgaacauggacucuau

SEQ ID NO: 20989 - RNA, 21 nt, Artificial Sequence
  Marburg virus siRNA sense strand
accucgaacauggacucuauc

SEQ ID NO: 20990 - RNA, 21 nt, Artificial Sequence
  Marburg virus siRNA sense strand
ccucgaacauggacucuaucc

SEQ ID NO: 20991 - RNA, 21 nt, Artificial Sequence
  Marburg virus siRNA sense strand
cucgaacauggacucuauccu

SEQ ID NO: 20992 - RNA, 21 nt, Artificial Sequence
  Marburg virus siRNA sense strand
ucgaacauggacucuauccuc

SEQ ID NO: 20993 - RNA, 21 nt, Artificial Sequence
  Marburg virus siRNA sense strand
cgaacauggacucuauccuca

SEQ ID NO: 20994 - RNA, 21 nt, Artificial Sequence
  Marburg virus siRNA sense strand
gaacauggacucuauccucag

SEQ ID NO: 20995 - RNA, 21 nt, Artificial Sequence
  Marburg virus siRNA sense strand
aacauggacucuauccucagc

SEQ ID NO: 20996 - RNA, 21 nt, Artificial Sequence
  Marburg virus siRNA sense strand
acauggacucuauccucagcu

SEQ ID NO: 20997 - RNA, 21 nt, Artificial Sequence
  Marburg virus siRNA sense strand
cauggacucuauccucagcuu

SEQ ID NO: 20998 - RNA, 21 nt, Artificial Sequence
  Marburg virus siRNA sense strand
auggacucuauccucagcuuu

SEQ ID NO: 20999 - RNA, 21 nt, Artificial Sequence
  Marburg virus siRNA sense strand
uggacucuauccucagcuuuc

SEQ ID NO: 21000 - RNA, 21 nt, Artificial Sequence
  Marburg virus siRNA sense strand
ggacucuauccucagcuuucg

SEQ ID NO: 21001 - RNA, 21 nt, Artificial Sequence
  Marburg virus siRNA sense strand
gacucuauccucagcuuucgg

SEQ ID NO: 21002 - RNA, 21 nt, Artificial Sequence
  Marburg virus siRNA sense strand
acucuauccucagcuuucggc

SEQ ID NO: 21003 - RNA, 21 nt, Artificial Sequence
  Marburg virus siRNA sense strand
cucuauccucagcuuucggcg

SEQ ID NO: 21004 - RNA, 21 nt, Artificial Sequence
  Marburg virus siRNA sense strand
ucuauccucagcuuucggcga

SEQ ID NO: 21005 - RNA, 21 nt, Artificial Sequence
  Marburg virus siRNA sense strand
cuauccucagcuuucggcgau

SEQ ID NO: 21006 - RNA, 21 nt, Artificial Sequence
  Marburg virus siRNA sense strand
uauccucagcuuucggcgauu

SEQ ID NO: 21007 - RNA, 21 nt, Artificial Sequence
  Marburg virus siRNA sense strand
auccucagcuuucggcgauug

SEQ ID NO: 21008 - RNA, 21 nt, Artificial Sequence
  Marburg virus siRNA sense strand
uccucagcuuucggcgauugc

SEQ ID NO: 21009 - RNA, 21 nt, Artificial Sequence
  Marburg virus siRNA sense strand
ccucagcuuucggcgauugcg

SEQ ID NO: 21010 - RNA, 21 nt, Artificial Sequence
  Marburg virus siRNA sense strand
cucagcuuucggcgauugcgc

SEQ ID NO: 21011 - RNA, 21 nt, Artificial Sequence
  Marburg virus siRNA sense strand
ucagcuuucggcgauugcgcu

SEQ ID NO: 21012 - RNA, 21 nt, Artificial Sequence
  Marburg virus siRNA sense strand
cagcuuucggcgauugcgcug

SEQ ID NO: 21013 - RNA, 21 nt, Artificial Sequence
  Marburg virus siRNA sense strand
agcuuucggcgauugcgcugg

SEQ ID NO: 21014 - RNA, 21 nt, Artificial Sequence
  Marburg virus siRNA sense strand
gcuuucggcgauugcgcuggg

SEQ ID NO: 21015 - RNA, 21 nt, Artificial Sequence
  Marburg virus siRNA sense strand
cuuucggcgauugcgcugggu

SEQ ID NO: 21016 - RNA, 21 nt, Artificial Sequence
  Marburg virus siRNA sense strand
uuucggcgauugcgcugggug

SEQ ID NO: 21017 - RNA, 21 nt, Artificial Sequence
  Marburg virus siRNA sense strand
uucggcgauugcgcugggugu

SEQ ID NO: 21018 - RNA, 21 nt, Artificial Sequence
  Marburg virus siRNA sense strand
ucggcgauugcgcuggguguu

SEQ ID NO: 21019 - RNA, 21 nt, Artificial Sequence
  Marburg virus siRNA sense strand
cggcgauugcgcuggguguug

SEQ ID NO: 21020 - RNA, 21 nt, Artificial Sequence
  Marburg virus siRNA sense strand
ggcgauugcgcuggguguugc

SEQ ID NO: 21021 - RNA, 21 nt, Artificial Sequence
  Marburg virus siRNA sense strand
gcgauugcgcuggguguugca

SEQ ID NO: 21022 - RNA, 21 nt, Artificial Sequence
  Marburg virus siRNA sense strand
cgauugcgcuggguguugcaa

SEQ ID NO: 21023 - RNA, 21 nt, Artificial Sequence
  Marburg virus siRNA sense strand
gauugcgcuggguguugcaac

SEQ ID NO: 21024 - RNA, 21 nt, Artificial Sequence
  Marburg virus siRNA sense strand
auugcgcuggguguugcaaca

SEQ ID NO: 21025 - RNA, 21 nt, Artificial Sequence
  Marburg virus siRNA sense strand
uugcgcuggguguugcaacag

SEQ ID NO: 21026 - RNA, 21 nt, Artificial Sequence
  Marburg virus siRNA sense strand
ugcgcuggguguugcaacagc

SEQ ID NO: 21027 - RNA, 21 nt, Artificial Sequence
  Marburg virus siRNA sense strand
gcgcuggguguugcaacagca

SEQ ID NO: 21028 - RNA, 21 nt, Artificial Sequence
  Marburg virus siRNA sense strand
cgcuggguguugcaacagcac

SEQ ID NO: 21029 - RNA, 21 nt, Artificial Sequence
  Marburg virus siRNA sense strand
gcuggguguugcaacagcaca

SEQ ID NO: 21030 - RNA, 21 nt, Artificial Sequence
  Marburg virus siRNA sense strand
cuggguguugcaacagcacac

SEQ ID NO: 21031 - RNA, 21 nt, Artificial Sequence
  Marburg virus siRNA sense strand
uggguguugcaacagcacacg

SEQ ID NO: 21032 - RNA, 21 nt, Artificial Sequence
  Marburg virus siRNA sense strand
ggguguugcaacagcacacgg

SEQ ID NO: 21033 - RNA, 21 nt, Artificial Sequence
  Marburg virus siRNA sense strand
gguguugcaacagcacacggc

SEQ ID NO: 21034 - RNA, 21 nt, Artificial Sequence
  Marburg virus siRNA sense strand
guguugcaacagcacacggca

SEQ ID NO: 21035 - RNA, 21 nt, Artificial Sequence
  Marburg virus siRNA sense strand
uguugcaacagcacacggcag

SEQ ID NO: 21036 - RNA, 21 nt, Artificial Sequence
  Marburg virus siRNA sense strand
guugcaacagcacacggcagu

SEQ ID NO: 21037 - RNA, 21 nt, Artificial Sequence
  Marburg virus siRNA sense strand
uugcaacagcacacggcagua

SEQ ID NO: 21038 - RNA, 21 nt, Artificial Sequence
  Marburg virus siRNA sense strand
ugcaacagcacacggcaguac

SEQ ID NO: 21039 - RNA, 21 nt, Artificial Sequence
  Marburg virus siRNA sense strand
gcaacagcacacggcaguaca

SEQ ID NO: 21040 - RNA, 21 nt, Artificial Sequence
  Marburg virus siRNA sense strand
caacagcacacggcaguacau

SEQ ID NO: 21041 - RNA, 21 nt, Artificial Sequence
  Marburg virus siRNA sense strand
aacagcacacggcaguacauu

SEQ ID NO: 21042 - RNA, 21 nt, Artificial Sequence
  Marburg virus siRNA sense strand
acagcacacggcaguacauug

SEQ ID NO: 21043 - RNA, 21 nt, Artificial Sequence
  Marburg virus siRNA sense strand
cagcacacggcaguacauugg

SEQ ID NO: 21044 - RNA, 21 nt, Artificial Sequence
  Marburg virus siRNA sense strand
agcacacggcaguacauuggc

SEQ ID NO: 21045 - RNA, 21 nt, Artificial Sequence
  Marburg virus siRNA sense strand
gcacacggcaguacauuggcu

SEQ ID NO: 21046 - RNA, 21 nt, Artificial Sequence
  Marburg virus siRNA sense strand
cacacggcaguacauuggcug

SEQ ID NO: 21047 - RNA, 21 nt, Artificial Sequence
  Marburg virus siRNA sense strand
acacggcaguacauuggcugg

SEQ ID NO: 21048 - RNA, 21 nt, Artificial Sequence
  Marburg virus siRNA sense strand
cacggcaguacauuggcuggu

SEQ ID NO: 21049 - RNA, 21 nt, Artificial Sequence
  Marburg virus siRNA sense strand
acggcaguacauuggcuggug

SEQ ID NO: 21050 - RNA, 21 nt, Artificial Sequence
  Marburg virus siRNA sense strand
cggcaguacauuggcuggugu

SEQ ID NO: 21051 - RNA, 21 nt, Artificial Sequence
  Marburg virus siRNA sense strand
ggcaguacauuggcugguguc

SEQ ID NO: 21052 - RNA, 21 nt, Artificial Sequence
  Marburg virus siRNA sense strand
gcaguacauuggcugguguca

SEQ ID NO: 21053 - RNA, 21 nt, Artificial Sequence
  Marburg virus siRNA sense strand
caguacauuggcuggugucaa

SEQ ID NO: 21054 - RNA, 21 nt, Artificial Sequence
  Marburg virus siRNA sense strand
aguacauuggcuggugucaau

SEQ ID NO: 21055 - RNA, 21 nt, Artificial Sequence
  Marburg virus siRNA sense strand
guacauuggcuggugucaaug

SEQ ID NO: 21056 - RNA, 21 nt, Artificial Sequence
  Marburg virus siRNA sense strand
uacauuggcuggugucaaugu

SEQ ID NO: 21057 - RNA, 21 nt, Artificial Sequence
  Marburg virus siRNA sense strand
acauuggcuggugucaauguu

SEQ ID NO: 21058 - RNA, 21 nt, Artificial Sequence
  Marburg virus siRNA sense strand
cauuggcuggugucaauguug

SEQ ID NO: 21059 - RNA, 21 nt, Artificial Sequence
  Marburg virus siRNA sense strand
auuggcuggugucaauguugg

SEQ ID NO: 21060 - RNA, 21 nt, Artificial Sequence
  Marburg virus siRNA sense strand
uuggcuggugucaauguuggc

SEQ ID NO: 21061 - RNA, 21 nt, Artificial Sequence
  Marburg virus siRNA sense strand
uggcuggugucaauguuggcg

SEQ ID NO: 21062 - RNA, 21 nt, Artificial Sequence
  Marburg virus siRNA sense strand
ggcuggugucaauguuggcga

SEQ ID NO: 21063 - RNA, 21 nt, Artificial Sequence
  Marburg virus siRNA sense strand
gcuggugucaauguuggcgaa

SEQ ID NO: 21064 - RNA, 21 nt, Artificial Sequence
  Marburg virus siRNA sense strand
cuggugucaauguuggcgaac

SEQ ID NO: 21065 - RNA, 21 nt, Artificial Sequence
  Marburg virus siRNA sense strand
uggugucaauguuggcgaaca

SEQ ID NO: 21066 - RNA, 21 nt, Artificial Sequence
  Marburg virus siRNA sense strand
ggugucaauguuggcgaacag

SEQ ID NO: 21067 - RNA, 21 nt, Artificial Sequence
  Marburg virus siRNA sense strand
gugucaauguuggcgaacagu

SEQ ID NO: 21068 - RNA, 21 nt, Artificial Sequence
  Marburg virus siRNA sense strand
ugucaauguuggcgaacagua

SEQ ID NO: 21069 - RNA, 21 nt, Artificial Sequence
  Marburg virus siRNA sense strand
gucaauguuggcgaacaguau

SEQ ID NO: 21070 - RNA, 21 nt, Artificial Sequence
  Marburg virus siRNA sense strand
ucaauguuggcgaacaguauc

SEQ ID NO: 21071 - RNA, 21 nt, Artificial Sequence
  Marburg virus siRNA sense strand
caauguuggcgaacaguauca

SEQ ID NO: 21072 - RNA, 21 nt, Artificial Sequence
  Marburg virus siRNA sense strand
aauguuggcgaacaguaucaa

SEQ ID NO: 21073 - RNA, 21 nt, Artificial Sequence
  Marburg virus siRNA sense strand
auguuggcgaacaguaucaac

SEQ ID NO: 21074 - RNA, 21 nt, Artificial Sequence
  Marburg virus siRNA sense strand
uguuggcgaacaguaucaaca

SEQ ID NO: 21075 - RNA, 21 nt, Artificial Sequence
  Marburg virus siRNA sense strand
guuggcgaacaguaucaacag

SEQ ID NO: 21076 - RNA, 21 nt, Artificial Sequence
  Marburg virus siRNA sense strand
uuggcgaacaguaucaacagc

SEQ ID NO: 21077 - RNA, 21 nt, Artificial Sequence
  Marburg virus siRNA sense strand
uggcgaacaguaucaacagcu

SEQ ID NO: 21078 - RNA, 21 nt, Artificial Sequence
  Marburg virus siRNA sense strand
ggcgaacaguaucaacagcua

SEQ ID NO: 21079 - RNA, 21 nt, Artificial Sequence
  Marburg virus siRNA sense strand
gcgaacaguaucaacagcuac

SEQ ID NO: 21080 - RNA, 21 nt, Artificial Sequence
  Marburg virus siRNA sense strand
cgaacaguaucaacagcuacg

SEQ ID NO: 21081 - RNA, 21 nt, Artificial Sequence
  Marburg virus siRNA sense strand
gaacaguaucaacagcuacga

SEQ ID NO: 21082 - RNA, 21 nt, Artificial Sequence
  Marburg virus siRNA sense strand
aacaguaucaacagcuacgag

SEQ ID NO: 21083 - RNA, 21 nt, Artificial Sequence
  Marburg virus siRNA sense strand
acaguaucaacagcuacgaga

SEQ ID NO: 21084 - RNA, 21 nt, Artificial Sequence
  Marburg virus siRNA sense strand
caguaucaacagcuacgagag

SEQ ID NO: 21085 - RNA, 21 nt, Artificial Sequence
  Marburg virus siRNA sense strand
aguaucaacagcuacgagagg

SEQ ID NO: 21086 - RNA, 21 nt, Artificial Sequence
  Marburg virus siRNA sense strand
guaucaacagcuacgagaggc

SEQ ID NO: 21087 - RNA, 21 nt, Artificial Sequence
  Marburg virus siRNA sense strand
uaucaacagcuacgagaggcg

SEQ ID NO: 21088 - RNA, 21 nt, Artificial Sequence
  Marburg virus siRNA sense strand
aucaacagcuacgagaggcgg

SEQ ID NO: 21089 - RNA, 21 nt, Artificial Sequence
  Marburg virus siRNA sense strand
ucaacagcuacgagaggcggc

SEQ ID NO: 21090 - RNA, 21 nt, Artificial Sequence
  Marburg virus siRNA sense strand
caacagcuacgagaggcggca

SEQ ID NO: 21091 - RNA, 21 nt, Artificial Sequence
  Marburg virus siRNA sense strand
aacagcuacgagaggcggcac

SEQ ID NO: 21092 - RNA, 21 nt, Artificial Sequence
  Marburg virus siRNA sense strand
acagcuacgagaggcggcaca

SEQ ID NO: 21093 - RNA, 21 nt, Artificial Sequence
  Marburg virus siRNA sense strand
cagcuacgagaggcggcacau

SEQ ID NO: 21094 - RNA, 21 nt, Artificial Sequence
  Marburg virus siRNA sense strand
agcuacgagaggcggcacaug

SEQ ID NO: 21095 - RNA, 21 nt, Artificial Sequence
  Marburg virus siRNA sense strand
gcuacgagaggcggcacauga

SEQ ID NO: 21096 - RNA, 21 nt, Artificial Sequence
  Marburg virus siRNA sense strand
cuacgagaggcggcacaugau

SEQ ID NO: 21097 - RNA, 21 nt, Artificial Sequence
  Marburg virus siRNA sense strand
uacgagaggcggcacaugaug

SEQ ID NO: 21098 - RNA, 21 nt, Artificial Sequence
  Marburg virus siRNA sense strand
acgagaggcggcacaugaugc

SEQ ID NO: 21099 - RNA, 21 nt, Artificial Sequence
  Marburg virus siRNA sense strand
cgagaggcggcacaugaugcg

SEQ ID NO: 21100 - RNA, 21 nt, Artificial Sequence
  Marburg virus siRNA sense strand
gagaggcggcacaugaugcgg

SEQ ID NO: 21101 - RNA, 21 nt, Artificial Sequence
  Marburg virus siRNA sense strand
agaggcggcacaugaugcgga

SEQ ID NO: 21102 - RNA, 21 nt, Artificial Sequence
  Marburg virus siRNA sense strand
gaggcggcacaugaugcggaa

SEQ ID NO: 21103 - RNA, 21 nt, Artificial Sequence
  Marburg virus siRNA sense strand
aggcggcacaugaugcggaaa

SEQ ID NO: 21104 - RNA, 21 nt, Artificial Sequence
  Marburg virus siRNA sense strand
ggcggcacaugaugcggaaau

SEQ ID NO: 21105 - RNA, 21 nt, Artificial Sequence
  Marburg virus siRNA sense strand
gcggcacaugaugcggaaaua

SEQ ID NO: 21106 - RNA, 21 nt, Artificial Sequence
  Marburg virus siRNA sense strand
cggcacaugaugcggaaauaa

SEQ ID NO: 21107 - RNA, 21 nt, Artificial Sequence
  Marburg virus siRNA sense strand
ggcacaugaugcggaaauaaa

SEQ ID NO: 21108 - RNA, 21 nt, Artificial Sequence
  Marburg virus siRNA sense strand
gcacaugaugcggaaauaaaa

SEQ ID NO: 21109 - RNA, 21 nt, Artificial Sequence
  Marburg virus siRNA sense strand
cacaugaugcggaaauaaaac

SEQ ID NO: 21110 - RNA, 21 nt, Artificial Sequence
  Marburg virus siRNA sense strand
acaugaugcggaaauaaaacu

SEQ ID NO: 21111 - RNA, 21 nt, Artificial Sequence
  Marburg virus siRNA sense strand
caugaugcggaaauaaaacua

SEQ ID NO: 21112 - RNA, 21 nt, Artificial Sequence
  Marburg virus siRNA sense strand
augaugcggaaauaaaacuac

SEQ ID NO: 21113 - RNA, 21 nt, Artificial Sequence
  Marburg virus siRNA sense strand
ugaugcggaaauaaaacuaca

SEQ ID NO: 21114 - RNA, 21 nt, Artificial Sequence
  Marburg virus siRNA sense strand
gaugcggaaauaaaacuacaa

SEQ ID NO: 21115 - RNA, 21 nt, Artificial Sequence
  Marburg virus siRNA sense strand
augcggaaauaaaacuacaaa

SEQ ID NO: 21116 - RNA, 21 nt, Artificial Sequence
  Marburg virus siRNA sense strand
ugcggaaauaaaacuacaaag

SEQ ID NO: 21117 - RNA, 21 nt, Artificial Sequence
  Marburg virus siRNA sense strand
gcggaaauaaaacuacaaagg

SEQ ID NO: 21118 - RNA, 21 nt, Artificial Sequence
  Marburg virus siRNA sense strand
cggaaauaaaacuacaaaggc

SEQ ID NO: 21119 - RNA, 21 nt, Artificial Sequence
  Marburg virus siRNA sense strand
ggaaauaaaacuacaaaggcg

SEQ ID NO: 21120 - RNA, 21 nt, Artificial Sequence
  Marburg virus siRNA sense strand
gaaauaaaacuacaaaggcga

SEQ ID NO: 21121 - RNA, 21 nt, Artificial Sequence
  Marburg virus siRNA sense strand
aaauaaaacuacaaaggcgac

SEQ ID NO: 21122 - RNA, 21 nt, Artificial Sequence
  Marburg virus siRNA sense strand
aauaaaacuacaaaggcgaca

SEQ ID NO: 21123 - RNA, 21 nt, Artificial Sequence
  Marburg virus siRNA sense strand
auaaaacuacaaaggcgacau

SEQ ID NO: 21124 - RNA, 21 nt, Artificial Sequence
  Marburg virus siRNA sense strand
uaaaacuacaaaggcgacaug

SEQ ID NO: 21125 - RNA, 21 nt, Artificial Sequence
  Marburg virus siRNA sense strand
aaaacuacaaaggcgacauga

SEQ ID NO: 21126 - RNA, 21 nt, Artificial Sequence
  Marburg virus siRNA sense strand
aaacuacaaaggcgacaugaa

SEQ ID NO: 21127 - RNA, 21 nt, Artificial Sequence
  Marburg virus siRNA sense strand
aacuacaaaggcgacaugaac

SEQ ID NO: 21128 - RNA, 21 nt, Artificial Sequence
  Marburg virus siRNA sense strand
acuacaaaggcgacaugaaca

SEQ ID NO: 21129 - RNA, 21 nt, Artificial Sequence
  Marburg virus siRNA sense strand
cuacaaaggcgacaugaacau

SEQ ID NO: 21130 - RNA, 21 nt, Artificial Sequence
  Marburg virus siRNA sense strand
uacaaaggcgacaugaacauc

SEQ ID NO: 21131 - RNA, 21 nt, Artificial Sequence
  Marburg virus siRNA sense strand
acaaaggcgacaugaacauca

SEQ ID NO: 21132 - RNA, 21 nt, Artificial Sequence
  Marburg virus siRNA sense strand
caaaggcgacaugaacaucag

SEQ ID NO: 21133 - RNA, 21 nt, Artificial Sequence
  Marburg virus siRNA sense strand
aaaggcgacaugaacaucagg

SEQ ID NO: 21134 - RNA, 21 nt, Artificial Sequence
  Marburg virus siRNA sense strand
aaggcgacaugaacaucagga

SEQ ID NO: 21135 - RNA, 21 nt, Artificial Sequence
  Marburg virus siRNA sense strand
aggcgacaugaacaucaggaa

SEQ ID NO: 21136 - RNA, 21 nt, Artificial Sequence
  Marburg virus siRNA sense strand
ggcgacaugaacaucaggaaa

SEQ ID NO: 21137 - RNA, 21 nt, Artificial Sequence
  Marburg virus siRNA sense strand
gcgacaugaacaucaggaaau

SEQ ID NO: 21138 - RNA, 21 nt, Artificial Sequence
  Marburg virus siRNA sense strand
cgacaugaacaucaggaaauu

SEQ ID NO: 21139 - RNA, 21 nt, Artificial Sequence
  Marburg virus siRNA sense strand
gacaugaacaucaggaaauuc

SEQ ID NO: 21140 - RNA, 21 nt, Artificial Sequence
  Marburg virus siRNA sense strand
acaugaacaucaggaaauuca

SEQ ID NO: 21141 - RNA, 21 nt, Artificial Sequence
  Marburg virus siRNA sense strand
caugaacaucaggaaauucaa

SEQ ID NO: 21142 - RNA, 21 nt, Artificial Sequence
  Marburg virus siRNA sense strand
augaacaucaggaaauucaag

SEQ ID NO: 21143 - RNA, 21 nt, Artificial Sequence
  Marburg virus siRNA sense strand
ugaacaucaggaaauucaagc

SEQ ID NO: 21144 - RNA, 21 nt, Artificial Sequence
  Marburg virus siRNA sense strand
gaacaucaggaaauucaagcu

SEQ ID NO: 21145 - RNA, 21 nt, Artificial Sequence
  Marburg virus siRNA sense strand
aacaucaggaaauucaagcua

SEQ ID NO: 21146 - RNA, 21 nt, Artificial Sequence
  Marburg virus siRNA sense strand
acaucaggaaauucaagcuau

SEQ ID NO: 21147 - RNA, 21 nt, Artificial Sequence
  Marburg virus siRNA sense strand
caucaggaaauucaagcuauu

SEQ ID NO: 21148 - RNA, 21 nt, Artificial Sequence
  Marburg virus siRNA sense strand
aucaggaaauucaagcuauug

SEQ ID NO: 21149 - RNA, 21 nt, Artificial Sequence
  Marburg virus siRNA sense strand
ucaggaaauucaagcuauugc

SEQ ID NO: 21150 - RNA, 21 nt, Artificial Sequence
  Marburg virus siRNA sense strand
caggaaauucaagcuauugca

SEQ ID NO: 21151 - RNA, 21 nt, Artificial Sequence
  Marburg virus siRNA sense strand
aggaaauucaagcuauugcag

SEQ ID NO: 21152 - RNA, 21 nt, Artificial Sequence
  Marburg virus siRNA sense strand
ggaaauucaagcuauugcaga

SEQ ID NO: 21153 - RNA, 21 nt, Artificial Sequence
  Marburg virus siRNA sense strand
gaaauucaagcuauugcagag

SEQ ID NO: 21154 - RNA, 21 nt, Artificial Sequence
  Marburg virus siRNA sense strand
aaauucaagcuauugcagagg

SEQ ID NO: 21155 - RNA, 21 nt, Artificial Sequence
  Marburg virus siRNA sense strand
aauucaagcuauugcagagga

SEQ ID NO: 21156 - RNA, 21 nt, Artificial Sequence
  Marburg virus siRNA sense strand
auucaagcuauugcagaggau

SEQ ID NO: 21157 - RNA, 21 nt, Artificial Sequence
  Marburg virus siRNA sense strand
uucaagcuauugcagaggaug

SEQ ID NO: 21158 - RNA, 21 nt, Artificial Sequence
  Marburg virus siRNA sense strand
ucaagcuauugcagaggauga

SEQ ID NO: 21159 - RNA, 21 nt, Artificial Sequence
  Marburg virus siRNA sense strand
caagcuauugcagaggaugau

SEQ ID NO: 21160 - RNA, 21 nt, Artificial Sequence
  Marburg virus siRNA sense strand
aagcuauugcagaggaugaug

SEQ ID NO: 21161 - RNA, 21 nt, Artificial Sequence
  Marburg virus siRNA sense strand
agcuauugcagaggaugauga

SEQ ID NO: 21162 - RNA, 21 nt, Artificial Sequence
  Marburg virus siRNA sense strand
gcuauugcagaggaugaugag

SEQ ID NO: 21163 - RNA, 21 nt, Artificial Sequence
  Marburg virus siRNA sense strand
cuauugcagaggaugaugagg

SEQ ID NO: 21164 - RNA, 21 nt, Artificial Sequence
  Marburg virus siRNA sense strand
uauugcagaggaugaugagga

SEQ ID NO: 21165 - RNA, 21 nt, Artificial Sequence
  Marburg virus siRNA sense strand
auugcagaggaugaugaggag

SEQ ID NO: 21166 - RNA, 21 nt, Artificial Sequence
  Marburg virus siRNA sense strand
uugcagaggaugaugaggaga

SEQ ID NO: 21167 - RNA, 21 nt, Artificial Sequence
  Marburg virus siRNA sense strand
ugcagaggaugaugaggagag

SEQ ID NO: 21168 - RNA, 21 nt, Artificial Sequence
  Marburg virus siRNA sense strand
gcagaggaugaugaggagagg

SEQ ID NO: 21169 - RNA, 21 nt, Artificial Sequence
  Marburg virus siRNA sense strand
cagaggaugaugaggagagga

SEQ ID NO: 21170 - RNA, 21 nt, Artificial Sequence
  Marburg virus siRNA sense strand
agaggaugaugaggagaggaa

SEQ ID NO: 21171 - RNA, 21 nt, Artificial Sequence
  Marburg virus siRNA sense strand
gaggaugaugaggagaggaag

SEQ ID NO: 21172 - RNA, 21 nt, Artificial Sequence
  Marburg virus siRNA sense strand
aggaugaugaggagaggaaga

SEQ ID NO: 21173 - RNA, 21 nt, Artificial Sequence
  Marburg virus siRNA sense strand
ggaugaugaggagaggaagau

SEQ ID NO: 21174 - RNA, 21 nt, Artificial Sequence
  Marburg virus siRNA sense strand
gaugaugaggagaggaagaua

SEQ ID NO: 21175 - RNA, 21 nt, Artificial Sequence
  Marburg virus siRNA sense strand
augaugaggagaggaagauau

SEQ ID NO: 21176 - RNA, 21 nt, Artificial Sequence
  Marburg virus siRNA sense strand
ugaugaggagaggaagauauu

SEQ ID NO: 21177 - RNA, 21 nt, Artificial Sequence
  Marburg virus siRNA sense strand
gaugaggagaggaagauauua

SEQ ID NO: 21178 - RNA, 21 nt, Artificial Sequence
  Marburg virus siRNA sense strand
augaggagaggaagauauuag

SEQ ID NO: 21179 - RNA, 21 nt, Artificial Sequence
  Marburg virus siRNA sense strand
ugaggagaggaagauauuaga

SEQ ID NO: 21180 - RNA, 21 nt, Artificial Sequence
  Marburg virus siRNA sense strand
gaggagaggaagauauuagaa

SEQ ID NO: 21181 - RNA, 21 nt, Artificial Sequence
  Marburg virus siRNA sense strand
aggagaggaagauauuagaac

SEQ ID NO: 21182 - RNA, 21 nt, Artificial Sequence
  Marburg virus siRNA sense strand
ggagaggaagauauuagaaca

SEQ ID NO: 21183 - RNA, 21 nt, Artificial Sequence
  Marburg virus siRNA sense strand
gagaggaagauauuagaacaa

SEQ ID NO: 21184 - RNA, 21 nt, Artificial Sequence
  Marburg virus siRNA sense strand
agaggaagauauuagaacaau

SEQ ID NO: 21185 - RNA, 21 nt, Artificial Sequence
  Marburg virus siRNA sense strand
gaggaagauauuagaacaauu

SEQ ID NO: 21186 - RNA, 21 nt, Artificial Sequence
  Marburg virus siRNA sense strand
aggaagauauuagaacaauuc

SEQ ID NO: 21187 - RNA, 21 nt, Artificial Sequence
  Marburg virus siRNA sense strand
ggaagauauuagaacaauucc

SEQ ID NO: 21188 - RNA, 21 nt, Artificial Sequence
  Marburg virus siRNA sense strand
gaagauauuagaacaauucca

SEQ ID NO: 21189 - RNA, 21 nt, Artificial Sequence
  Marburg virus siRNA sense strand
aagauauuagaacaauuccac

SEQ ID NO: 21190 - RNA, 21 nt, Artificial Sequence
  Marburg virus siRNA sense strand
agauauuagaacaauuccacc

SEQ ID NO: 21191 - RNA, 21 nt, Artificial Sequence
  Marburg virus siRNA sense strand
gauauuagaacaauuccaccu

SEQ ID NO: 21192 - RNA, 21 nt, Artificial Sequence
  Marburg virus siRNA sense strand
auauuagaacaauuccaccuu

SEQ ID NO: 21193 - RNA, 21 nt, Artificial Sequence
  Marburg virus siRNA sense strand
uauuagaacaauuccaccuuc

SEQ ID NO: 21194 - RNA, 21 nt, Artificial Sequence
  Marburg virus siRNA sense strand
auuagaacaauuccaccuuca

SEQ ID NO: 21195 - RNA, 21 nt, Artificial Sequence
  Marburg virus siRNA sense strand
uuagaacaauuccaccuucag

SEQ ID NO: 21196 - RNA, 21 nt, Artificial Sequence
  Marburg virus siRNA sense strand
uagaacaauuccaccuucaga

SEQ ID NO: 21197 - RNA, 21 nt, Artificial Sequence
  Marburg virus siRNA sense strand
agaacaauuccaccuucagaa

SEQ ID NO: 21198 - RNA, 21 nt, Artificial Sequence
  Marburg virus siRNA sense strand
gaacaauuccaccuucagaaa

SEQ ID NO: 21199 - RNA, 21 nt, Artificial Sequence
  Marburg virus siRNA sense strand
aacaauuccaccuucagaaaa

SEQ ID NO: 21200 - RNA, 21 nt, Artificial Sequence
  Marburg virus siRNA sense strand
acaauuccaccuucagaaaac

SEQ ID NO: 21201 - RNA, 21 nt, Artificial Sequence
  Marburg virus siRNA sense strand
caauuccaccuucagaaaacu

SEQ ID NO: 21202 - RNA, 21 nt, Artificial Sequence
  Marburg virus siRNA sense strand
aauuccaccuucagaaaacug

SEQ ID NO: 21203 - RNA, 21 nt, Artificial Sequence
  Marburg virus siRNA sense strand
auuccaccuucagaaaacuga

SEQ ID NO: 21204 - RNA, 21 nt, Artificial Sequence
  Marburg virus siRNA sense strand
uuccaccuucagaaaacugaa

SEQ ID NO: 21205 - RNA, 21 nt, Artificial Sequence
  Marburg virus siRNA sense strand
uccaccuucagaaaacugaaa

SEQ ID NO: 21206 - RNA, 21 nt, Artificial Sequence
  Marburg virus siRNA sense strand
ccaccuucagaaaacugaaau

SEQ ID NO: 21207 - RNA, 21 nt, Artificial Sequence
  Marburg virus siRNA sense strand
caccuucagaaaacugaaauc

SEQ ID NO: 21208 - RNA, 21 nt, Artificial Sequence
  Marburg virus siRNA sense strand
accuucagaaaacugaaauca

SEQ ID NO: 21209 - RNA, 21 nt, Artificial Sequence
  Marburg virus siRNA sense strand
ccuucagaaaacugaaaucac

SEQ ID NO: 21210 - RNA, 21 nt, Artificial Sequence
  Marburg virus siRNA sense strand
cuucagaaaacugaaaucaca

SEQ ID NO: 21211 - RNA, 21 nt, Artificial Sequence
  Marburg virus siRNA sense strand
uucagaaaacugaaaucacac

SEQ ID NO: 21212 - RNA, 21 nt, Artificial Sequence
  Marburg virus siRNA sense strand
ucagaaaacugaaaucacaca

SEQ ID NO: 21213 - RNA, 21 nt, Artificial Sequence
  Marburg virus siRNA sense strand
cagaaaacugaaaucacacac

SEQ ID NO: 21214 - RNA, 21 nt, Artificial Sequence
  Marburg virus siRNA sense strand
agaaaacugaaaucacacaca

SEQ ID NO: 21215 - RNA, 21 nt, Artificial Sequence
  Marburg virus siRNA sense strand
gaaaacugaaaucacacacag

SEQ ID NO: 21216 - RNA, 21 nt, Artificial Sequence
  Marburg virus siRNA sense strand
aaaacugaaaucacacacagu

SEQ ID NO: 21217 - RNA, 21 nt, Artificial Sequence
  Marburg virus siRNA sense strand
aaacugaaaucacacacaguc

SEQ ID NO: 21218 - RNA, 21 nt, Artificial Sequence
  Marburg virus siRNA sense strand
aacugaaaucacacacaguca

SEQ ID NO: 21219 - RNA, 21 nt, Artificial Sequence
  Marburg virus siRNA sense strand
acugaaaucacacacagucag

SEQ ID NO: 21220 - RNA, 21 nt, Artificial Sequence
  Marburg virus siRNA sense strand
cugaaaucacacacagucaga

SEQ ID NO: 21221 - RNA, 21 nt, Artificial Sequence
  Marburg virus siRNA sense strand
ugaaaucacacacagucagac

SEQ ID NO: 21222 - RNA, 21 nt, Artificial Sequence
  Marburg virus siRNA sense strand
gaaaucacacacagucagaca

SEQ ID NO: 21223 - RNA, 21 nt, Artificial Sequence
  Marburg virus siRNA sense strand
aaaucacacacagucagacac

SEQ ID NO: 21224 - RNA, 21 nt, Artificial Sequence
  Marburg virus siRNA sense strand
aaucacacacagucagacacu

SEQ ID NO: 21225 - RNA, 21 nt, Artificial Sequence
  Marburg virus siRNA sense strand
aucacacacagucagacacua

SEQ ID NO: 21226 - RNA, 21 nt, Artificial Sequence
  Marburg virus siRNA sense strand
ucacacacagucagacacuag

SEQ ID NO: 21227 - RNA, 21 nt, Artificial Sequence
  Marburg virus siRNA sense strand
cacacacagucagacacuagc

SEQ ID NO: 21228 - RNA, 21 nt, Artificial Sequence
  Marburg virus siRNA sense strand
acacacagucagacacuagcc

SEQ ID NO: 21229 - RNA, 21 nt, Artificial Sequence
  Marburg virus siRNA sense strand
cacacagucagacacuagccg

SEQ ID NO: 21230 - RNA, 21 nt, Artificial Sequence
  Marburg virus siRNA sense strand
acacagucagacacuagccgu

SEQ ID NO: 21231 - RNA, 21 nt, Artificial Sequence
  Marburg virus siRNA sense strand
cacagucagacacuagccguc

SEQ ID NO: 21232 - RNA, 21 nt, Artificial Sequence
  Marburg virus siRNA sense strand
acagucagacacuagccgucc

SEQ ID NO: 21233 - RNA, 21 nt, Artificial Sequence
  Marburg virus siRNA sense strand
cagucagacacuagccguccu

SEQ ID NO: 21234 - RNA, 21 nt, Artificial Sequence
  Marburg virus siRNA sense strand
agucagacacuagccguccuc

SEQ ID NO: 21235 - RNA, 21 nt, Artificial Sequence
  Marburg virus siRNA sense strand
gucagacacuagccguccuca

SEQ ID NO: 21236 - RNA, 21 nt, Artificial Sequence
  Marburg virus siRNA sense strand
ucagacacuagccguccucag

SEQ ID NO: 21237 - RNA, 21 nt, Artificial Sequence
  Marburg virus siRNA sense strand
cagacacuagccguccucagc

SEQ ID NO: 21238 - RNA, 21 nt, Artificial Sequence
  Marburg virus siRNA sense strand
agacacuagccguccucagcc

SEQ ID NO: 21239 - RNA, 21 nt, Artificial Sequence
  Marburg virus siRNA sense strand
gacacuagccguccucagcca

SEQ ID NO: 21240 - RNA, 21 nt, Artificial Sequence
  Marburg virus siRNA sense strand
acacuagccguccucagccag

SEQ ID NO: 21241 - RNA, 21 nt, Artificial Sequence
  Marburg virus siRNA sense strand
cacuagccguccucagccaga

SEQ ID NO: 21242 - RNA, 21 nt, Artificial Sequence
  Marburg virus siRNA sense strand
acuagccguccucagccagaa

SEQ ID NO: 21243 - RNA, 21 nt, Artificial Sequence
  Marburg virus siRNA sense strand
cuagccguccucagccagaaa

SEQ ID NO: 21244 - RNA, 21 nt, Artificial Sequence
  Marburg virus siRNA sense strand
uagccguccucagccagaaac

SEQ ID NO: 21245 - RNA, 21 nt, Artificial Sequence
  Marburg virus siRNA sense strand
agccguccucagccagaaacg

SEQ ID NO: 21246 - RNA, 21 nt, Artificial Sequence
  Marburg virus siRNA sense strand
gccguccucagccagaaacga

SEQ ID NO: 21247 - RNA, 21 nt, Artificial Sequence
  Marburg virus siRNA sense strand
ccguccucagccagaaacgag

SEQ ID NO: 21248 - RNA, 21 nt, Artificial Sequence
  Marburg virus siRNA sense strand
cguccucagccagaaacgaga

SEQ ID NO: 21249 - RNA, 21 nt, Artificial Sequence
  Marburg virus siRNA sense strand
guccucagccagaaacgagaa

SEQ ID NO: 21250 - RNA, 21 nt, Artificial Sequence
  Marburg virus siRNA sense strand
uccucagccagaaacgagaaa

SEQ ID NO: 21251 - RNA, 21 nt, Artificial Sequence
  Marburg virus siRNA sense strand
ccucagccagaaacgagaaaa

SEQ ID NO: 21252 - RNA, 21 nt, Artificial Sequence
  Marburg virus siRNA sense strand
cucagccagaaacgagaaaaa

SEQ ID NO: 21253 - RNA, 21 nt, Artificial Sequence
  Marburg virus siRNA sense strand
ucagccagaaacgagaaaaau

SEQ ID NO: 21254 - RNA, 21 nt, Artificial Sequence
  Marburg virus siRNA sense strand
cagccagaaacgagaaaaauu

SEQ ID NO: 21255 - RNA, 21 nt, Artificial Sequence
  Marburg virus siRNA sense strand
agccagaaacgagaaaaauua

SEQ ID NO: 21256 - RNA, 21 nt, Artificial Sequence
  Marburg virus siRNA sense strand
gccagaaacgagaaaaauuag

SEQ ID NO: 21257 - RNA, 21 nt, Artificial Sequence
  Marburg virus siRNA sense strand
ccagaaacgagaaaaauuagc

SEQ ID NO: 21258 - RNA, 21 nt, Artificial Sequence
  Marburg virus siRNA sense strand
cagaaacgagaaaaauuagcu

SEQ ID NO: 21259 - RNA, 21 nt, Artificial Sequence
  Marburg virus siRNA sense strand
agaaacgagaaaaauuagcuc

SEQ ID NO: 21260 - RNA, 21 nt, Artificial Sequence
  Marburg virus siRNA sense strand
gaaacgagaaaaauuagcucg

SEQ ID NO: 21261 - RNA, 21 nt, Artificial Sequence
  Marburg virus siRNA sense strand
aaacgagaaaaauuagcucgu

SEQ ID NO: 21262 - RNA, 21 nt, Artificial Sequence
  Marburg virus siRNA sense strand
aacgagaaaaauuagcucguc

SEQ ID NO: 21263 - RNA, 21 nt, Artificial Sequence
  Marburg virus siRNA sense strand
acgagaaaaauuagcucgucu

SEQ ID NO: 21264 - RNA, 21 nt, Artificial Sequence
  Marburg virus siRNA sense strand
cgagaaaaauuagcucgucuu

SEQ ID NO: 21265 - RNA, 21 nt, Artificial Sequence
  Marburg virus siRNA sense strand
gagaaaaauuagcucgucuug

SEQ ID NO: 21266 - RNA, 21 nt, Artificial Sequence
  Marburg virus siRNA sense strand
agaaaaauuagcucgucuugc

SEQ ID NO: 21267 - RNA, 21 nt, Artificial Sequence
  Marburg virus siRNA sense strand
gaaaaauuagcucgucuugcu

SEQ ID NO: 21268 - RNA, 21 nt, Artificial Sequence
  Marburg virus siRNA sense strand
aaaaauuagcucgucuugcug

SEQ ID NO: 21269 - RNA, 21 nt, Artificial Sequence
  Marburg virus siRNA sense strand
aaaauuagcucgucuugcugc

SEQ ID NO: 21270 - RNA, 21 nt, Artificial Sequence
  Marburg virus siRNA sense strand
aaauuagcucgucuugcugca

SEQ ID NO: 21271 - RNA, 21 nt, Artificial Sequence
  Marburg virus siRNA sense strand
aauuagcucgucuugcugcag

SEQ ID NO: 21272 - RNA, 21 nt, Artificial Sequence
  Marburg virus siRNA sense strand
auuagcucgucuugcugcaga

SEQ ID NO: 21273 - RNA, 21 nt, Artificial Sequence
  Marburg virus siRNA sense strand
uuagcucgucuugcugcagaa

SEQ ID NO: 21274 - RNA, 21 nt, Artificial Sequence
  Marburg virus siRNA sense strand
uagcucgucuugcugcagaaa

SEQ ID NO: 21275 - RNA, 21 nt, Artificial Sequence
  Marburg virus siRNA sense strand
agcucgucuugcugcagaaau

SEQ ID NO: 21276 - RNA, 21 nt, Artificial Sequence
  Marburg virus siRNA sense strand
gcucgucuugcugcagaaauu

SEQ ID NO: 21277 - RNA, 21 nt, Artificial Sequence
  Marburg virus siRNA sense strand
cucgucuugcugcagaaauug

SEQ ID NO: 21278 - RNA, 21 nt, Artificial Sequence
  Marburg virus siRNA sense strand
ucgucuugcugcagaaauuga

SEQ ID NO: 21279 - RNA, 21 nt, Artificial Sequence
  Marburg virus siRNA sense strand
cgucuugcugcagaaauugaa

SEQ ID NO: 21280 - RNA, 21 nt, Artificial Sequence
  Marburg virus siRNA sense strand
gucuugcugcagaaauugaaa

SEQ ID NO: 21281 - RNA, 21 nt, Artificial Sequence
  Marburg virus siRNA sense strand
ucuugcugcagaaauugaaaa

SEQ ID NO: 21282 - RNA, 21 nt, Artificial Sequence
  Marburg virus siRNA sense strand
cuugcugcagaaauugaaaac

SEQ ID NO: 21283 - RNA, 21 nt, Artificial Sequence
  Marburg virus siRNA sense strand
uugcugcagaaauugaaaaca

SEQ ID NO: 21284 - RNA, 21 nt, Artificial Sequence
  Marburg virus siRNA sense strand
ugcugcagaaauugaaaacaa

SEQ ID NO: 21285 - RNA, 21 nt, Artificial Sequence
  Marburg virus siRNA sense strand
gcugcagaaauugaaaacaau

SEQ ID NO: 21286 - RNA, 21 nt, Artificial Sequence
  Marburg virus siRNA sense strand
cugcagaaauugaaaacaaua

SEQ ID NO: 21287 - RNA, 21 nt, Artificial Sequence
  Marburg virus siRNA sense strand
ugcagaaauugaaaacaauau

SEQ ID NO: 21288 - RNA, 21 nt, Artificial Sequence
  Marburg virus siRNA sense strand
gcagaaauugaaaacaauauu

SEQ ID NO: 21289 - RNA, 21 nt, Artificial Sequence
  Marburg virus siRNA sense strand
cagaaauugaaaacaauauug

SEQ ID NO: 21290 - RNA, 21 nt, Artificial Sequence
  Marburg virus siRNA sense strand
agaaauugaaaacaauauugu

SEQ ID NO: 21291 - RNA, 21 nt, Artificial Sequence
  Marburg virus siRNA sense strand
gaaauugaaaacaauauugug

SEQ ID NO: 21292 - RNA, 21 nt, Artificial Sequence
  Marburg virus siRNA sense strand
aaauugaaaacaauauugugg

SEQ ID NO: 21293 - RNA, 21 nt, Artificial Sequence
  Marburg virus siRNA sense strand
aauugaaaacaauauugugga

SEQ ID NO: 21294 - RNA, 21 nt, Artificial Sequence
  Marburg virus siRNA sense strand
auugaaaacaauauuguggaa

SEQ ID NO: 21295 - RNA, 21 nt, Artificial Sequence
  Marburg virus siRNA sense strand
uugaaaacaauauuguggaag

SEQ ID NO: 21296 - RNA, 21 nt, Artificial Sequence
  Marburg virus siRNA sense strand
ugaaaacaauauuguggaaga

SEQ ID NO: 21297 - RNA, 21 nt, Artificial Sequence
  Marburg virus siRNA sense strand
gaaaacaauauuguggaagau

SEQ ID NO: 21298 - RNA, 21 nt, Artificial Sequence
  Marburg virus siRNA sense strand
aaaacaauauuguggaagauc

SEQ ID NO: 21299 - RNA, 21 nt, Artificial Sequence
  Marburg virus siRNA sense strand
aaacaauauuguggaagauca

SEQ ID NO: 21300 - RNA, 21 nt, Artificial Sequence
  Marburg virus siRNA sense strand
aacaauauuguggaagaucag

SEQ ID NO: 21301 - RNA, 21 nt, Artificial Sequence
  Marburg virus siRNA sense strand
acaauauuguggaagaucagg

SEQ ID NO: 21302 - RNA, 21 nt, Artificial Sequence
  Marburg virus siRNA sense strand
caauauuguggaagaucaggg

SEQ ID NO: 21303 - RNA, 21 nt, Artificial Sequence
  Marburg virus siRNA sense strand
aauauuguggaagaucaggga

SEQ ID NO: 21304 - RNA, 21 nt, Artificial Sequence
  Marburg virus siRNA sense strand
auauuguggaagaucagggau

SEQ ID NO: 21305 - RNA, 21 nt, Artificial Sequence
  Marburg virus siRNA sense strand
uauuguggaagaucagggauu

SEQ ID NO: 21306 - RNA, 21 nt, Artificial Sequence
  Marburg virus siRNA sense strand
auuguggaagaucagggauuu

SEQ ID NO: 21307 - RNA, 21 nt, Artificial Sequence
  Marburg virus siRNA sense strand
uuguggaagaucagggauuua

SEQ ID NO: 21308 - RNA, 21 nt, Artificial Sequence
  Marburg virus siRNA sense strand
uguggaagaucagggauuuaa

SEQ ID NO: 21309 - RNA, 21 nt, Artificial Sequence
  Marburg virus siRNA sense strand
guggaagaucagggauuuaaa

SEQ ID NO: 21310 - RNA, 21 nt, Artificial Sequence
  Marburg virus siRNA sense strand
uggaagaucagggauuuaaac

SEQ ID NO: 21311 - RNA, 21 nt, Artificial Sequence
  Marburg virus siRNA sense strand
ggaagaucagggauuuaaaca

SEQ ID NO: 21312 - RNA, 21 nt, Artificial Sequence
  Marburg virus siRNA sense strand
gaagaucagggauuuaaacaa

SEQ ID NO: 21313 - RNA, 21 nt, Artificial Sequence
  Marburg virus siRNA sense strand
aagaucagggauuuaaacaau

SEQ ID NO: 21314 - RNA, 21 nt, Artificial Sequence
  Marburg virus siRNA sense strand
agaucagggauuuaaacaauc

SEQ ID NO: 21315 - RNA, 21 nt, Artificial Sequence
  Marburg virus siRNA sense strand
gaucagggauuuaaacaauca

SEQ ID NO: 21316 - RNA, 21 nt, Artificial Sequence
  Marburg virus siRNA sense strand
aucagggauuuaaacaaucac

SEQ ID NO: 21317 - RNA, 21 nt, Artificial Sequence
  Marburg virus siRNA sense strand
ucagggauuuaaacaaucaca

SEQ ID NO: 21318 - RNA, 21 nt, Artificial Sequence
  Marburg virus siRNA sense strand
cagggauuuaaacaaucacag

SEQ ID NO: 21319 - RNA, 21 nt, Artificial Sequence
  Marburg virus siRNA sense strand
agggauuuaaacaaucacaga

SEQ ID NO: 21320 - RNA, 21 nt, Artificial Sequence
  Marburg virus siRNA sense strand
gggauuuaaacaaucacagaa

SEQ ID NO: 21321 - RNA, 21 nt, Artificial Sequence
  Marburg virus siRNA sense strand
ggauuuaaacaaucacagaau

SEQ ID NO: 21322 - RNA, 21 nt, Artificial Sequence
  Marburg virus siRNA sense strand
gauuuaaacaaucacagaauc

SEQ ID NO: 21323 - RNA, 21 nt, Artificial Sequence
  Marburg virus siRNA sense strand
auuuaaacaaucacagaauca

SEQ ID NO: 21324 - RNA, 21 nt, Artificial Sequence
  Marburg virus siRNA sense strand
uuuaaacaaucacagaaucag

SEQ ID NO: 21325 - RNA, 21 nt, Artificial Sequence
  Marburg virus siRNA sense strand
uuaaacaaucacagaaucagg

SEQ ID NO: 21326 - RNA, 21 nt, Artificial Sequence
  Marburg virus siRNA sense strand
uaaacaaucacagaaucaggu

SEQ ID NO: 21327 - RNA, 21 nt, Artificial Sequence
  Marburg virus siRNA sense strand
aaacaaucacagaaucaggug

SEQ ID NO: 21328 - RNA, 21 nt, Artificial Sequence
  Marburg virus siRNA sense strand
aacaaucacagaaucaggugu

SEQ ID NO: 21329 - RNA, 21 nt, Artificial Sequence
  Marburg virus siRNA sense strand
acaaucacagaaucagguguc

SEQ ID NO: 21330 - RNA, 21 nt, Artificial Sequence
  Marburg virus siRNA sense strand
caaucacagaaucagguguca

SEQ ID NO: 21331 - RNA, 21 nt, Artificial Sequence
  Marburg virus siRNA sense strand
aaucacagaaucaggugucac

SEQ ID NO: 21332 - RNA, 21 nt, Artificial Sequence
  Marburg virus siRNA sense strand
aucacagaaucaggugucaca

SEQ ID NO: 21333 - RNA, 21 nt, Artificial Sequence
  Marburg virus siRNA sense strand
ucacagaaucaggugucacag

SEQ ID NO: 21334 - RNA, 21 nt, Artificial Sequence
  Marburg virus siRNA sense strand
cacagaaucaggugucacagu

SEQ ID NO: 21335 - RNA, 21 nt, Artificial Sequence
  Marburg virus siRNA sense strand
acagaaucaggugucacaguc

SEQ ID NO: 21336 - RNA, 21 nt, Artificial Sequence
  Marburg virus siRNA sense strand
cagaaucaggugucacagucg

SEQ ID NO: 21337 - RNA, 21 nt, Artificial Sequence
  Marburg virus siRNA sense strand
agaaucaggugucacagucgu

SEQ ID NO: 21338 - RNA, 21 nt, Artificial Sequence
  Marburg virus siRNA sense strand
gaaucaggugucacagucguu

SEQ ID NO: 21339 - RNA, 21 nt, Artificial Sequence
  Marburg virus siRNA sense strand
aaucaggugucacagucguuu

SEQ ID NO: 21340 - RNA, 21 nt, Artificial Sequence
  Marburg virus siRNA sense strand
aucaggugucacagucguuuu

SEQ ID NO: 21341 - RNA, 21 nt, Artificial Sequence
  Marburg virus siRNA sense strand
ucaggugucacagucguuuuu

SEQ ID NO: 21342 - RNA, 21 nt, Artificial Sequence
  Marburg virus siRNA sense strand
caggugucacagucguuuuug

SEQ ID NO: 21343 - RNA, 21 nt, Artificial Sequence
  Marburg virus siRNA sense strand
aggugucacagucguuuuuga

SEQ ID NO: 21344 - RNA, 21 nt, Artificial Sequence
  Marburg virus siRNA sense strand
ggugucacagucguuuuugaa

SEQ ID NO: 21345 - RNA, 21 nt, Artificial Sequence
  Marburg virus siRNA sense strand
gugucacagucguuuuugaau

SEQ ID NO: 21346 - RNA, 21 nt, Artificial Sequence
  Marburg virus siRNA sense strand
ugucacagucguuuuugaaug

SEQ ID NO: 21347 - RNA, 21 nt, Artificial Sequence
  Marburg virus siRNA sense strand
gucacagucguuuuugaauga

SEQ ID NO: 21348 - RNA, 21 nt, Artificial Sequence
  Marburg virus siRNA sense strand
ucacagucguuuuugaaugac

SEQ ID NO: 21349 - RNA, 21 nt, Artificial Sequence
  Marburg virus siRNA sense strand
cacagucguuuuugaaugacc

SEQ ID NO: 21350 - RNA, 21 nt, Artificial Sequence
  Marburg virus siRNA sense strand
acagucguuuuugaaugaccc

SEQ ID NO: 21351 - RNA, 21 nt, Artificial Sequence
  Marburg virus siRNA sense strand
cagucguuuuugaaugacccu

SEQ ID NO: 21352 - RNA, 21 nt, Artificial Sequence
  Marburg virus siRNA sense strand
agucguuuuugaaugacccua

SEQ ID NO: 21353 - RNA, 21 nt, Artificial Sequence
  Marburg virus siRNA sense strand
gucguuuuugaaugacccuac

SEQ ID NO: 21354 - RNA, 21 nt, Artificial Sequence
  Marburg virus siRNA sense strand
ucguuuuugaaugacccuaca

SEQ ID NO: 21355 - RNA, 21 nt, Artificial Sequence
  Marburg virus siRNA sense strand
cguuuuugaaugacccuacac

SEQ ID NO: 21356 - RNA, 21 nt, Artificial Sequence
  Marburg virus siRNA sense strand
guuuuugaaugacccuacacc

SEQ ID NO: 21357 - RNA, 21 nt, Artificial Sequence
  Marburg virus siRNA sense strand
uuuuugaaugacccuacaccu

SEQ ID NO: 21358 - RNA, 21 nt, Artificial Sequence
  Marburg virus siRNA sense strand
uuuugaaugacccuacaccug

SEQ ID NO: 21359 - RNA, 21 nt, Artificial Sequence
  Marburg virus siRNA sense strand
uuugaaugacccuacaccugu

SEQ ID NO: 21360 - RNA, 21 nt, Artificial Sequence
  Marburg virus siRNA sense strand
uugaaugacccuacaccugug

SEQ ID NO: 21361 - RNA, 21 nt, Artificial Sequence
  Marburg virus siRNA sense strand
ugaaugacccuacaccugugg

SEQ ID NO: 21362 - RNA, 21 nt, Artificial Sequence
  Marburg virus siRNA sense strand
gaaugacccuacaccugugga

SEQ ID NO: 21363 - RNA, 21 nt, Artificial Sequence
  Marburg virus siRNA sense strand
aaugacccuacaccuguggaa

SEQ ID NO: 21364 - RNA, 21 nt, Artificial Sequence
  Marburg virus siRNA sense strand
augacccuacaccuguggaag

SEQ ID NO: 21365 - RNA, 21 nt, Artificial Sequence
  Marburg virus siRNA sense strand
ugacccuacaccuguggaagu

SEQ ID NO: 21366 - RNA, 21 nt, Artificial Sequence
  Marburg virus siRNA sense strand
gacccuacaccuguggaagua

SEQ ID NO: 21367 - RNA, 21 nt, Artificial Sequence
  Marburg virus siRNA sense strand
acccuacaccuguggaaguaa

SEQ ID NO: 21368 - RNA, 21 nt, Artificial Sequence
  Marburg virus siRNA sense strand
cccuacaccuguggaaguaac

SEQ ID NO: 21369 - RNA, 21 nt, Artificial Sequence
  Marburg virus siRNA sense strand
ccuacaccuguggaaguaacg

SEQ ID NO: 21370 - RNA, 21 nt, Artificial Sequence
  Marburg virus siRNA sense strand
cuacaccuguggaaguaacgg

SEQ ID NO: 21371 - RNA, 21 nt, Artificial Sequence
  Marburg virus siRNA sense strand
uacaccuguggaaguaacggu

SEQ ID NO: 21372 - RNA, 21 nt, Artificial Sequence
  Marburg virus siRNA sense strand
acaccuguggaaguaacgguu

SEQ ID NO: 21373 - RNA, 21 nt, Artificial Sequence
  Marburg virus siRNA sense strand
caccuguggaaguaacgguuc

SEQ ID NO: 21374 - RNA, 21 nt, Artificial Sequence
  Marburg virus siRNA sense strand
accuguggaaguaacgguuca

SEQ ID NO: 21375 - RNA, 21 nt, Artificial Sequence
  Marburg virus siRNA sense strand
ccuguggaaguaacgguucaa

SEQ ID NO: 21376 - RNA, 21 nt, Artificial Sequence
  Marburg virus siRNA sense strand
cuguggaaguaacgguucaag

SEQ ID NO: 21377 - RNA, 21 nt, Artificial Sequence
  Marburg virus siRNA sense strand
uguggaaguaacgguucaagc

SEQ ID NO: 21378 - RNA, 21 nt, Artificial Sequence
  Marburg virus siRNA sense strand
guggaaguaacgguucaagcc

SEQ ID NO: 21379 - RNA, 21 nt, Artificial Sequence
  Marburg virus siRNA sense strand
uggaaguaacgguucaagcca

SEQ ID NO: 21380 - RNA, 21 nt, Artificial Sequence
  Marburg virus siRNA sense strand
ggaaguaacgguucaagccag

SEQ ID NO: 21381 - RNA, 21 nt, Artificial Sequence
  Marburg virus siRNA sense strand
gaaguaacgguucaagccagg

SEQ ID NO: 21382 - RNA, 21 nt, Artificial Sequence
  Marburg virus siRNA sense strand
aaguaacgguucaagccaggc

SEQ ID NO: 21383 - RNA, 21 nt, Artificial Sequence
  Marburg virus siRNA sense strand
aguaacgguucaagccaggcc

SEQ ID NO: 21384 - RNA, 21 nt, Artificial Sequence
  Marburg virus siRNA sense strand
guaacgguucaagccaggccc

SEQ ID NO: 21385 - RNA, 21 nt, Artificial Sequence
  Marburg virus siRNA sense strand
uaacgguucaagccaggccca

SEQ ID NO: 21386 - RNA, 21 nt, Artificial Sequence
  Marburg virus siRNA sense strand
aacgguucaagccaggcccau

SEQ ID NO: 21387 - RNA, 21 nt, Artificial Sequence
  Marburg virus siRNA sense strand
acgguucaagccaggcccaua

SEQ ID NO: 21388 - RNA, 21 nt, Artificial Sequence
  Marburg virus siRNA sense strand
cgguucaagccaggcccauaa

SEQ ID NO: 21389 - RNA, 21 nt, Artificial Sequence
  Marburg virus siRNA sense strand
gguucaagccaggcccauaaa

SEQ ID NO: 21390 - RNA, 21 nt, Artificial Sequence
  Marburg virus siRNA sense strand
guucaagccaggcccauaaau

SEQ ID NO: 21391 - RNA, 21 nt, Artificial Sequence
  Marburg virus siRNA sense strand
uucaagccaggcccauaaauc

SEQ ID NO: 21392 - RNA, 21 nt, Artificial Sequence
  Marburg virus siRNA sense strand
ucaagccaggcccauaaaucg

SEQ ID NO: 21393 - RNA, 21 nt, Artificial Sequence
  Marburg virus siRNA sense strand
caagccaggcccauaaaucga

SEQ ID NO: 21394 - RNA, 21 nt, Artificial Sequence
  Marburg virus siRNA sense strand
aagccaggcccauaaaucgac

SEQ ID NO: 21395 - RNA, 21 nt, Artificial Sequence
  Marburg virus siRNA sense strand
agccaggcccauaaaucgacc

SEQ ID NO: 21396 - RNA, 21 nt, Artificial Sequence
  Marburg virus siRNA sense strand
gccaggcccauaaaucgacca

SEQ ID NO: 21397 - RNA, 21 nt, Artificial Sequence
  Marburg virus siRNA sense strand
ccaggcccauaaaucgaccaa

SEQ ID NO: 21398 - RNA, 21 nt, Artificial Sequence
  Marburg virus siRNA sense strand
caggcccauaaaucgaccaac

SEQ ID NO: 21399 - RNA, 21 nt, Artificial Sequence
  Marburg virus siRNA sense strand
aggcccauaaaucgaccaacu

SEQ ID NO: 21400 - RNA, 21 nt, Artificial Sequence
  Marburg virus siRNA sense strand
ggcccauaaaucgaccaacug

SEQ ID NO: 21401 - RNA, 21 nt, Artificial Sequence
  Marburg virus siRNA sense strand
gcccauaaaucgaccaacugc

SEQ ID NO: 21402 - RNA, 21 nt, Artificial Sequence
  Marburg virus siRNA sense strand
cccauaaaucgaccaacugcu

SEQ ID NO: 21403 - RNA, 21 nt, Artificial Sequence
  Marburg virus siRNA sense strand
ccauaaaucgaccaacugcuc

SEQ ID NO: 21404 - RNA, 21 nt, Artificial Sequence
  Marburg virus siRNA sense strand
cauaaaucgaccaacugcucu

SEQ ID NO: 21405 - RNA, 21 nt, Artificial Sequence
  Marburg virus siRNA sense strand
auaaaucgaccaacugcucug

SEQ ID NO: 21406 - RNA, 21 nt, Artificial Sequence
  Marburg virus siRNA sense strand
uaaaucgaccaacugcucugc

SEQ ID NO: 21407 - RNA, 21 nt, Artificial Sequence
  Marburg virus siRNA sense strand
aaaucgaccaacugcucugcc

SEQ ID NO: 21408 - RNA, 21 nt, Artificial Sequence
  Marburg virus siRNA sense strand
aaucgaccaacugcucugccu

SEQ ID NO: 21409 - RNA, 21 nt, Artificial Sequence
  Marburg virus siRNA sense strand
aucgaccaacugcucugccuc

SEQ ID NO: 21410 - RNA, 21 nt, Artificial Sequence
  Marburg virus siRNA sense strand
ucgaccaacugcucugccucc

SEQ ID NO: 21411 - RNA, 21 nt, Artificial Sequence
  Marburg virus siRNA sense strand
cgaccaacugcucugccuccc

SEQ ID NO: 21412 - RNA, 21 nt, Artificial Sequence
  Marburg virus siRNA sense strand
gaccaacugcucugccucccc

SEQ ID NO: 21413 - RNA, 21 nt, Artificial Sequence
  Marburg virus siRNA sense strand
accaacugcucugccuccccc

SEQ ID NO: 21414 - RNA, 21 nt, Artificial Sequence
  Marburg virus siRNA sense strand
ccaacugcucugccuccccca

SEQ ID NO: 21415 - RNA, 21 nt, Artificial Sequence
  Marburg virus siRNA sense strand
caacugcucugccucccccag

SEQ ID NO: 21416 - RNA, 21 nt, Artificial Sequence
  Marburg virus siRNA sense strand
aacugcucugccucccccagu

SEQ ID NO: 21417 - RNA, 21 nt, Artificial Sequence
  Marburg virus siRNA sense strand
acugcucugccucccccaguu

SEQ ID NO: 21418 - RNA, 21 nt, Artificial Sequence
  Marburg virus siRNA sense strand
cugcucugccucccccaguug

SEQ ID NO: 21419 - RNA, 21 nt, Artificial Sequence
  Marburg virus siRNA sense strand
ugcucugccucccccaguuga

SEQ ID NO: 21420 - RNA, 21 nt, Artificial Sequence
  Marburg virus siRNA sense strand
gcucugccucccccaguugac

SEQ ID NO: 21421 - RNA, 21 nt, Artificial Sequence
  Marburg virus siRNA sense strand
cucugccucccccaguugaca

SEQ ID NO: 21422 - RNA, 21 nt, Artificial Sequence
  Marburg virus siRNA sense strand
ucugccucccccaguugacaa

SEQ ID NO: 21423 - RNA, 21 nt, Artificial Sequence
  Marburg virus siRNA sense strand
cugccucccccaguugacaac

SEQ ID NO: 21424 - RNA, 21 nt, Artificial Sequence
  Marburg virus siRNA sense strand
ugccucccccaguugacaaca

SEQ ID NO: 21425 - RNA, 21 nt, Artificial Sequence
  Marburg virus siRNA sense strand
gccucccccaguugacaacaa

SEQ ID NO: 21426 - RNA, 21 nt, Artificial Sequence
  Marburg virus siRNA sense strand
ccucccccaguugacaacaaa

SEQ ID NO: 21427 - RNA, 21 nt, Artificial Sequence
  Marburg virus siRNA sense strand
cucccccaguugacaacaaaa

SEQ ID NO: 21428 - RNA, 21 nt, Artificial Sequence
  Marburg virus siRNA sense strand
ucccccaguugacaacaaaau

SEQ ID NO: 21429 - RNA, 21 nt, Artificial Sequence
  Marburg virus siRNA sense strand
cccccaguugacaacaaaauu

SEQ ID NO: 21430 - RNA, 21 nt, Artificial Sequence
  Marburg virus siRNA sense strand
ccccaguugacaacaaaauug

SEQ ID NO: 21431 - RNA, 21 nt, Artificial Sequence
  Marburg virus siRNA sense strand
cccaguugacaacaaaauuga

SEQ ID NO: 21432 - RNA, 21 nt, Artificial Sequence
  Marburg virus siRNA sense strand
ccaguugacaacaaaauugag

SEQ ID NO: 21433 - RNA, 21 nt, Artificial Sequence
  Marburg virus siRNA sense strand
caguugacaacaaaauugagc

SEQ ID NO: 21434 - RNA, 21 nt, Artificial Sequence
  Marburg virus siRNA sense strand
aguugacaacaaaauugagca

SEQ ID NO: 21435 - RNA, 21 nt, Artificial Sequence
  Marburg virus siRNA sense strand
guugacaacaaaauugagcac

SEQ ID NO: 21436 - RNA, 21 nt, Artificial Sequence
  Marburg virus siRNA sense strand
uugacaacaaaauugagcacg

SEQ ID NO: 21437 - RNA, 21 nt, Artificial Sequence
  Marburg virus siRNA sense strand
ugacaacaaaauugagcacga

SEQ ID NO: 21438 - RNA, 21 nt, Artificial Sequence
  Marburg virus siRNA sense strand
gacaacaaaauugagcacgaa

SEQ ID NO: 21439 - RNA, 21 nt, Artificial Sequence
  Marburg virus siRNA sense strand
acaacaaaauugagcacgaau

SEQ ID NO: 21440 - RNA, 21 nt, Artificial Sequence
  Marburg virus siRNA sense strand
caacaaaauugagcacgaauc

SEQ ID NO: 21441 - RNA, 21 nt, Artificial Sequence
  Marburg virus siRNA sense strand
aacaaaauugagcacgaaucu

SEQ ID NO: 21442 - RNA, 21 nt, Artificial Sequence
  Marburg virus siRNA sense strand
acaaaauugagcacgaaucua

SEQ ID NO: 21443 - RNA, 21 nt, Artificial Sequence
  Marburg virus siRNA sense strand
caaaauugagcacgaaucuac

SEQ ID NO: 21444 - RNA, 21 nt, Artificial Sequence
  Marburg virus siRNA sense strand
aaaauugagcacgaaucuaca

SEQ ID NO: 21445 - RNA, 21 nt, Artificial Sequence
  Marburg virus siRNA sense strand
aaauugagcacgaaucuacag

SEQ ID NO: 21446 - RNA, 21 nt, Artificial Sequence
  Marburg virus siRNA sense strand
aauugagcacgaaucuacaga

SEQ ID NO: 21447 - RNA, 21 nt, Artificial Sequence
  Marburg virus siRNA sense strand
auugagcacgaaucuacagaa

SEQ ID NO: 21448 - RNA, 21 nt, Artificial Sequence
  Marburg virus siRNA sense strand
uugagcacgaaucuacagaag

SEQ ID NO: 21449 - RNA, 21 nt, Artificial Sequence
  Marburg virus siRNA sense strand
ugagcacgaaucuacagaaga

SEQ ID NO: 21450 - RNA, 21 nt, Artificial Sequence
  Marburg virus siRNA sense strand
gagcacgaaucuacagaagau

SEQ ID NO: 21451 - RNA, 21 nt, Artificial Sequence
  Marburg virus siRNA sense strand
agcacgaaucuacagaagaua

SEQ ID NO: 21452 - RNA, 21 nt, Artificial Sequence
  Marburg virus siRNA sense strand
gcacgaaucuacagaagauag

SEQ ID NO: 21453 - RNA, 21 nt, Artificial Sequence
  Marburg virus siRNA sense strand
cacgaaucuacagaagauagc

SEQ ID NO: 21454 - RNA, 21 nt, Artificial Sequence
  Marburg virus siRNA sense strand
acgaaucuacagaagauagcu

SEQ ID NO: 21455 - RNA, 21 nt, Artificial Sequence
  Marburg virus siRNA sense strand
cgaaucuacagaagauagcuc

SEQ ID NO: 21456 - RNA, 21 nt, Artificial Sequence
  Marburg virus siRNA sense strand
gaaucuacagaagauagcucu

SEQ ID NO: 21457 - RNA, 21 nt, Artificial Sequence
  Marburg virus siRNA sense strand
aaucuacagaagauagcucuu

SEQ ID NO: 21458 - RNA, 21 nt, Artificial Sequence
  Marburg virus siRNA sense strand
aucuacagaagauagcucuuc

SEQ ID NO: 21459 - RNA, 21 nt, Artificial Sequence
  Marburg virus siRNA sense strand
ucuacagaagauagcucuucu

SEQ ID NO: 21460 - RNA, 21 nt, Artificial Sequence
  Marburg virus siRNA sense strand
cuacagaagauagcucuucuu

SEQ ID NO: 21461 - RNA, 21 nt, Artificial Sequence
  Marburg virus siRNA sense strand
uacagaagauagcucuucuuc

SEQ ID NO: 21462 - RNA, 21 nt, Artificial Sequence
  Marburg virus siRNA sense strand
acagaagauagcucuucuuca

SEQ ID NO: 21463 - RNA, 21 nt, Artificial Sequence
  Marburg virus siRNA sense strand
cagaagauagcucuucuucaa

SEQ ID NO: 21464 - RNA, 21 nt, Artificial Sequence
  Marburg virus siRNA sense strand
agaagauagcucuucuucaag

SEQ ID NO: 21465 - RNA, 21 nt, Artificial Sequence
  Marburg virus siRNA sense strand
gaagauagcucuucuucaagc

SEQ ID NO: 21466 - RNA, 21 nt, Artificial Sequence
  Marburg virus siRNA sense strand
aagauagcucuucuucaagca

SEQ ID NO: 21467 - RNA, 21 nt, Artificial Sequence
  Marburg virus siRNA sense strand
agauagcucuucuucaagcag

SEQ ID NO: 21468 - RNA, 21 nt, Artificial Sequence
  Marburg virus siRNA sense strand
gauagcucuucuucaagcagc

SEQ ID NO: 21469 - RNA, 21 nt, Artificial Sequence
  Marburg virus siRNA sense strand
auagcucuucuucaagcagcu

SEQ ID NO: 21470 - RNA, 21 nt, Artificial Sequence
  Marburg virus siRNA sense strand
uagcucuucuucaagcagcuu

SEQ ID NO: 21471 - RNA, 21 nt, Artificial Sequence
  Marburg virus siRNA sense strand
agcucuucuucaagcagcuuu

SEQ ID NO: 21472 - RNA, 21 nt, Artificial Sequence
  Marburg virus siRNA sense strand
gcucuucuucaagcagcuuug

SEQ ID NO: 21473 - RNA, 21 nt, Artificial Sequence
  Marburg virus siRNA sense strand
cucuucuucaagcagcuuugu

SEQ ID NO: 21474 - RNA, 21 nt, Artificial Sequence
  Marburg virus siRNA sense strand
ucuucuucaagcagcuuuguu

SEQ ID NO: 21475 - RNA, 21 nt, Artificial Sequence
  Marburg virus siRNA sense strand
cuucuucaagcagcuuuguug

SEQ ID NO: 21476 - RNA, 21 nt, Artificial Sequence
  Marburg virus siRNA sense strand
uucuucaagcagcuuuguuga

SEQ ID NO: 21477 - RNA, 21 nt, Artificial Sequence
  Marburg virus siRNA sense strand
ucuucaagcagcuuuguugau

SEQ ID NO: 21478 - RNA, 21 nt, Artificial Sequence
  Marburg virus siRNA sense strand
cuucaagcagcuuuguugauc

SEQ ID NO: 21479 - RNA, 21 nt, Artificial Sequence
  Marburg virus siRNA sense strand
uucaagcagcuuuguugaucu

SEQ ID NO: 21480 - RNA, 21 nt, Artificial Sequence
  Marburg virus siRNA sense strand
ucaagcagcuuuguugaucuu

SEQ ID NO: 21481 - RNA, 21 nt, Artificial Sequence
  Marburg virus siRNA sense strand
caagcagcuuuguugaucuua

SEQ ID NO: 21482 - RNA, 21 nt, Artificial Sequence
  Marburg virus siRNA sense strand
aagcagcuuuguugaucuuaa

SEQ ID NO: 21483 - RNA, 21 nt, Artificial Sequence
  Marburg virus siRNA sense strand
agcagcuuuguugaucuuaau

SEQ ID NO: 21484 - RNA, 21 nt, Artificial Sequence
  Marburg virus siRNA sense strand
gcagcuuuguugaucuuaaug

SEQ ID NO: 21485 - RNA, 21 nt, Artificial Sequence
  Marburg virus siRNA sense strand
cagcuuuguugaucuuaauga

SEQ ID NO: 21486 - RNA, 21 nt, Artificial Sequence
  Marburg virus siRNA sense strand
agcuuuguugaucuuaaugau

SEQ ID NO: 21487 - RNA, 21 nt, Artificial Sequence
  Marburg virus siRNA sense strand
gcuuuguugaucuuaaugauc

SEQ ID NO: 21488 - RNA, 21 nt, Artificial Sequence
  Marburg virus siRNA sense strand
cuuuguugaucuuaaugaucc

SEQ ID NO: 21489 - RNA, 21 nt, Artificial Sequence
  Marburg virus siRNA sense strand
uuuguugaucuuaaugaucca

SEQ ID NO: 21490 - RNA, 21 nt, Artificial Sequence
  Marburg virus siRNA sense strand
uuguugaucuuaaugauccau

SEQ ID NO: 21491 - RNA, 21 nt, Artificial Sequence
  Marburg virus siRNA sense strand
uguugaucuuaaugauccauu

SEQ ID NO: 21492 - RNA, 21 nt, Artificial Sequence
  Marburg virus siRNA sense strand
guugaucuuaaugauccauuu

SEQ ID NO: 21493 - RNA, 21 nt, Artificial Sequence
  Marburg virus siRNA sense strand
uugaucuuaaugauccauuug

SEQ ID NO: 21494 - RNA, 21 nt, Artificial Sequence
  Marburg virus siRNA sense strand
ugaucuuaaugauccauuugc

SEQ ID NO: 21495 - RNA, 21 nt, Artificial Sequence
  Marburg virus siRNA sense strand
gaucuuaaugauccauuugcg

SEQ ID NO: 21496 - RNA, 21 nt, Artificial Sequence
  Marburg virus siRNA sense strand
aucuuaaugauccauuugcgc

SEQ ID NO: 21497 - RNA, 21 nt, Artificial Sequence
  Marburg virus siRNA sense strand
ucuuaaugauccauuugcgcu

SEQ ID NO: 21498 - RNA, 21 nt, Artificial Sequence
  Marburg virus siRNA sense strand
cuuaaugauccauuugcgcug

SEQ ID NO: 21499 - RNA, 21 nt, Artificial Sequence
  Marburg virus siRNA sense strand
uuaaugauccauuugcgcugc

SEQ ID NO: 21500 - RNA, 21 nt, Artificial Sequence
  Marburg virus siRNA sense strand
uaaugauccauuugcgcugcu

SEQ ID NO: 21501 - RNA, 21 nt, Artificial Sequence
  Marburg virus siRNA sense strand
aaugauccauuugcgcugcug

SEQ ID NO: 21502 - RNA, 21 nt, Artificial Sequence
  Marburg virus siRNA sense strand
augauccauuugcgcugcuga

SEQ ID NO: 21503 - RNA, 21 nt, Artificial Sequence
  Marburg virus siRNA sense strand
ugauccauuugcgcugcugaa

SEQ ID NO: 21504 - RNA, 21 nt, Artificial Sequence
  Marburg virus siRNA sense strand
gauccauuugcgcugcugaau

SEQ ID NO: 21505 - RNA, 21 nt, Artificial Sequence
  Marburg virus siRNA sense strand
auccauuugcgcugcugaaug

SEQ ID NO: 21506 - RNA, 21 nt, Artificial Sequence
  Marburg virus siRNA sense strand
uccauuugcgcugcugaauga

SEQ ID NO: 21507 - RNA, 21 nt, Artificial Sequence
  Marburg virus siRNA sense strand
ccauuugcgcugcugaaugag

SEQ ID NO: 21508 - RNA, 21 nt, Artificial Sequence
  Marburg virus siRNA sense strand
cauuugcgcugcugaaugagg

SEQ ID NO: 21509 - RNA, 21 nt, Artificial Sequence
  Marburg virus siRNA sense strand
auuugcgcugcugaaugagga

SEQ ID NO: 21510 - RNA, 21 nt, Artificial Sequence
  Marburg virus siRNA sense strand
uuugcgcugcugaaugaggac

SEQ ID NO: 21511 - RNA, 21 nt, Artificial Sequence
  Marburg virus siRNA sense strand
uugcgcugcugaaugaggacg

SEQ ID NO: 21512 - RNA, 21 nt, Artificial Sequence
  Marburg virus siRNA sense strand
ugcgcugcugaaugaggacga

SEQ ID NO: 21513 - RNA, 21 nt, Artificial Sequence
  Marburg virus siRNA sense strand
gcgcugcugaaugaggacgaa

SEQ ID NO: 21514 - RNA, 21 nt, Artificial Sequence
  Marburg virus siRNA sense strand
cgcugcugaaugaggacgaag

SEQ ID NO: 21515 - RNA, 21 nt, Artificial Sequence
  Marburg virus siRNA sense strand
gcugcugaaugaggacgaaga

SEQ ID NO: 21516 - RNA, 21 nt, Artificial Sequence
  Marburg virus siRNA sense strand
cugcugaaugaggacgaagac

SEQ ID NO: 21517 - RNA, 21 nt, Artificial Sequence
  Marburg virus siRNA sense strand
ugcugaaugaggacgaagaca

SEQ ID NO: 21518 - RNA, 21 nt, Artificial Sequence
  Marburg virus siRNA sense strand
gcugaaugaggacgaagacac

SEQ ID NO: 21519 - RNA, 21 nt, Artificial Sequence
  Marburg virus siRNA sense strand
cugaaugaggacgaagacacu

SEQ ID NO: 21520 - RNA, 21 nt, Artificial Sequence
  Marburg virus siRNA sense strand
ugaaugaggacgaagacacuc

SEQ ID NO: 21521 - RNA, 21 nt, Artificial Sequence
  Marburg virus siRNA sense strand
gaaugaggacgaagacacucu

SEQ ID NO: 21522 - RNA, 21 nt, Artificial Sequence
  Marburg virus siRNA sense strand
aaugaggacgaagacacucuu

SEQ ID NO: 21523 - RNA, 21 nt, Artificial Sequence
  Marburg virus siRNA sense strand
augaggacgaagacacucuug

SEQ ID NO: 21524 - RNA, 21 nt, Artificial Sequence
  Marburg virus siRNA sense strand
ugaggacgaagacacucuuga

SEQ ID NO: 21525 - RNA, 21 nt, Artificial Sequence
  Marburg virus siRNA sense strand
gaggacgaagacacucuugac

SEQ ID NO: 21526 - RNA, 21 nt, Artificial Sequence
  Marburg virus siRNA sense strand
aggacgaagacacucuugacg

SEQ ID NO: 21527 - RNA, 21 nt, Artificial Sequence
  Marburg virus siRNA sense strand
ggacgaagacacucuugacga

SEQ ID NO: 21528 - RNA, 21 nt, Artificial Sequence
  Marburg virus siRNA sense strand
gacgaagacacucuugacgac

SEQ ID NO: 21529 - RNA, 21 nt, Artificial Sequence
  Marburg virus siRNA sense strand
acgaagacacucuugacgaca

SEQ ID NO: 21530 - RNA, 21 nt, Artificial Sequence
  Marburg virus siRNA sense strand
cgaagacacucuugacgacag

SEQ ID NO: 21531 - RNA, 21 nt, Artificial Sequence
  Marburg virus siRNA sense strand
gaagacacucuugacgacagu

SEQ ID NO: 21532 - RNA, 21 nt, Artificial Sequence
  Marburg virus siRNA sense strand
aagacacucuugacgacagug

SEQ ID NO: 21533 - RNA, 21 nt, Artificial Sequence
  Marburg virus siRNA sense strand
agacacucuugacgacagugu

SEQ ID NO: 21534 - RNA, 21 nt, Artificial Sequence
  Marburg virus siRNA sense strand
gacacucuugacgacaguguc

SEQ ID NO: 21535 - RNA, 21 nt, Artificial Sequence
  Marburg virus siRNA sense strand
acacucuugacgacaguguca

SEQ ID NO: 21536 - RNA, 21 nt, Artificial Sequence
  Marburg virus siRNA sense strand
cacucuugacgacagugucau

SEQ ID NO: 21537 - RNA, 21 nt, Artificial Sequence
  Marburg virus siRNA sense strand
acucuugacgacagugucaug

SEQ ID NO: 21538 - RNA, 21 nt, Artificial Sequence
  Marburg virus siRNA sense strand
cucuugacgacagugucauga

SEQ ID NO: 21539 - RNA, 21 nt, Artificial Sequence
  Marburg virus siRNA sense strand
ucuugacgacagugucaugau

SEQ ID NO: 21540 - RNA, 21 nt, Artificial Sequence
  Marburg virus siRNA sense strand
cuugacgacagugucaugauc

SEQ ID NO: 21541 - RNA, 21 nt, Artificial Sequence
  Marburg virus siRNA sense strand
uugacgacagugucaugaucc

SEQ ID NO: 21542 - RNA, 21 nt, Artificial Sequence
  Marburg virus siRNA sense strand
ugacgacagugucaugauccc

SEQ ID NO: 21543 - RNA, 21 nt, Artificial Sequence
  Marburg virus siRNA sense strand
gacgacagugucaugaucccg

SEQ ID NO: 21544 - RNA, 21 nt, Artificial Sequence
  Marburg virus siRNA sense strand
acgacagugucaugaucccga

SEQ ID NO: 21545 - RNA, 21 nt, Artificial Sequence
  Marburg virus siRNA sense strand
cgacagugucaugaucccgag

SEQ ID NO: 21546 - RNA, 21 nt, Artificial Sequence
  Marburg virus siRNA sense strand
gacagugucaugaucccgagc

SEQ ID NO: 21547 - RNA, 21 nt, Artificial Sequence
  Marburg virus siRNA sense strand
acagugucaugaucccgagca

SEQ ID NO: 21548 - RNA, 21 nt, Artificial Sequence
  Marburg virus siRNA sense strand
cagugucaugaucccgagcac

SEQ ID NO: 21549 - RNA, 21 nt, Artificial Sequence
  Marburg virus siRNA sense strand
agugucaugaucccgagcaca

SEQ ID NO: 21550 - RNA, 21 nt, Artificial Sequence
  Marburg virus siRNA sense strand
gugucaugaucccgagcacaa

SEQ ID NO: 21551 - RNA, 21 nt, Artificial Sequence
  Marburg virus siRNA sense strand
ugucaugaucccgagcacaac

SEQ ID NO: 21552 - RNA, 21 nt, Artificial Sequence
  Marburg virus siRNA sense strand
gucaugaucccgagcacaaca

SEQ ID NO: 21553 - RNA, 21 nt, Artificial Sequence
  Marburg virus siRNA sense strand
ucaugaucccgagcacaacau

SEQ ID NO: 21554 - RNA, 21 nt, Artificial Sequence
  Marburg virus siRNA sense strand
caugaucccgagcacaacauc

SEQ ID NO: 21555 - RNA, 21 nt, Artificial Sequence
  Marburg virus siRNA sense strand
augaucccgagcacaacaucg

SEQ ID NO: 21556 - RNA, 21 nt, Artificial Sequence
  Marburg virus siRNA sense strand
ugaucccgagcacaacaucga

SEQ ID NO: 21557 - RNA, 21 nt, Artificial Sequence
  Marburg virus siRNA sense strand
gaucccgagcacaacaucgag

SEQ ID NO: 21558 - RNA, 21 nt, Artificial Sequence
  Marburg virus siRNA sense strand
aucccgagcacaacaucgaga

SEQ ID NO: 21559 - RNA, 21 nt, Artificial Sequence
  Marburg virus siRNA sense strand
ucccgagcacaacaucgagag

SEQ ID NO: 21560 - RNA, 21 nt, Artificial Sequence
  Marburg virus siRNA sense strand
cccgagcacaacaucgagaga

SEQ ID NO: 21561 - RNA, 21 nt, Artificial Sequence
  Marburg virus siRNA sense strand
ccgagcacaacaucgagagaa

SEQ ID NO: 21562 - RNA, 21 nt, Artificial Sequence
  Marburg virus siRNA sense strand
cgagcacaacaucgagagaau

SEQ ID NO: 21563 - RNA, 21 nt, Artificial Sequence
  Marburg virus siRNA sense strand
gagcacaacaucgagagaauu

SEQ ID NO: 21564 - RNA, 21 nt, Artificial Sequence
  Marburg virus siRNA sense strand
agcacaacaucgagagaauuu

SEQ ID NO: 21565 - RNA, 21 nt, Artificial Sequence
  Marburg virus siRNA sense strand
gcacaacaucgagagaauuuc

SEQ ID NO: 21566 - RNA, 21 nt, Artificial Sequence
  Marburg virus siRNA sense strand
cacaacaucgagagaauuuca

SEQ ID NO: 21567 - RNA, 21 nt, Artificial Sequence
  Marburg virus siRNA sense strand
acaacaucgagagaauuucaa

SEQ ID NO: 21568 - RNA, 21 nt, Artificial Sequence
  Marburg virus siRNA sense strand
caacaucgagagaauuucaag

SEQ ID NO: 21569 - RNA, 21 nt, Artificial Sequence
  Marburg virus siRNA sense strand
aacaucgagagaauuucaagg

SEQ ID NO: 21570 - RNA, 21 nt, Artificial Sequence
  Marburg virus siRNA sense strand
acaucgagagaauuucaaggg

SEQ ID NO: 21571 - RNA, 21 nt, Artificial Sequence
  Marburg virus siRNA sense strand
caucgagagaauuucaaggga

SEQ ID NO: 21572 - RNA, 21 nt, Artificial Sequence
  Marburg virus siRNA sense strand
aucgagagaauuucaagggau

SEQ ID NO: 21573 - RNA, 21 nt, Artificial Sequence
  Marburg virus siRNA sense strand
ucgagagaauuucaagggauu

SEQ ID NO: 21574 - RNA, 21 nt, Artificial Sequence
  Marburg virus siRNA sense strand
cgagagaauuucaagggauuc

SEQ ID NO: 21575 - RNA, 21 nt, Artificial Sequence
  Marburg virus siRNA sense strand
gagagaauuucaagggauucc

SEQ ID NO: 21576 - RNA, 21 nt, Artificial Sequence
  Marburg virus siRNA sense strand
agagaauuucaagggauucca

SEQ ID NO: 21577 - RNA, 21 nt, Artificial Sequence
  Marburg virus siRNA sense strand
gagaauuucaagggauuccag

SEQ ID NO: 21578 - RNA, 21 nt, Artificial Sequence
  Marburg virus siRNA sense strand
agaauuucaagggauuccagc

SEQ ID NO: 21579 - RNA, 21 nt, Artificial Sequence
  Marburg virus siRNA sense strand
gaauuucaagggauuccagca

SEQ ID NO: 21580 - RNA, 21 nt, Artificial Sequence
  Marburg virus siRNA sense strand
aauuucaagggauuccagcac

SEQ ID NO: 21581 - RNA, 21 nt, Artificial Sequence
  Marburg virus siRNA sense strand
auuucaagggauuccagcacc

SEQ ID NO: 21582 - RNA, 21 nt, Artificial Sequence
  Marburg virus siRNA sense strand
uuucaagggauuccagcacca

SEQ ID NO: 21583 - RNA, 21 nt, Artificial Sequence
  Marburg virus siRNA sense strand
uucaagggauuccagcaccac

SEQ ID NO: 21584 - RNA, 21 nt, Artificial Sequence
  Marburg virus siRNA sense strand
ucaagggauuccagcaccacc

SEQ ID NO: 21585 - RNA, 21 nt, Artificial Sequence
  Marburg virus siRNA sense strand
caagggauuccagcaccacca

SEQ ID NO: 21586 - RNA, 21 nt, Artificial Sequence
  Marburg virus siRNA sense strand
aagggauuccagcaccaccaa

SEQ ID NO: 21587 - RNA, 21 nt, Artificial Sequence
  Marburg virus siRNA sense strand
agggauuccagcaccaccaag

SEQ ID NO: 21588 - RNA, 21 nt, Artificial Sequence
  Marburg virus siRNA sense strand
gggauuccagcaccaccaaga

SEQ ID NO: 21589 - RNA, 21 nt, Artificial Sequence
  Marburg virus siRNA sense strand
ggauuccagcaccaccaagac

SEQ ID NO: 21590 - RNA, 21 nt, Artificial Sequence
  Marburg virus siRNA sense strand
gauuccagcaccaccaagaca

SEQ ID NO: 21591 - RNA, 21 nt, Artificial Sequence
  Marburg virus siRNA sense strand
auuccagcaccaccaagacaa

SEQ ID NO: 21592 - RNA, 21 nt, Artificial Sequence
  Marburg virus siRNA sense strand
uuccagcaccaccaagacaau

SEQ ID NO: 21593 - RNA, 21 nt, Artificial Sequence
  Marburg virus siRNA sense strand
uccagcaccaccaagacaauc

SEQ ID NO: 21594 - RNA, 21 nt, Artificial Sequence
  Marburg virus siRNA sense strand
ccagcaccaccaagacaaucu

SEQ ID NO: 21595 - RNA, 21 nt, Artificial Sequence
  Marburg virus siRNA sense strand
cagcaccaccaagacaaucuc

SEQ ID NO: 21596 - RNA, 21 nt, Artificial Sequence
  Marburg virus siRNA sense strand
agcaccaccaagacaaucuca

SEQ ID NO: 21597 - RNA, 21 nt, Artificial Sequence
  Marburg virus siRNA sense strand
gcaccaccaagacaaucucag

SEQ ID NO: 21598 - RNA, 21 nt, Artificial Sequence
  Marburg virus siRNA sense strand
caccaccaagacaaucucagg

SEQ ID NO: 21599 - RNA, 21 nt, Artificial Sequence
  Marburg virus siRNA sense strand
accaccaagacaaucucagga

SEQ ID NO: 21600 - RNA, 21 nt, Artificial Sequence
  Marburg virus siRNA sense strand
ccaccaagacaaucucaggac

SEQ ID NO: 21601 - RNA, 21 nt, Artificial Sequence
  Marburg virus siRNA sense strand
caccaagacaaucucaggacc

SEQ ID NO: 21602 - RNA, 21 nt, Artificial Sequence
  Marburg virus siRNA sense strand
accaagacaaucucaggaccu

SEQ ID NO: 21603 - RNA, 21 nt, Artificial Sequence
  Marburg virus siRNA sense strand
ccaagacaaucucaggaccuc

SEQ ID NO: 21604 - RNA, 21 nt, Artificial Sequence
  Marburg virus siRNA sense strand
caagacaaucucaggaccuca

SEQ ID NO: 21605 - RNA, 21 nt, Artificial Sequence
  Marburg virus siRNA sense strand
aagacaaucucaggaccucaa

SEQ ID NO: 21606 - RNA, 21 nt, Artificial Sequence
  Marburg virus siRNA sense strand
agacaaucucaggaccucaac

SEQ ID NO: 21607 - RNA, 21 nt, Artificial Sequence
  Marburg virus siRNA sense strand
gacaaucucaggaccucaaca

SEQ ID NO: 21608 - RNA, 21 nt, Artificial Sequence
  Marburg virus siRNA sense strand
acaaucucaggaccucaacaa

SEQ ID NO: 21609 - RNA, 21 nt, Artificial Sequence
  Marburg virus siRNA sense strand
caaucucaggaccucaacaac

SEQ ID NO: 21610 - RNA, 21 nt, Artificial Sequence
  Marburg virus siRNA sense strand
aaucucaggaccucaacaaca

SEQ ID NO: 21611 - RNA, 21 nt, Artificial Sequence
  Marburg virus siRNA sense strand
aucucaggaccucaacaacag

SEQ ID NO: 21612 - RNA, 21 nt, Artificial Sequence
  Marburg virus siRNA sense strand
ucucaggaccucaacaacagc

SEQ ID NO: 21613 - RNA, 21 nt, Artificial Sequence
  Marburg virus siRNA sense strand
cucaggaccucaacaacagcc

SEQ ID NO: 21614 - RNA, 21 nt, Artificial Sequence
  Marburg virus siRNA sense strand
ucaggaccucaacaacagcca

SEQ ID NO: 21615 - RNA, 21 nt, Artificial Sequence
  Marburg virus siRNA sense strand
caggaccucaacaacagccaa

SEQ ID NO: 21616 - RNA, 21 nt, Artificial Sequence
  Marburg virus siRNA sense strand
aggaccucaacaacagccaag

SEQ ID NO: 21617 - RNA, 21 nt, Artificial Sequence
  Marburg virus siRNA sense strand
ggaccucaacaacagccaagg

SEQ ID NO: 21618 - RNA, 21 nt, Artificial Sequence
  Marburg virus siRNA sense strand
gaccucaacaacagccaagga

SEQ ID NO: 21619 - RNA, 21 nt, Artificial Sequence
  Marburg virus siRNA sense strand
accucaacaacagccaaggaa

SEQ ID NO: 21620 - RNA, 21 nt, Artificial Sequence
  Marburg virus siRNA sense strand
ccucaacaacagccaaggaaa

SEQ ID NO: 21621 - RNA, 21 nt, Artificial Sequence
  Marburg virus siRNA sense strand
cucaacaacagccaaggaaag

SEQ ID NO: 21622 - RNA, 21 nt, Artificial Sequence
  Marburg virus siRNA sense strand
ucaacaacagccaaggaaagc

SEQ ID NO: 21623 - RNA, 21 nt, Artificial Sequence
  Marburg virus siRNA sense strand
caacaacagccaaggaaagca

SEQ ID NO: 21624 - RNA, 21 nt, Artificial Sequence
  Marburg virus siRNA sense strand
aacaacagccaaggaaagcag

SEQ ID NO: 21625 - RNA, 21 nt, Artificial Sequence
  Marburg virus siRNA sense strand
acaacagccaaggaaagcagg

SEQ ID NO: 21626 - RNA, 21 nt, Artificial Sequence
  Marburg virus siRNA sense strand
caacagccaaggaaagcagga

SEQ ID NO: 21627 - RNA, 21 nt, Artificial Sequence
  Marburg virus siRNA sense strand
aacagccaaggaaagcaggaa

SEQ ID NO: 21628 - RNA, 21 nt, Artificial Sequence
  Marburg virus siRNA sense strand
acagccaaggaaagcaggaag

SEQ ID NO: 21629 - RNA, 21 nt, Artificial Sequence
  Marburg virus siRNA sense strand
cagccaaggaaagcaggaaga

SEQ ID NO: 21630 - RNA, 21 nt, Artificial Sequence
  Marburg virus siRNA sense strand
agccaaggaaagcaggaagau

SEQ ID NO: 21631 - RNA, 21 nt, Artificial Sequence
  Marburg virus siRNA sense strand
gccaaggaaagcaggaagaug

SEQ ID NO: 21632 - RNA, 21 nt, Artificial Sequence
  Marburg virus siRNA sense strand
ccaaggaaagcaggaagauga

SEQ ID NO: 21633 - RNA, 21 nt, Artificial Sequence
  Marburg virus siRNA sense strand
caaggaaagcaggaagaugaa

SEQ ID NO: 21634 - RNA, 21 nt, Artificial Sequence
  Marburg virus siRNA sense strand
aaggaaagcaggaagaugaau

SEQ ID NO: 21635 - RNA, 21 nt, Artificial Sequence
  Marburg virus siRNA sense strand
aggaaagcaggaagaugaauc

SEQ ID NO: 21636 - RNA, 21 nt, Artificial Sequence
  Marburg virus siRNA sense strand
ggaaagcaggaagaugaauca

SEQ ID NO: 21637 - RNA, 21 nt, Artificial Sequence
  Marburg virus siRNA sense strand
gaaagcaggaagaugaaucaa

SEQ ID NO: 21638 - RNA, 21 nt, Artificial Sequence
  Marburg virus siRNA sense strand
aaagcaggaagaugaaucaac

SEQ ID NO: 21639 - RNA, 21 nt, Artificial Sequence
  Marburg virus siRNA sense strand
aagcaggaagaugaaucaaca

SEQ ID NO: 21640 - RNA, 21 nt, Artificial Sequence
  Marburg virus siRNA sense strand
agcaggaagaugaaucaacaa

SEQ ID NO: 21641 - RNA, 21 nt, Artificial Sequence
  Marburg virus siRNA sense strand
gcaggaagaugaaucaacaaa

SEQ ID NO: 21642 - RNA, 21 nt, Artificial Sequence
  Marburg virus siRNA sense strand
caggaagaugaaucaacaaau

SEQ ID NO: 21643 - RNA, 21 nt, Artificial Sequence
  Marburg virus siRNA sense strand
aggaagaugaaucaacaaauc

SEQ ID NO: 21644 - RNA, 21 nt, Artificial Sequence
  Marburg virus siRNA sense strand
ggaagaugaaucaacaaaucc

SEQ ID NO: 21645 - RNA, 21 nt, Artificial Sequence
  Marburg virus siRNA sense strand
gaagaugaaucaacaaauccg

SEQ ID NO: 21646 - RNA, 21 nt, Artificial Sequence
  Marburg virus siRNA sense strand
aagaugaaucaacaaauccga

SEQ ID NO: 21647 - RNA, 21 nt, Artificial Sequence
  Marburg virus siRNA sense strand
agaugaaucaacaaauccgau

SEQ ID NO: 21648 - RNA, 21 nt, Artificial Sequence
  Marburg virus siRNA sense strand
gaugaaucaacaaauccgauu

SEQ ID NO: 21649 - RNA, 21 nt, Artificial Sequence
  Marburg virus siRNA sense strand
augaaucaacaaauccgauua

SEQ ID NO: 21650 - RNA, 21 nt, Artificial Sequence
  Marburg virus siRNA sense strand
ugaaucaacaaauccgauuaa

SEQ ID NO: 21651 - RNA, 21 nt, Artificial Sequence
  Marburg virus siRNA sense strand
gaaucaacaaauccgauuaag

SEQ ID NO: 21652 - RNA, 21 nt, Artificial Sequence
  Marburg virus siRNA sense strand
aaucaacaaauccgauuaaga

SEQ ID NO: 21653 - RNA, 21 nt, Artificial Sequence
  Marburg virus siRNA sense strand
aucaacaaauccgauuaagaa

SEQ ID NO: 21654 - RNA, 21 nt, Artificial Sequence
  Marburg virus siRNA sense strand
ucaacaaauccgauuaagaaa

SEQ ID NO: 21655 - RNA, 21 nt, Artificial Sequence
  Marburg virus siRNA sense strand
caacaaauccgauuaagaaac

SEQ ID NO: 21656 - RNA, 21 nt, Artificial Sequence
  Marburg virus siRNA sense strand
aacaaauccgauuaagaaaca

SEQ ID NO: 21657 - RNA, 21 nt, Artificial Sequence
  Marburg virus siRNA sense strand
acaaauccgauuaagaaacag

SEQ ID NO: 21658 - RNA, 21 nt, Artificial Sequence
  Marburg virus siRNA sense strand
caaauccgauuaagaaacagu

SEQ ID NO: 21659 - RNA, 21 nt, Artificial Sequence
  Marburg virus siRNA sense strand
aaauccgauuaagaaacaguu

SEQ ID NO: 21660 - RNA, 21 nt, Artificial Sequence
  Marburg virus siRNA sense strand
aauccgauuaagaaacaguuu

SEQ ID NO: 21661 - RNA, 21 nt, Artificial Sequence
  Marburg virus siRNA sense strand
auccgauuaagaaacaguuuc

SEQ ID NO: 21662 - RNA, 21 nt, Artificial Sequence
  Marburg virus siRNA sense strand
uccgauuaagaaacaguuucu

SEQ ID NO: 21663 - RNA, 21 nt, Artificial Sequence
  Marburg virus siRNA sense strand
ccgauuaagaaacaguuucug

SEQ ID NO: 21664 - RNA, 21 nt, Artificial Sequence
  Marburg virus siRNA sense strand
cgauuaagaaacaguuucuga

SEQ ID NO: 21665 - RNA, 21 nt, Artificial Sequence
  Marburg virus siRNA sense strand
gauuaagaaacaguuucugag

SEQ ID NO: 21666 - RNA, 21 nt, Artificial Sequence
  Marburg virus siRNA sense strand
auuaagaaacaguuucugaga

SEQ ID NO: 21667 - RNA, 21 nt, Artificial Sequence
  Marburg virus siRNA sense strand
uuaagaaacaguuucugagau

SEQ ID NO: 21668 - RNA, 21 nt, Artificial Sequence
  Marburg virus siRNA sense strand
uaagaaacaguuucugagaua

SEQ ID NO: 21669 - RNA, 21 nt, Artificial Sequence
  Marburg virus siRNA sense strand
aagaaacaguuucugagauau

SEQ ID NO: 21670 - RNA, 21 nt, Artificial Sequence
  Marburg virus siRNA sense strand
agaaacaguuucugagauauc

SEQ ID NO: 21671 - RNA, 21 nt, Artificial Sequence
  Marburg virus siRNA sense strand
gaaacaguuucugagauauca

SEQ ID NO: 21672 - RNA, 21 nt, Artificial Sequence
  Marburg virus siRNA sense strand
aaacaguuucugagauaucaa

SEQ ID NO: 21673 - RNA, 21 nt, Artificial Sequence
  Marburg virus siRNA sense strand
aacaguuucugagauaucaag

SEQ ID NO: 21674 - RNA, 21 nt, Artificial Sequence
  Marburg virus siRNA sense strand
acaguuucugagauaucaaga

SEQ ID NO: 21675 - RNA, 21 nt, Artificial Sequence
  Marburg virus siRNA sense strand
caguuucugagauaucaagaa

SEQ ID NO: 21676 - RNA, 21 nt, Artificial Sequence
  Marburg virus siRNA sense strand
aguuucugagauaucaagaac

SEQ ID NO: 21677 - RNA, 21 nt, Artificial Sequence
  Marburg virus siRNA sense strand
guuucugagauaucaagaacu

SEQ ID NO: 21678 - RNA, 21 nt, Artificial Sequence
  Marburg virus siRNA sense strand
uuucugagauaucaagaacug

SEQ ID NO: 21679 - RNA, 21 nt, Artificial Sequence
  Marburg virus siRNA sense strand
uucugagauaucaagaacugc

SEQ ID NO: 21680 - RNA, 21 nt, Artificial Sequence
  Marburg virus siRNA sense strand
ucugagauaucaagaacugcc

SEQ ID NO: 21681 - RNA, 21 nt, Artificial Sequence
  Marburg virus siRNA sense strand
cugagauaucaagaacugccu

SEQ ID NO: 21682 - RNA, 21 nt, Artificial Sequence
  Marburg virus siRNA sense strand
ugagauaucaagaacugccuc

SEQ ID NO: 21683 - RNA, 21 nt, Artificial Sequence
  Marburg virus siRNA sense strand
gagauaucaagaacugccucc

SEQ ID NO: 21684 - RNA, 21 nt, Artificial Sequence
  Marburg virus siRNA sense strand
agauaucaagaacugccuccg

SEQ ID NO: 21685 - RNA, 21 nt, Artificial Sequence
  Marburg virus siRNA sense strand
gauaucaagaacugccuccgg

SEQ ID NO: 21686 - RNA, 21 nt, Artificial Sequence
  Marburg virus siRNA sense strand
auaucaagaacugccuccggu

SEQ ID NO: 21687 - RNA, 21 nt, Artificial Sequence
  Marburg virus siRNA sense strand
uaucaagaacugccuccgguu

SEQ ID NO: 21688 - RNA, 21 nt, Artificial Sequence
  Marburg virus siRNA sense strand
aucaagaacugccuccgguuc

SEQ ID NO: 21689 - RNA, 21 nt, Artificial Sequence
  Marburg virus siRNA sense strand
ucaagaacugccuccgguuca

SEQ ID NO: 21690 - RNA, 21 nt, Artificial Sequence
  Marburg virus siRNA sense strand
caagaacugccuccgguucaa

SEQ ID NO: 21691 - RNA, 21 nt, Artificial Sequence
  Marburg virus siRNA sense strand
aagaacugccuccgguucaag

SEQ ID NO: 21692 - RNA, 21 nt, Artificial Sequence
  Marburg virus siRNA sense strand
agaacugccuccgguucaaga

SEQ ID NO: 21693 - RNA, 21 nt, Artificial Sequence
  Marburg virus siRNA sense strand
gaacugccuccgguucaagag

SEQ ID NO: 21694 - RNA, 21 nt, Artificial Sequence
  Marburg virus siRNA sense strand
aacugccuccgguucaagagg

SEQ ID NO: 21695 - RNA, 21 nt, Artificial Sequence
  Marburg virus siRNA sense strand
acugccuccgguucaagagga

SEQ ID NO: 21696 - RNA, 21 nt, Artificial Sequence
  Marburg virus siRNA sense strand
cugccuccgguucaagaggau

SEQ ID NO: 21697 - RNA, 21 nt, Artificial Sequence
  Marburg virus siRNA sense strand
ugccuccgguucaagaggaug

SEQ ID NO: 21698 - RNA, 21 nt, Artificial Sequence
  Marburg virus siRNA sense strand
gccuccgguucaagaggauga

SEQ ID NO: 21699 - RNA, 21 nt, Artificial Sequence
  Marburg virus siRNA sense strand
ccuccgguucaagaggaugau

SEQ ID NO: 21700 - RNA, 21 nt, Artificial Sequence
  Marburg virus siRNA sense strand
cuccgguucaagaggaugaug

SEQ ID NO: 21701 - RNA, 21 nt, Artificial Sequence
  Marburg virus siRNA sense strand
uccgguucaagaggaugauga

SEQ ID NO: 21702 - RNA, 21 nt, Artificial Sequence
  Marburg virus siRNA sense strand
ccgguucaagaggaugaugaa

SEQ ID NO: 21703 - RNA, 21 nt, Artificial Sequence
  Marburg virus siRNA sense strand
cgguucaagaggaugaugaau

SEQ ID NO: 21704 - RNA, 21 nt, Artificial Sequence
  Marburg virus siRNA sense strand
gguucaagaggaugaugaauc

SEQ ID NO: 21705 - RNA, 21 nt, Artificial Sequence
  Marburg virus siRNA sense strand
guucaagaggaugaugaaucg

SEQ ID NO: 21706 - RNA, 21 nt, Artificial Sequence
  Marburg virus siRNA sense strand
uucaagaggaugaugaaucgg

SEQ ID NO: 21707 - RNA, 21 nt, Artificial Sequence
  Marburg virus siRNA sense strand
ucaagaggaugaugaaucgga

SEQ ID NO: 21708 - RNA, 21 nt, Artificial Sequence
  Marburg virus siRNA sense strand
caagaggaugaugaaucggaa

SEQ ID NO: 21709 - RNA, 21 nt, Artificial Sequence
  Marburg virus siRNA sense strand
aagaggaugaugaaucggaau

SEQ ID NO: 21710 - RNA, 21 nt, Artificial Sequence
  Marburg virus siRNA sense strand
agaggaugaugaaucggaaua

SEQ ID NO: 21711 - RNA, 21 nt, Artificial Sequence
  Marburg virus siRNA sense strand
gaggaugaugaaucggaauac

SEQ ID NO: 21712 - RNA, 21 nt, Artificial Sequence
  Marburg virus siRNA sense strand
aggaugaugaaucggaauaca

SEQ ID NO: 21713 - RNA, 21 nt, Artificial Sequence
  Marburg virus siRNA sense strand
ggaugaugaaucggaauacac

SEQ ID NO: 21714 - RNA, 21 nt, Artificial Sequence
  Marburg virus siRNA sense strand
gaugaugaaucggaauacaca

SEQ ID NO: 21715 - RNA, 21 nt, Artificial Sequence
  Marburg virus siRNA sense strand
augaugaaucggaauacacaa

SEQ ID NO: 21716 - RNA, 21 nt, Artificial Sequence
  Marburg virus siRNA sense strand
ugaugaaucggaauacacaac

SEQ ID NO: 21717 - RNA, 21 nt, Artificial Sequence
  Marburg virus siRNA sense strand
gaugaaucggaauacacaacc

SEQ ID NO: 21718 - RNA, 21 nt, Artificial Sequence
  Marburg virus siRNA sense strand
augaaucggaauacacaaccg

SEQ ID NO: 21719 - RNA, 21 nt, Artificial Sequence
  Marburg virus siRNA sense strand
ugaaucggaauacacaaccga

SEQ ID NO: 21720 - RNA, 21 nt, Artificial Sequence
  Marburg virus siRNA sense strand
gaaucggaauacacaaccgac

SEQ ID NO: 21721 - RNA, 21 nt, Artificial Sequence
  Marburg virus siRNA sense strand
aaucggaauacacaaccgacu

SEQ ID NO: 21722 - RNA, 21 nt, Artificial Sequence
  Marburg virus siRNA sense strand
aucggaauacacaaccgacuc

SEQ ID NO: 21723 - RNA, 21 nt, Artificial Sequence
  Marburg virus siRNA sense strand
ucggaauacacaaccgacucu

SEQ ID NO: 21724 - RNA, 21 nt, Artificial Sequence
  Marburg virus siRNA sense strand
cggaauacacaaccgacucuc

SEQ ID NO: 21725 - RNA, 21 nt, Artificial Sequence
  Marburg virus siRNA sense strand
ggaauacacaaccgacucuca

SEQ ID NO: 21726 - RNA, 21 nt, Artificial Sequence
  Marburg virus siRNA sense strand
gaauacacaaccgacucucag

SEQ ID NO: 21727 - RNA, 21 nt, Artificial Sequence
  Marburg virus siRNA sense strand
aauacacaaccgacucucagg

SEQ ID NO: 21728 - RNA, 21 nt, Artificial Sequence
  Marburg virus siRNA sense strand
auacacaaccgacucucagga

SEQ ID NO: 21729 - RNA, 21 nt, Artificial Sequence
  Marburg virus siRNA sense strand
uacacaaccgacucucaggag

SEQ ID NO: 21730 - RNA, 21 nt, Artificial Sequence
  Marburg virus siRNA sense strand
acacaaccgacucucaggaga

SEQ ID NO: 21731 - RNA, 21 nt, Artificial Sequence
  Marburg virus siRNA sense strand
cacaaccgacucucaggagag

SEQ ID NO: 21732 - RNA, 21 nt, Artificial Sequence
  Marburg virus siRNA sense strand
acaaccgacucucaggagagu

SEQ ID NO: 21733 - RNA, 21 nt, Artificial Sequence
  Marburg virus siRNA sense strand
caaccgacucucaggagagua

SEQ ID NO: 21734 - RNA, 21 nt, Artificial Sequence
  Marburg virus siRNA sense strand
aaccgacucucaggagaguau

SEQ ID NO: 21735 - RNA, 21 nt, Artificial Sequence
  Marburg virus siRNA sense strand
accgacucucaggagaguauc

SEQ ID NO: 21736 - RNA, 21 nt, Artificial Sequence
  Marburg virus siRNA sense strand
ccgacucucaggagaguaucg

SEQ ID NO: 21737 - RNA, 21 nt, Artificial Sequence
  Marburg virus siRNA sense strand
cgacucucaggagaguaucga

SEQ ID NO: 21738 - RNA, 21 nt, Artificial Sequence
  Marburg virus siRNA sense strand
gacucucaggagaguaucgac

SEQ ID NO: 21739 - RNA, 21 nt, Artificial Sequence
  Marburg virus siRNA sense strand
acucucaggagaguaucgacc

SEQ ID NO: 21740 - RNA, 21 nt, Artificial Sequence
  Marburg virus siRNA sense strand
cucucaggagaguaucgacca

SEQ ID NO: 21741 - RNA, 21 nt, Artificial Sequence
  Marburg virus siRNA sense strand
ucucaggagaguaucgaccaa

SEQ ID NO: 21742 - RNA, 21 nt, Artificial Sequence
  Marburg virus siRNA sense strand
cucaggagaguaucgaccaac

SEQ ID NO: 21743 - RNA, 21 nt, Artificial Sequence
  Marburg virus siRNA sense strand
ucaggagaguaucgaccaacc

SEQ ID NO: 21744 - RNA, 21 nt, Artificial Sequence
  Marburg virus siRNA sense strand
caggagaguaucgaccaacca

SEQ ID NO: 21745 - RNA, 21 nt, Artificial Sequence
  Marburg virus siRNA sense strand
aggagaguaucgaccaaccag

SEQ ID NO: 21746 - RNA, 21 nt, Artificial Sequence
  Marburg virus siRNA sense strand
ggagaguaucgaccaaccagg

SEQ ID NO: 21747 - RNA, 21 nt, Artificial Sequence
  Marburg virus siRNA sense strand
gagaguaucgaccaaccagga

SEQ ID NO: 21748 - RNA, 21 nt, Artificial Sequence
  Marburg virus siRNA sense strand
agaguaucgaccaaccaggau

SEQ ID NO: 21749 - RNA, 21 nt, Artificial Sequence
  Marburg virus siRNA sense strand
gaguaucgaccaaccaggauc

SEQ ID NO: 21750 - RNA, 21 nt, Artificial Sequence
  Marburg virus siRNA sense strand
aguaucgaccaaccaggaucu

SEQ ID NO: 21751 - RNA, 21 nt, Artificial Sequence
  Marburg virus siRNA sense strand
guaucgaccaaccaggaucug

SEQ ID NO: 21752 - RNA, 21 nt, Artificial Sequence
  Marburg virus siRNA sense strand
uaucgaccaaccaggaucuga

SEQ ID NO: 21753 - RNA, 21 nt, Artificial Sequence
  Marburg virus siRNA sense strand
aucgaccaaccaggaucugac

SEQ ID NO: 21754 - RNA, 21 nt, Artificial Sequence
  Marburg virus siRNA sense strand
ucgaccaaccaggaucugaca

SEQ ID NO: 21755 - RNA, 21 nt, Artificial Sequence
  Marburg virus siRNA sense strand
cgaccaaccaggaucugacaa

SEQ ID NO: 21756 - RNA, 21 nt, Artificial Sequence
  Marburg virus siRNA sense strand
gaccaaccaggaucugacaau

SEQ ID NO: 21757 - RNA, 21 nt, Artificial Sequence
  Marburg virus siRNA sense strand
accaaccaggaucugacaaug

SEQ ID NO: 21758 - RNA, 21 nt, Artificial Sequence
  Marburg virus siRNA sense strand
ccaaccaggaucugacaauga

SEQ ID NO: 21759 - RNA, 21 nt, Artificial Sequence
  Marburg virus siRNA sense strand
caaccaggaucugacaaugaa

SEQ ID NO: 21760 - RNA, 21 nt, Artificial Sequence
  Marburg virus siRNA sense strand
aaccaggaucugacaaugaac

SEQ ID NO: 21761 - RNA, 21 nt, Artificial Sequence
  Marburg virus siRNA sense strand
accaggaucugacaaugaaca

SEQ ID NO: 21762 - RNA, 21 nt, Artificial Sequence
  Marburg virus siRNA sense strand
ccaggaucugacaaugaacaa

SEQ ID NO: 21763 - RNA, 21 nt, Artificial Sequence
  Marburg virus siRNA sense strand
caggaucugacaaugaacaag

SEQ ID NO: 21764 - RNA, 21 nt, Artificial Sequence
  Marburg virus siRNA sense strand
aggaucugacaaugaacaagg

SEQ ID NO: 21765 - RNA, 21 nt, Artificial Sequence
  Marburg virus siRNA sense strand
ggaucugacaaugaacaagga

SEQ ID NO: 21766 - RNA, 21 nt, Artificial Sequence
  Marburg virus siRNA sense strand
gaucugacaaugaacaaggag

SEQ ID NO: 21767 - RNA, 21 nt, Artificial Sequence
  Marburg virus siRNA sense strand
aucugacaaugaacaaggagu

SEQ ID NO: 21768 - RNA, 21 nt, Artificial Sequence
  Marburg virus siRNA sense strand
ucugacaaugaacaaggaguu

SEQ ID NO: 21769 - RNA, 21 nt, Artificial Sequence
  Marburg virus siRNA sense strand
cugacaaugaacaaggaguug

SEQ ID NO: 21770 - RNA, 21 nt, Artificial Sequence
  Marburg virus siRNA sense strand
ugacaaugaacaaggaguuga

SEQ ID NO: 21771 - RNA, 21 nt, Artificial Sequence
  Marburg virus siRNA sense strand
gacaaugaacaaggaguugau

SEQ ID NO: 21772 - RNA, 21 nt, Artificial Sequence
  Marburg virus siRNA sense strand
acaaugaacaaggaguugauc

SEQ ID NO: 21773 - RNA, 21 nt, Artificial Sequence
  Marburg virus siRNA sense strand
caaugaacaaggaguugaucu

SEQ ID NO: 21774 - RNA, 21 nt, Artificial Sequence
  Marburg virus siRNA sense strand
aaugaacaaggaguugaucuu

SEQ ID NO: 21775 - RNA, 21 nt, Artificial Sequence
  Marburg virus siRNA sense strand
augaacaaggaguugaucuuc

SEQ ID NO: 21776 - RNA, 21 nt, Artificial Sequence
  Marburg virus siRNA sense strand
ugaacaaggaguugaucuucc

SEQ ID NO: 21777 - RNA, 21 nt, Artificial Sequence
  Marburg virus siRNA sense strand
gaacaaggaguugaucuucca

SEQ ID NO: 21778 - RNA, 21 nt, Artificial Sequence
  Marburg virus siRNA sense strand
aacaaggaguugaucuuccac

SEQ ID NO: 21779 - RNA, 21 nt, Artificial Sequence
  Marburg virus siRNA sense strand
acaaggaguugaucuuccacc

SEQ ID NO: 21780 - RNA, 21 nt, Artificial Sequence
  Marburg virus siRNA sense strand
caaggaguugaucuuccaccu

SEQ ID NO: 21781 - RNA, 21 nt, Artificial Sequence
  Marburg virus siRNA sense strand
aaggaguugaucuuccaccuc

SEQ ID NO: 21782 - RNA, 21 nt, Artificial Sequence
  Marburg virus siRNA sense strand
aggaguugaucuuccaccucc

SEQ ID NO: 21783 - RNA, 21 nt, Artificial Sequence
  Marburg virus siRNA sense strand
ggaguugaucuuccaccuccu

SEQ ID NO: 21784 - RNA, 21 nt, Artificial Sequence
  Marburg virus siRNA sense strand
gaguugaucuuccaccuccuc

SEQ ID NO: 21785 - RNA, 21 nt, Artificial Sequence
  Marburg virus siRNA sense strand
aguugaucuuccaccuccucc

SEQ ID NO: 21786 - RNA, 21 nt, Artificial Sequence
  Marburg virus siRNA sense strand
guugaucuuccaccuccucca

SEQ ID NO: 21787 - RNA, 21 nt, Artificial Sequence
  Marburg virus siRNA sense strand
uugaucuuccaccuccuccau

SEQ ID NO: 21788 - RNA, 21 nt, Artificial Sequence
  Marburg virus siRNA sense strand
ugaucuuccaccuccuccauu

SEQ ID NO: 21789 - RNA, 21 nt, Artificial Sequence
  Marburg virus siRNA sense strand
gaucuuccaccuccuccauug

SEQ ID NO: 21790 - RNA, 21 nt, Artificial Sequence
  Marburg virus siRNA sense strand
aucuuccaccuccuccauugu

SEQ ID NO: 21791 - RNA, 21 nt, Artificial Sequence
  Marburg virus siRNA sense strand
ucuuccaccuccuccauugua

SEQ ID NO: 21792 - RNA, 21 nt, Artificial Sequence
  Marburg virus siRNA sense strand
cuuccaccuccuccauuguac

SEQ ID NO: 21793 - RNA, 21 nt, Artificial Sequence
  Marburg virus siRNA sense strand
uuccaccuccuccauuguacg

SEQ ID NO: 21794 - RNA, 21 nt, Artificial Sequence
  Marburg virus siRNA sense strand
uccaccuccuccauuguacgc

SEQ ID NO: 21795 - RNA, 21 nt, Artificial Sequence
  Marburg virus siRNA sense strand
ccaccuccuccauuguacgcu

SEQ ID NO: 21796 - RNA, 21 nt, Artificial Sequence
  Marburg virus siRNA sense strand
caccuccuccauuguacgcuc

SEQ ID NO: 21797 - RNA, 21 nt, Artificial Sequence
  Marburg virus siRNA sense strand
accuccuccauuguacgcuca

SEQ ID NO: 21798 - RNA, 21 nt, Artificial Sequence
  Marburg virus siRNA sense strand
ccuccuccauuguacgcucag

SEQ ID NO: 21799 - RNA, 21 nt, Artificial Sequence
  Marburg virus siRNA sense strand
cuccuccauuguacgcucagg

SEQ ID NO: 21800 - RNA, 21 nt, Artificial Sequence
  Marburg virus siRNA sense strand
uccuccauuguacgcucagga

SEQ ID NO: 21801 - RNA, 21 nt, Artificial Sequence
  Marburg virus siRNA sense strand
ccuccauuguacgcucaggaa

SEQ ID NO: 21802 - RNA, 21 nt, Artificial Sequence
  Marburg virus siRNA sense strand
cuccauuguacgcucaggaaa

SEQ ID NO: 21803 - RNA, 21 nt, Artificial Sequence
  Marburg virus siRNA sense strand
uccauuguacgcucaggaaaa

SEQ ID NO: 21804 - RNA, 21 nt, Artificial Sequence
  Marburg virus siRNA sense strand
ccauuguacgcucaggaaaaa

SEQ ID NO: 21805 - RNA, 21 nt, Artificial Sequence
  Marburg virus siRNA sense strand
cauuguacgcucaggaaaaaa

SEQ ID NO: 21806 - RNA, 21 nt, Artificial Sequence
  Marburg virus siRNA sense strand
auuguacgcucaggaaaaaag

SEQ ID NO: 21807 - RNA, 21 nt, Artificial Sequence
  Marburg virus siRNA sense strand
uuguacgcucaggaaaaaagg

SEQ ID NO: 21808 - RNA, 21 nt, Artificial Sequence
  Marburg virus siRNA sense strand
uguacgcucaggaaaaaaggc

SEQ ID NO: 21809 - RNA, 21 nt, Artificial Sequence
  Marburg virus siRNA sense strand
guacgcucaggaaaaaaggca

SEQ ID NO: 21810 - RNA, 21 nt, Artificial Sequence
  Marburg virus siRNA sense strand
uacgcucaggaaaaaaggcaa

SEQ ID NO: 21811 - RNA, 21 nt, Artificial Sequence
  Marburg virus siRNA sense strand
acgcucaggaaaaaaggcaag

SEQ ID NO: 21812 - RNA, 21 nt, Artificial Sequence
  Marburg virus siRNA sense strand
cgcucaggaaaaaaggcaaga

SEQ ID NO: 21813 - RNA, 21 nt, Artificial Sequence
  Marburg virus siRNA sense strand
gcucaggaaaaaaggcaagau

SEQ ID NO: 21814 - RNA, 21 nt, Artificial Sequence
  Marburg virus siRNA sense strand
cucaggaaaaaaggcaagauc

SEQ ID NO: 21815 - RNA, 21 nt, Artificial Sequence
  Marburg virus siRNA sense strand
ucaggaaaaaaggcaagaucc

SEQ ID NO: 21816 - RNA, 21 nt, Artificial Sequence
  Marburg virus siRNA sense strand
caggaaaaaaggcaagaucca

SEQ ID NO: 21817 - RNA, 21 nt, Artificial Sequence
  Marburg virus siRNA sense strand
aggaaaaaaggcaagauccaa

SEQ ID NO: 21818 - RNA, 21 nt, Artificial Sequence
  Marburg virus siRNA sense strand
ggaaaaaaggcaagauccaau

SEQ ID NO: 21819 - RNA, 21 nt, Artificial Sequence
  Marburg virus siRNA sense strand
gaaaaaaggcaagauccaaua

SEQ ID NO: 21820 - RNA, 21 nt, Artificial Sequence
  Marburg virus siRNA sense strand
aaaaaaggcaagauccaauac

SEQ ID NO: 21821 - RNA, 21 nt, Artificial Sequence
  Marburg virus siRNA sense strand
aaaaaggcaagauccaauaca

SEQ ID NO: 21822 - RNA, 21 nt, Artificial Sequence
  Marburg virus siRNA sense strand
aaaaggcaagauccaauacag

SEQ ID NO: 21823 - RNA, 21 nt, Artificial Sequence
  Marburg virus siRNA sense strand
aaaggcaagauccaauacagc

SEQ ID NO: 21824 - RNA, 21 nt, Artificial Sequence
  Marburg virus siRNA sense strand
aaggcaagauccaauacagca

SEQ ID NO: 21825 - RNA, 21 nt, Artificial Sequence
  Marburg virus siRNA sense strand
aggcaagauccaauacagcac

SEQ ID NO: 21826 - RNA, 21 nt, Artificial Sequence
  Marburg virus siRNA sense strand
ggcaagauccaauacagcacc

SEQ ID NO: 21827 - RNA, 21 nt, Artificial Sequence
  Marburg virus siRNA sense strand
gcaagauccaauacagcaccc

SEQ ID NO: 21828 - RNA, 21 nt, Artificial Sequence
  Marburg virus siRNA sense strand
caagauccaauacagcaccca

SEQ ID NO: 21829 - RNA, 21 nt, Artificial Sequence
  Marburg virus siRNA sense strand
aagauccaauacagcacccag

SEQ ID NO: 21830 - RNA, 21 nt, Artificial Sequence
  Marburg virus siRNA sense strand
agauccaauacagcacccagc

SEQ ID NO: 21831 - RNA, 21 nt, Artificial Sequence
  Marburg virus siRNA sense strand
gauccaauacagcacccagca

SEQ ID NO: 21832 - RNA, 21 nt, Artificial Sequence
  Marburg virus siRNA sense strand
auccaauacagcacccagcag

SEQ ID NO: 21833 - RNA, 21 nt, Artificial Sequence
  Marburg virus siRNA sense strand
uccaauacagcacccagcagu

SEQ ID NO: 21834 - RNA, 21 nt, Artificial Sequence
  Marburg virus siRNA sense strand
ccaauacagcacccagcagua

SEQ ID NO: 21835 - RNA, 21 nt, Artificial Sequence
  Marburg virus siRNA sense strand
caauacagcacccagcaguaa

SEQ ID NO: 21836 - RNA, 21 nt, Artificial Sequence
  Marburg virus siRNA sense strand
aauacagcacccagcaguaag

SEQ ID NO: 21837 - RNA, 21 nt, Artificial Sequence
  Marburg virus siRNA sense strand
auacagcacccagcaguaagc

SEQ ID NO: 21838 - RNA, 21 nt, Artificial Sequence
  Marburg virus siRNA sense strand
uacagcacccagcaguaagcu

SEQ ID NO: 21839 - RNA, 21 nt, Artificial Sequence
  Marburg virus siRNA sense strand
acagcacccagcaguaagcuc

SEQ ID NO: 21840 - RNA, 21 nt, Artificial Sequence
  Marburg virus siRNA sense strand
cagcacccagcaguaagcucu

SEQ ID NO: 21841 - RNA, 21 nt, Artificial Sequence
  Marburg virus siRNA sense strand
agcacccagcaguaagcucuc

SEQ ID NO: 21842 - RNA, 21 nt, Artificial Sequence
  Marburg virus siRNA sense strand
gcacccagcaguaagcucuca

SEQ ID NO: 21843 - RNA, 21 nt, Artificial Sequence
  Marburg virus siRNA sense strand
cacccagcaguaagcucucag

SEQ ID NO: 21844 - RNA, 21 nt, Artificial Sequence
  Marburg virus siRNA sense strand
acccagcaguaagcucucagg

SEQ ID NO: 21845 - RNA, 21 nt, Artificial Sequence
  Marburg virus siRNA sense strand
cccagcaguaagcucucagga

SEQ ID NO: 21846 - RNA, 21 nt, Artificial Sequence
  Marburg virus siRNA sense strand
ccagcaguaagcucucaggau

SEQ ID NO: 21847 - RNA, 21 nt, Artificial Sequence
  Marburg virus siRNA sense strand
cagcaguaagcucucaggauc

SEQ ID NO: 21848 - RNA, 21 nt, Artificial Sequence
  Marburg virus siRNA sense strand
agcaguaagcucucaggaucc

SEQ ID NO: 21849 - RNA, 21 nt, Artificial Sequence
  Marburg virus siRNA sense strand
gcaguaagcucucaggauccc

SEQ ID NO: 21850 - RNA, 21 nt, Artificial Sequence
  Marburg virus siRNA sense strand
caguaagcucucaggaucccu

SEQ ID NO: 21851 - RNA, 21 nt, Artificial Sequence
  Marburg virus siRNA sense strand
aguaagcucucaggaucccuu

SEQ ID NO: 21852 - RNA, 21 nt, Artificial Sequence
  Marburg virus siRNA sense strand
guaagcucucaggaucccuuu

SEQ ID NO: 21853 - RNA, 21 nt, Artificial Sequence
  Marburg virus siRNA sense strand
uaagcucucaggaucccuuug

SEQ ID NO: 21854 - RNA, 21 nt, Artificial Sequence
  Marburg virus siRNA sense strand
aagcucucaggaucccuuugg

SEQ ID NO: 21855 - RNA, 21 nt, Artificial Sequence
  Marburg virus siRNA sense strand
agcucucaggaucccuuuggc

SEQ ID NO: 21856 - RNA, 21 nt, Artificial Sequence
  Marburg virus siRNA sense strand
gcucucaggaucccuuuggca

SEQ ID NO: 21857 - RNA, 21 nt, Artificial Sequence
  Marburg virus siRNA sense strand
cucucaggaucccuuuggcag

SEQ ID NO: 21858 - RNA, 21 nt, Artificial Sequence
  Marburg virus siRNA sense strand
ucucaggaucccuuuggcagu

SEQ ID NO: 21859 - RNA, 21 nt, Artificial Sequence
  Marburg virus siRNA sense strand
cucaggaucccuuuggcagua

SEQ ID NO: 21860 - RNA, 21 nt, Artificial Sequence
  Marburg virus siRNA sense strand
ucaggaucccuuuggcaguau

SEQ ID NO: 21861 - RNA, 21 nt, Artificial Sequence
  Marburg virus siRNA sense strand
caggaucccuuuggcaguauu

SEQ ID NO: 21862 - RNA, 21 nt, Artificial Sequence
  Marburg virus siRNA sense strand
aggaucccuuuggcaguauug

SEQ ID NO: 21863 - RNA, 21 nt, Artificial Sequence
  Marburg virus siRNA sense strand
ggaucccuuuggcaguauugg

SEQ ID NO: 21864 - RNA, 21 nt, Artificial Sequence
  Marburg virus siRNA sense strand
gaucccuuuggcaguauuggu

SEQ ID NO: 21865 - RNA, 21 nt, Artificial Sequence
  Marburg virus siRNA sense strand
aucccuuuggcaguauuggug

SEQ ID NO: 21866 - RNA, 21 nt, Artificial Sequence
  Marburg virus siRNA sense strand
ucccuuuggcaguauugguga

SEQ ID NO: 21867 - RNA, 21 nt, Artificial Sequence
  Marburg virus siRNA sense strand
cccuuuggcaguauuggugau

SEQ ID NO: 21868 - RNA, 21 nt, Artificial Sequence
  Marburg virus siRNA sense strand
ccuuuggcaguauuggugaug

SEQ ID NO: 21869 - RNA, 21 nt, Artificial Sequence
  Marburg virus siRNA sense strand
cuuuggcaguauuggugaugu

SEQ ID NO: 21870 - RNA, 21 nt, Artificial Sequence
  Marburg virus siRNA sense strand
uuuggcaguauuggugaugua

SEQ ID NO: 21871 - RNA, 21 nt, Artificial Sequence
  Marburg virus siRNA sense strand
uuggcaguauuggugauguaa

SEQ ID NO: 21872 - RNA, 21 nt, Artificial Sequence
  Marburg virus siRNA sense strand
uggcaguauuggugauguaaa

SEQ ID NO: 21873 - RNA, 21 nt, Artificial Sequence
  Marburg virus siRNA sense strand
ggcaguauuggugauguaaau

SEQ ID NO: 21874 - RNA, 21 nt, Artificial Sequence
  Marburg virus siRNA sense strand
gcaguauuggugauguaaaug

SEQ ID NO: 21875 - RNA, 21 nt, Artificial Sequence
  Marburg virus siRNA sense strand
caguauuggugauguaaaugg

SEQ ID NO: 21876 - RNA, 21 nt, Artificial Sequence
  Marburg virus siRNA sense strand
aguauuggugauguaaauggu

SEQ ID NO: 21877 - RNA, 21 nt, Artificial Sequence
  Marburg virus siRNA sense strand
guauuggugauguaaauggug

SEQ ID NO: 21878 - RNA, 21 nt, Artificial Sequence
  Marburg virus siRNA sense strand
uauuggugauguaaaugguga

SEQ ID NO: 21879 - RNA, 21 nt, Artificial Sequence
  Marburg virus siRNA sense strand
auuggugauguaaauggugau

SEQ ID NO: 21880 - RNA, 21 nt, Artificial Sequence
  Marburg virus siRNA sense strand
uuggugauguaaauggugaua

SEQ ID NO: 21881 - RNA, 21 nt, Artificial Sequence
  Marburg virus siRNA sense strand
uggugauguaaauggugauau

SEQ ID NO: 21882 - RNA, 21 nt, Artificial Sequence
  Marburg virus siRNA sense strand
ggugauguaaauggugauauc

SEQ ID NO: 21883 - RNA, 21 nt, Artificial Sequence
  Marburg virus siRNA sense strand
gugauguaaauggugauaucu

SEQ ID NO: 21884 - RNA, 21 nt, Artificial Sequence
  Marburg virus siRNA sense strand
ugauguaaauggugauaucuu

SEQ ID NO: 21885 - RNA, 21 nt, Artificial Sequence
  Marburg virus siRNA sense strand
gauguaaauggugauaucuua

SEQ ID NO: 21886 - RNA, 21 nt, Artificial Sequence
  Marburg virus siRNA sense strand
auguaaauggugauaucuuag

SEQ ID NO: 21887 - RNA, 21 nt, Artificial Sequence
  Marburg virus siRNA sense strand
uguaaauggugauaucuuaga

SEQ ID NO: 21888 - RNA, 21 nt, Artificial Sequence
  Marburg virus siRNA sense strand
guaaauggugauaucuuagaa

SEQ ID NO: 21889 - RNA, 21 nt, Artificial Sequence
  Marburg virus siRNA sense strand
uaaauggugauaucuuagaac

SEQ ID NO: 21890 - RNA, 21 nt, Artificial Sequence
  Marburg virus siRNA sense strand
aaauggugauaucuuagaacc

SEQ ID NO: 21891 - RNA, 21 nt, Artificial Sequence
  Marburg virus siRNA sense strand
aauggugauaucuuagaaccc

SEQ ID NO: 21892 - RNA, 21 nt, Artificial Sequence
  Marburg virus siRNA sense strand
auggugauaucuuagaaccca

SEQ ID NO: 21893 - RNA, 21 nt, Artificial Sequence
  Marburg virus siRNA sense strand
uggugauaucuuagaacccau

SEQ ID NO: 21894 - RNA, 21 nt, Artificial Sequence
  Marburg virus siRNA sense strand
ggugauaucuuagaacccaua

SEQ ID NO: 21895 - RNA, 21 nt, Artificial Sequence
  Marburg virus siRNA sense strand
gugauaucuuagaacccauaa

SEQ ID NO: 21896 - RNA, 21 nt, Artificial Sequence
  Marburg virus siRNA sense strand
ugauaucuuagaacccauaag

SEQ ID NO: 21897 - RNA, 21 nt, Artificial Sequence
  Marburg virus siRNA sense strand
gauaucuuagaacccauaaga

SEQ ID NO: 21898 - RNA, 21 nt, Artificial Sequence
  Marburg virus siRNA sense strand
auaucuuagaacccauaagau

SEQ ID NO: 21899 - RNA, 21 nt, Artificial Sequence
  Marburg virus siRNA sense strand
uaucuuagaacccauaagauc

SEQ ID NO: 21900 - RNA, 21 nt, Artificial Sequence
  Marburg virus siRNA sense strand
aucuuagaacccauaagauca

SEQ ID NO: 21901 - RNA, 21 nt, Artificial Sequence
  Marburg virus siRNA sense strand
ucuuagaacccauaagaucac

SEQ ID NO: 21902 - RNA, 21 nt, Artificial Sequence
  Marburg virus siRNA sense strand
cuuagaacccauaagaucacc

SEQ ID NO: 21903 - RNA, 21 nt, Artificial Sequence
  Marburg virus siRNA sense strand
uuagaacccauaagaucaccu

SEQ ID NO: 21904 - RNA, 21 nt, Artificial Sequence
  Marburg virus siRNA sense strand
uagaacccauaagaucaccuu

SEQ ID NO: 21905 - RNA, 21 nt, Artificial Sequence
  Marburg virus siRNA sense strand
agaacccauaagaucaccuuc

SEQ ID NO: 21906 - RNA, 21 nt, Artificial Sequence
  Marburg virus siRNA sense strand
gaacccauaagaucaccuucu

SEQ ID NO: 21907 - RNA, 21 nt, Artificial Sequence
  Marburg virus siRNA sense strand
aacccauaagaucaccuucuu

SEQ ID NO: 21908 - RNA, 21 nt, Artificial Sequence
  Marburg virus siRNA sense strand
acccauaagaucaccuucuuc

SEQ ID NO: 21909 - RNA, 21 nt, Artificial Sequence
  Marburg virus siRNA sense strand
cccauaagaucaccuucuuca

SEQ ID NO: 21910 - RNA, 21 nt, Artificial Sequence
  Marburg virus siRNA sense strand
ccauaagaucaccuucuucac

SEQ ID NO: 21911 - RNA, 21 nt, Artificial Sequence
  Marburg virus siRNA sense strand
cauaagaucaccuucuucacc

SEQ ID NO: 21912 - RNA, 21 nt, Artificial Sequence
  Marburg virus siRNA sense strand
auaagaucaccuucuucacca

SEQ ID NO: 21913 - RNA, 21 nt, Artificial Sequence
  Marburg virus siRNA sense strand
uaagaucaccuucuucaccau

SEQ ID NO: 21914 - RNA, 21 nt, Artificial Sequence
  Marburg virus siRNA sense strand
aagaucaccuucuucaccauc

SEQ ID NO: 21915 - RNA, 21 nt, Artificial Sequence
  Marburg virus siRNA sense strand
agaucaccuucuucaccaucu

SEQ ID NO: 21916 - RNA, 21 nt, Artificial Sequence
  Marburg virus siRNA sense strand
gaucaccuucuucaccaucug

SEQ ID NO: 21917 - RNA, 21 nt, Artificial Sequence
  Marburg virus siRNA sense strand
aucaccuucuucaccaucugc

SEQ ID NO: 21918 - RNA, 21 nt, Artificial Sequence
  Marburg virus siRNA sense strand
ucaccuucuucaccaucugcu

SEQ ID NO: 21919 - RNA, 21 nt, Artificial Sequence
  Marburg virus siRNA sense strand
caccuucuucaccaucugcuc

SEQ ID NO: 21920 - RNA, 21 nt, Artificial Sequence
  Marburg virus siRNA sense strand
accuucuucaccaucugcucc

SEQ ID NO: 21921 - RNA, 21 nt, Artificial Sequence
  Marburg virus siRNA sense strand
ccuucuucaccaucugcuccu

SEQ ID NO: 21922 - RNA, 21 nt, Artificial Sequence
  Marburg virus siRNA sense strand
cuucuucaccaucugcuccuc

SEQ ID NO: 21923 - RNA, 21 nt, Artificial Sequence
  Marburg virus siRNA sense strand
uucuucaccaucugcuccuca

SEQ ID NO: 21924 - RNA, 21 nt, Artificial Sequence
  Marburg virus siRNA sense strand
ucuucaccaucugcuccucag

SEQ ID NO: 21925 - RNA, 21 nt, Artificial Sequence
  Marburg virus siRNA sense strand
cuucaccaucugcuccucagg

SEQ ID NO: 21926 - RNA, 21 nt, Artificial Sequence
  Marburg virus siRNA sense strand
uucaccaucugcuccucagga

SEQ ID NO: 21927 - RNA, 21 nt, Artificial Sequence
  Marburg virus siRNA sense strand
ucaccaucugcuccucaggaa

SEQ ID NO: 21928 - RNA, 21 nt, Artificial Sequence
  Marburg virus siRNA sense strand
caccaucugcuccucaggaag

SEQ ID NO: 21929 - RNA, 21 nt, Artificial Sequence
  Marburg virus siRNA sense strand
accaucugcuccucaggaaga

SEQ ID NO: 21930 - RNA, 21 nt, Artificial Sequence
  Marburg virus siRNA sense strand
ccaucugcuccucaggaagac

SEQ ID NO: 21931 - RNA, 21 nt, Artificial Sequence
  Marburg virus siRNA sense strand
caucugcuccucaggaagaca

SEQ ID NO: 21932 - RNA, 21 nt, Artificial Sequence
  Marburg virus siRNA sense strand
aucugcuccucaggaagacac

SEQ ID NO: 21933 - RNA, 21 nt, Artificial Sequence
  Marburg virus siRNA sense strand
ucugcuccucaggaagacaca

SEQ ID NO: 21934 - RNA, 21 nt, Artificial Sequence
  Marburg virus siRNA sense strand
cugcuccucaggaagacacaa

SEQ ID NO: 21935 - RNA, 21 nt, Artificial Sequence
  Marburg virus siRNA sense strand
ugcuccucaggaagacacaag

SEQ ID NO: 21936 - RNA, 21 nt, Artificial Sequence
  Marburg virus siRNA sense strand
gcuccucaggaagacacaagg

SEQ ID NO: 21937 - RNA, 21 nt, Artificial Sequence
  Marburg virus siRNA sense strand
cuccucaggaagacacaaggg

SEQ ID NO: 21938 - RNA, 21 nt, Artificial Sequence
  Marburg virus siRNA sense strand
uccucaggaagacacaagggc

SEQ ID NO: 21939 - RNA, 21 nt, Artificial Sequence
  Marburg virus siRNA sense strand
ccucaggaagacacaagggca

SEQ ID NO: 21940 - RNA, 21 nt, Artificial Sequence
  Marburg virus siRNA sense strand
cucaggaagacacaagggcaa

SEQ ID NO: 21941 - RNA, 21 nt, Artificial Sequence
  Marburg virus siRNA sense strand
ucaggaagacacaagggcaag

SEQ ID NO: 21942 - RNA, 21 nt, Artificial Sequence
  Marburg virus siRNA sense strand
caggaagacacaagggcaaga

SEQ ID NO: 21943 - RNA, 21 nt, Artificial Sequence
  Marburg virus siRNA sense strand
aggaagacacaagggcaagag

SEQ ID NO: 21944 - RNA, 21 nt, Artificial Sequence
  Marburg virus siRNA sense strand
ggaagacacaagggcaagaga

SEQ ID NO: 21945 - RNA, 21 nt, Artificial Sequence
  Marburg virus siRNA sense strand
gaagacacaagggcaagagaa

SEQ ID NO: 21946 - RNA, 21 nt, Artificial Sequence
  Marburg virus siRNA sense strand
aagacacaagggcaagagaag

SEQ ID NO: 21947 - RNA, 21 nt, Artificial Sequence
  Marburg virus siRNA sense strand
agacacaagggcaagagaagc

SEQ ID NO: 21948 - RNA, 21 nt, Artificial Sequence
  Marburg virus siRNA sense strand
gacacaagggcaagagaagcc

SEQ ID NO: 21949 - RNA, 21 nt, Artificial Sequence
  Marburg virus siRNA sense strand
acacaagggcaagagaagccu

SEQ ID NO: 21950 - RNA, 21 nt, Artificial Sequence
  Marburg virus siRNA sense strand
cacaagggcaagagaagccua

SEQ ID NO: 21951 - RNA, 21 nt, Artificial Sequence
  Marburg virus siRNA sense strand
acaagggcaagagaagccuau

SEQ ID NO: 21952 - RNA, 21 nt, Artificial Sequence
  Marburg virus siRNA sense strand
caagggcaagagaagccuaug

SEQ ID NO: 21953 - RNA, 21 nt, Artificial Sequence
  Marburg virus siRNA sense strand
aagggcaagagaagccuauga

SEQ ID NO: 21954 - RNA, 21 nt, Artificial Sequence
  Marburg virus siRNA sense strand
agggcaagagaagccuaugaa

SEQ ID NO: 21955 - RNA, 21 nt, Artificial Sequence
  Marburg virus siRNA sense strand
gggcaagagaagccuaugaau

SEQ ID NO: 21956 - RNA, 21 nt, Artificial Sequence
  Marburg virus siRNA sense strand
ggcaagagaagccuaugaauu

SEQ ID NO: 21957 - RNA, 21 nt, Artificial Sequence
  Marburg virus siRNA sense strand
gcaagagaagccuaugaauug

SEQ ID NO: 21958 - RNA, 21 nt, Artificial Sequence
  Marburg virus siRNA sense strand
caagagaagccuaugaauugu

SEQ ID NO: 21959 - RNA, 21 nt, Artificial Sequence
  Marburg virus siRNA sense strand
aagagaagccuaugaauuguc

SEQ ID NO: 21960 - RNA, 21 nt, Artificial Sequence
  Marburg virus siRNA sense strand
agagaagccuaugaauugucg

SEQ ID NO: 21961 - RNA, 21 nt, Artificial Sequence
  Marburg virus siRNA sense strand
gagaagccuaugaauugucgc

SEQ ID NO: 21962 - RNA, 21 nt, Artificial Sequence
  Marburg virus siRNA sense strand
agaagccuaugaauugucgcc

SEQ ID NO: 21963 - RNA, 21 nt, Artificial Sequence
  Marburg virus siRNA sense strand
gaagccuaugaauugucgccu

SEQ ID NO: 21964 - RNA, 21 nt, Artificial Sequence
  Marburg virus siRNA sense strand
aagccuaugaauugucgccug

SEQ ID NO: 21965 - RNA, 21 nt, Artificial Sequence
  Marburg virus siRNA sense strand
agccuaugaauugucgccuga

SEQ ID NO: 21966 - RNA, 21 nt, Artificial Sequence
  Marburg virus siRNA sense strand
gccuaugaauugucgccugau

SEQ ID NO: 21967 - RNA, 21 nt, Artificial Sequence
  Marburg virus siRNA sense strand
ccuaugaauugucgccugauu

SEQ ID NO: 21968 - RNA, 21 nt, Artificial Sequence
  Marburg virus siRNA sense strand
cuaugaauugucgccugauuu

SEQ ID NO: 21969 - RNA, 21 nt, Artificial Sequence
  Marburg virus siRNA sense strand
uaugaauugucgccugauuuc

SEQ ID NO: 21970 - RNA, 21 nt, Artificial Sequence
  Marburg virus siRNA sense strand
augaauugucgccugauuuca

SEQ ID NO: 21971 - RNA, 21 nt, Artificial Sequence
  Marburg virus siRNA sense strand
ugaauugucgccugauuucac

SEQ ID NO: 21972 - RNA, 21 nt, Artificial Sequence
  Marburg virus siRNA sense strand
gaauugucgccugauuucaca

SEQ ID NO: 21973 - RNA, 21 nt, Artificial Sequence
  Marburg virus siRNA sense strand
aauugucgccugauuucacaa

SEQ ID NO: 21974 - RNA, 21 nt, Artificial Sequence
  Marburg virus siRNA sense strand
auugucgccugauuucacaaa

SEQ ID NO: 21975 - RNA, 21 nt, Artificial Sequence
  Marburg virus siRNA sense strand
uugucgccugauuucacaaau

SEQ ID NO: 21976 - RNA, 21 nt, Artificial Sequence
  Marburg virus siRNA sense strand
ugucgccugauuucacaaauu

SEQ ID NO: 21977 - RNA, 21 nt, Artificial Sequence
  Marburg virus siRNA sense strand
gucgccugauuucacaaauua

SEQ ID NO: 21978 - RNA, 21 nt, Artificial Sequence
  Marburg virus siRNA sense strand
ucgccugauuucacaaauuau

SEQ ID NO: 21979 - RNA, 21 nt, Artificial Sequence
  Marburg virus siRNA sense strand
cgccugauuucacaaauuaug

SEQ ID NO: 21980 - RNA, 21 nt, Artificial Sequence
  Marburg virus siRNA sense strand
gccugauuucacaaauuauga

SEQ ID NO: 21981 - RNA, 21 nt, Artificial Sequence
  Marburg virus siRNA sense strand
ccugauuucacaaauuaugag

SEQ ID NO: 21982 - RNA, 21 nt, Artificial Sequence
  Marburg virus siRNA sense strand
cugauuucacaaauuaugagg

SEQ ID NO: 21983 - RNA, 21 nt, Artificial Sequence
  Marburg virus siRNA sense strand
ugauuucacaaauuaugagga

SEQ ID NO: 21984 - RNA, 21 nt, Artificial Sequence
  Marburg virus siRNA sense strand
gauuucacaaauuaugaggac

SEQ ID NO: 21985 - RNA, 21 nt, Artificial Sequence
  Marburg virus siRNA sense strand
auuucacaaauuaugaggaca

SEQ ID NO: 21986 - RNA, 21 nt, Artificial Sequence
  Marburg virus siRNA sense strand
uuucacaaauuaugaggacaa

SEQ ID NO: 21987 - RNA, 21 nt, Artificial Sequence
  Marburg virus siRNA sense strand
uucacaaauuaugaggacaau

SEQ ID NO: 21988 - RNA, 21 nt, Artificial Sequence
  Marburg virus siRNA sense strand
ucacaaauuaugaggacaauc

SEQ ID NO: 21989 - RNA, 21 nt, Artificial Sequence
  Marburg virus siRNA sense strand
cacaaauuaugaggacaauca

SEQ ID NO: 21990 - RNA, 21 nt, Artificial Sequence
  Marburg virus siRNA sense strand
acaaauuaugaggacaaucag

SEQ ID NO: 21991 - RNA, 21 nt, Artificial Sequence
  Marburg virus siRNA sense strand
caaauuaugaggacaaucagc

SEQ ID NO: 21992 - RNA, 21 nt, Artificial Sequence
  Marburg virus siRNA sense strand
aaauuaugaggacaaucagca

SEQ ID NO: 21993 - RNA, 21 nt, Artificial Sequence
  Marburg virus siRNA sense strand
aauuaugaggacaaucagcag

SEQ ID NO: 21994 - RNA, 21 nt, Artificial Sequence
  Marburg virus siRNA sense strand
auuaugaggacaaucagcaga

SEQ ID NO: 21995 - RNA, 21 nt, Artificial Sequence
  Marburg virus siRNA sense strand
uuaugaggacaaucagcagaa

SEQ ID NO: 21996 - RNA, 21 nt, Artificial Sequence
  Marburg virus siRNA sense strand
uaugaggacaaucagcagaau

SEQ ID NO: 21997 - RNA, 21 nt, Artificial Sequence
  Marburg virus siRNA sense strand
augaggacaaucagcagaauu

SEQ ID NO: 21998 - RNA, 21 nt, Artificial Sequence
  Marburg virus siRNA sense strand
ugaggacaaucagcagaauug

SEQ ID NO: 21999 - RNA, 21 nt, Artificial Sequence
  Marburg virus siRNA sense strand
gaggacaaucagcagaauugg

SEQ ID NO: 22000 - RNA, 21 nt, Artificial Sequence
  Marburg virus siRNA sense strand
aggacaaucagcagaauuggc

SEQ ID NO: 22001 - RNA, 21 nt, Artificial Sequence
  Marburg virus siRNA sense strand
ggacaaucagcagaauuggcc

SEQ ID NO: 22002 - RNA, 21 nt, Artificial Sequence
  Marburg virus siRNA sense strand
gacaaucagcagaauuggcca

SEQ ID NO: 22003 - RNA, 21 nt, Artificial Sequence
  Marburg virus siRNA sense strand
acaaucagcagaauuggccac

SEQ ID NO: 22004 - RNA, 21 nt, Artificial Sequence
  Marburg virus siRNA sense strand
caaucagcagaauuggccaca

SEQ ID NO: 22005 - RNA, 21 nt, Artificial Sequence
  Marburg virus siRNA sense strand
aaucagcagaauuggccacaa

SEQ ID NO: 22006 - RNA, 21 nt, Artificial Sequence
  Marburg virus siRNA sense strand
aucagcagaauuggccacaaa

SEQ ID NO: 22007 - RNA, 21 nt, Artificial Sequence
  Marburg virus siRNA sense strand
ucagcagaauuggccacaaag

SEQ ID NO: 22008 - RNA, 21 nt, Artificial Sequence
  Marburg virus siRNA sense strand
cagcagaauuggccacaaaga

SEQ ID NO: 22009 - RNA, 21 nt, Artificial Sequence
  Marburg virus siRNA sense strand
agcagaauuggccacaaagag

SEQ ID NO: 22010 - RNA, 21 nt, Artificial Sequence
  Marburg virus siRNA sense strand
gcagaauuggccacaaagagu

SEQ ID NO: 22011 - RNA, 21 nt, Artificial Sequence
  Marburg virus siRNA sense strand
cagaauuggccacaaagagug

SEQ ID NO: 22012 - RNA, 21 nt, Artificial Sequence
  Marburg virus siRNA sense strand
agaauuggccacaaagagugg

SEQ ID NO: 22013 - RNA, 21 nt, Artificial Sequence
  Marburg virus siRNA sense strand
gaauuggccacaaagaguggu

SEQ ID NO: 22014 - RNA, 21 nt, Artificial Sequence
  Marburg virus siRNA sense strand
aauuggccacaaagaguggug

SEQ ID NO: 22015 - RNA, 21 nt, Artificial Sequence
  Marburg virus siRNA sense strand
auuggccacaaagagugguga

SEQ ID NO: 22016 - RNA, 21 nt, Artificial Sequence
  Marburg virus siRNA sense strand
uuggccacaaagaguggugac

SEQ ID NO: 22017 - RNA, 21 nt, Artificial Sequence
  Marburg virus siRNA sense strand
uggccacaaagaguggugaca

SEQ ID NO: 22018 - RNA, 21 nt, Artificial Sequence
  Marburg virus siRNA sense strand
ggccacaaagaguggugacaa

SEQ ID NO: 22019 - RNA, 21 nt, Artificial Sequence
  Marburg virus siRNA sense strand
gccacaaagaguggugacaaa

SEQ ID NO: 22020 - RNA, 21 nt, Artificial Sequence
  Marburg virus siRNA sense strand
ccacaaagaguggugacaaag

SEQ ID NO: 22021 - RNA, 21 nt, Artificial Sequence
  Marburg virus siRNA sense strand
cacaaagaguggugacaaaga

SEQ ID NO: 22022 - RNA, 21 nt, Artificial Sequence
  Marburg virus siRNA sense strand
acaaagaguggugacaaagaa

SEQ ID NO: 22023 - RNA, 21 nt, Artificial Sequence
  Marburg virus siRNA sense strand
caaagaguggugacaaagaag

SEQ ID NO: 22024 - RNA, 21 nt, Artificial Sequence
  Marburg virus siRNA sense strand
aaagaguggugacaaagaagg

SEQ ID NO: 22025 - RNA, 21 nt, Artificial Sequence
  Marburg virus siRNA sense strand
aagaguggugacaaagaaggg

SEQ ID NO: 22026 - RNA, 21 nt, Artificial Sequence
  Marburg virus siRNA sense strand
agaguggugacaaagaagggu

SEQ ID NO: 22027 - RNA, 21 nt, Artificial Sequence
  Marburg virus siRNA sense strand
gaguggugacaaagaagggua

SEQ ID NO: 22028 - RNA, 21 nt, Artificial Sequence
  Marburg virus siRNA sense strand
aguggugacaaagaaggguag

SEQ ID NO: 22029 - RNA, 21 nt, Artificial Sequence
  Marburg virus siRNA sense strand
guggugacaaagaaggguagg

SEQ ID NO: 22030 - RNA, 21 nt, Artificial Sequence
  Marburg virus siRNA sense strand
uggugacaaagaaggguagga

SEQ ID NO: 22031 - RNA, 21 nt, Artificial Sequence
  Marburg virus siRNA sense strand
ggugacaaagaaggguaggac

SEQ ID NO: 22032 - RNA, 21 nt, Artificial Sequence
  Marburg virus siRNA sense strand
gugacaaagaaggguaggacu

SEQ ID NO: 22033 - RNA, 21 nt, Artificial Sequence
  Marburg virus siRNA sense strand
ugacaaagaaggguaggacuu

SEQ ID NO: 22034 - RNA, 21 nt, Artificial Sequence
  Marburg virus siRNA sense strand
gacaaagaaggguaggacuuu

SEQ ID NO: 22035 - RNA, 21 nt, Artificial Sequence
  Marburg virus siRNA sense strand
acaaagaaggguaggacuuuc

SEQ ID NO: 22036 - RNA, 21 nt, Artificial Sequence
  Marburg virus siRNA sense strand
caaagaaggguaggacuuucc

SEQ ID NO: 22037 - RNA, 21 nt, Artificial Sequence
  Marburg virus siRNA sense strand
aaagaaggguaggacuuuccu

SEQ ID NO: 22038 - RNA, 21 nt, Artificial Sequence
  Marburg virus siRNA sense strand
aagaaggguaggacuuuccuu

SEQ ID NO: 22039 - RNA, 21 nt, Artificial Sequence
  Marburg virus siRNA sense strand
agaaggguaggacuuuccuuu

SEQ ID NO: 22040 - RNA, 21 nt, Artificial Sequence
  Marburg virus siRNA sense strand
gaaggguaggacuuuccuuua

SEQ ID NO: 22041 - RNA, 21 nt, Artificial Sequence
  Marburg virus siRNA sense strand
aaggguaggacuuuccuuuau

SEQ ID NO: 22042 - RNA, 21 nt, Artificial Sequence
  Marburg virus siRNA sense strand
aggguaggacuuuccuuuauc

SEQ ID NO: 22043 - RNA, 21 nt, Artificial Sequence
  Marburg virus siRNA sense strand
ggguaggacuuuccuuuaucc

SEQ ID NO: 22044 - RNA, 21 nt, Artificial Sequence
  Marburg virus siRNA sense strand
gguaggacuuuccuuuauccu

SEQ ID NO: 22045 - RNA, 21 nt, Artificial Sequence
  Marburg virus siRNA sense strand
guaggacuuuccuuuauccua

SEQ ID NO: 22046 - RNA, 21 nt, Artificial Sequence
  Marburg virus siRNA sense strand
uaggacuuuccuuuauccuaa

SEQ ID NO: 22047 - RNA, 21 nt, Artificial Sequence
  Marburg virus siRNA sense strand
aggacuuuccuuuauccuaau

SEQ ID NO: 22048 - RNA, 21 nt, Artificial Sequence
  Marburg virus siRNA sense strand
ggacuuuccuuuauccuaaug

SEQ ID NO: 22049 - RNA, 21 nt, Artificial Sequence
  Marburg virus siRNA sense strand
gacuuuccuuuauccuaauga

SEQ ID NO: 22050 - RNA, 21 nt, Artificial Sequence
  Marburg virus siRNA sense strand
acuuuccuuuauccuaaugau

SEQ ID NO: 22051 - RNA, 21 nt, Artificial Sequence
  Marburg virus siRNA sense strand
cuuuccuuuauccuaaugauc

SEQ ID NO: 22052 - RNA, 21 nt, Artificial Sequence
  Marburg virus siRNA sense strand
uuuccuuuauccuaaugaucu

SEQ ID NO: 22053 - RNA, 21 nt, Artificial Sequence
  Marburg virus siRNA sense strand
uuccuuuauccuaaugaucuu

SEQ ID NO: 22054 - RNA, 21 nt, Artificial Sequence
  Marburg virus siRNA sense strand
uccuuuauccuaaugaucuuc

SEQ ID NO: 22055 - RNA, 21 nt, Artificial Sequence
  Marburg virus siRNA sense strand
ccuuuauccuaaugaucuucu

SEQ ID NO: 22056 - RNA, 21 nt, Artificial Sequence
  Marburg virus siRNA sense strand
cuuuauccuaaugaucuucug

SEQ ID NO: 22057 - RNA, 21 nt, Artificial Sequence
  Marburg virus siRNA sense strand
uuuauccuaaugaucuucugc

SEQ ID NO: 22058 - RNA, 21 nt, Artificial Sequence
  Marburg virus siRNA sense strand
uuauccuaaugaucuucugca

SEQ ID NO: 22059 - RNA, 21 nt, Artificial Sequence
  Marburg virus siRNA sense strand
uauccuaaugaucuucugcag

SEQ ID NO: 22060 - RNA, 21 nt, Artificial Sequence
  Marburg virus siRNA sense strand
auccuaaugaucuucugcaga

SEQ ID NO: 22061 - RNA, 21 nt, Artificial Sequence
  Marburg virus siRNA sense strand
uccuaaugaucuucugcagac

SEQ ID NO: 22062 - RNA, 21 nt, Artificial Sequence
  Marburg virus siRNA sense strand
ccuaaugaucuucugcagaca

SEQ ID NO: 22063 - RNA, 21 nt, Artificial Sequence
  Marburg virus siRNA sense strand
cuaaugaucuucugcagacaa

SEQ ID NO: 22064 - RNA, 21 nt, Artificial Sequence
  Marburg virus siRNA sense strand
uaaugaucuucugcagacaaa

SEQ ID NO: 22065 - RNA, 21 nt, Artificial Sequence
  Marburg virus siRNA sense strand
aaugaucuucugcagacaaau

SEQ ID NO: 22066 - RNA, 21 nt, Artificial Sequence
  Marburg virus siRNA sense strand
augaucuucugcagacaaauc

SEQ ID NO: 22067 - RNA, 21 nt, Artificial Sequence
  Marburg virus siRNA sense strand
ugaucuucugcagacaaaucc

SEQ ID NO: 22068 - RNA, 21 nt, Artificial Sequence
  Marburg virus siRNA sense strand
gaucuucugcagacaaauccu

SEQ ID NO: 22069 - RNA, 21 nt, Artificial Sequence
  Marburg virus siRNA sense strand
aucuucugcagacaaauccuc

SEQ ID NO: 22070 - RNA, 21 nt, Artificial Sequence
  Marburg virus siRNA sense strand
ucuucugcagacaaauccucc

SEQ ID NO: 22071 - RNA, 21 nt, Artificial Sequence
  Marburg virus siRNA sense strand
cuucugcagacaaauccucca

SEQ ID NO: 22072 - RNA, 21 nt, Artificial Sequence
  Marburg virus siRNA sense strand
uucugcagacaaauccuccag

SEQ ID NO: 22073 - RNA, 21 nt, Artificial Sequence
  Marburg virus siRNA sense strand
ucugcagacaaauccuccaga

SEQ ID NO: 22074 - RNA, 21 nt, Artificial Sequence
  Marburg virus siRNA sense strand
cugcagacaaauccuccagaa

SEQ ID NO: 22075 - RNA, 21 nt, Artificial Sequence
  Marburg virus siRNA sense strand
ugcagacaaauccuccagaau

SEQ ID NO: 22076 - RNA, 21 nt, Artificial Sequence
  Marburg virus siRNA sense strand
gcagacaaauccuccagaauc

SEQ ID NO: 22077 - RNA, 21 nt, Artificial Sequence
  Marburg virus siRNA sense strand
cagacaaauccuccagaauca

SEQ ID NO: 22078 - RNA, 21 nt, Artificial Sequence
  Marburg virus siRNA sense strand
agacaaauccuccagaaucac

SEQ ID NO: 22079 - RNA, 21 nt, Artificial Sequence
  Marburg virus siRNA sense strand
gacaaauccuccagaaucacu

SEQ ID NO: 22080 - RNA, 21 nt, Artificial Sequence
  Marburg virus siRNA sense strand
acaaauccuccagaaucacuu

SEQ ID NO: 22081 - RNA, 21 nt, Artificial Sequence
  Marburg virus siRNA sense strand
caaauccuccagaaucacuua

SEQ ID NO: 22082 - RNA, 21 nt, Artificial Sequence
  Marburg virus siRNA sense strand
aaauccuccagaaucacuuau

SEQ ID NO: 22083 - RNA, 21 nt, Artificial Sequence
  Marburg virus siRNA sense strand
aauccuccagaaucacuuaua

SEQ ID NO: 22084 - RNA, 21 nt, Artificial Sequence
  Marburg virus siRNA sense strand
auccuccagaaucacuuauaa

SEQ ID NO: 22085 - RNA, 21 nt, Artificial Sequence
  Marburg virus siRNA sense strand
uccuccagaaucacuuauaac

SEQ ID NO: 22086 - RNA, 21 nt, Artificial Sequence
  Marburg virus siRNA sense strand
ccuccagaaucacuuauaaca

SEQ ID NO: 22087 - RNA, 21 nt, Artificial Sequence
  Marburg virus siRNA sense strand
cuccagaaucacuuauaacag

SEQ ID NO: 22088 - RNA, 21 nt, Artificial Sequence
  Marburg virus siRNA sense strand
uccagaaucacuuauaacagc

SEQ ID NO: 22089 - RNA, 21 nt, Artificial Sequence
  Marburg virus siRNA sense strand
ccagaaucacuuauaacagcc

SEQ ID NO: 22090 - RNA, 21 nt, Artificial Sequence
  Marburg virus siRNA sense strand
cagaaucacuuauaacagccc

SEQ ID NO: 22091 - RNA, 21 nt, Artificial Sequence
  Marburg virus siRNA sense strand
agaaucacuuauaacagcccu

SEQ ID NO: 22092 - RNA, 21 nt, Artificial Sequence
  Marburg virus siRNA sense strand
gaaucacuuauaacagcccuc

SEQ ID NO: 22093 - RNA, 21 nt, Artificial Sequence
  Marburg virus siRNA sense strand
aaucacuuauaacagcccucg

SEQ ID NO: 22094 - RNA, 21 nt, Artificial Sequence
  Marburg virus siRNA sense strand
aucacuuauaacagcccucgu

SEQ ID NO: 22095 - RNA, 21 nt, Artificial Sequence
  Marburg virus siRNA sense strand
ucacuuauaacagcccucgua

SEQ ID NO: 22096 - RNA, 21 nt, Artificial Sequence
  Marburg virus siRNA sense strand
cacuuauaacagcccucguag

SEQ ID NO: 22097 - RNA, 21 nt, Artificial Sequence
  Marburg virus siRNA sense strand
acuuauaacagcccucguaga

SEQ ID NO: 22098 - RNA, 21 nt, Artificial Sequence
  Marburg virus siRNA sense strand
cuuauaacagcccucguagag

SEQ ID NO: 22099 - RNA, 21 nt, Artificial Sequence
  Marburg virus siRNA sense strand
uuauaacagcccucguagagg

SEQ ID NO: 22100 - RNA, 21 nt, Artificial Sequence
  Marburg virus siRNA sense strand
uauaacagcccucguagagga

SEQ ID NO: 22101 - RNA, 21 nt, Artificial Sequence
  Marburg virus siRNA sense strand
auaacagcccucguagaggaa

SEQ ID NO: 22102 - RNA, 21 nt, Artificial Sequence
  Marburg virus siRNA sense strand
uaacagcccucguagaggaau

SEQ ID NO: 22103 - RNA, 21 nt, Artificial Sequence
  Marburg virus siRNA sense strand
aacagcccucguagaggaaua

SEQ ID NO: 22104 - RNA, 21 nt, Artificial Sequence
  Marburg virus siRNA sense strand
acagcccucguagaggaauac

SEQ ID NO: 22105 - RNA, 21 nt, Artificial Sequence
  Marburg virus siRNA sense strand
cagcccucguagaggaauacc

SEQ ID NO: 22106 - RNA, 21 nt, Artificial Sequence
  Marburg virus siRNA sense strand
agcccucguagaggaauacca

SEQ ID NO: 22107 - RNA, 21 nt, Artificial Sequence
  Marburg virus siRNA sense strand
gcccucguagaggaauaccaa

SEQ ID NO: 22108 - RNA, 21 nt, Artificial Sequence
  Marburg virus siRNA sense strand
cccucguagaggaauaccaaa

SEQ ID NO: 22109 - RNA, 21 nt, Artificial Sequence
  Marburg virus siRNA sense strand
ccucguagaggaauaccaaaa

SEQ ID NO: 22110 - RNA, 21 nt, Artificial Sequence
  Marburg virus siRNA sense strand
cucguagaggaauaccaaaau

SEQ ID NO: 22111 - RNA, 21 nt, Artificial Sequence
  Marburg virus siRNA sense strand
ucguagaggaauaccaaaauc

SEQ ID NO: 22112 - RNA, 21 nt, Artificial Sequence
  Marburg virus siRNA sense strand
cguagaggaauaccaaaaucc

SEQ ID NO: 22113 - RNA, 21 nt, Artificial Sequence
  Marburg virus siRNA sense strand
guagaggaauaccaaaauccu

SEQ ID NO: 22114 - RNA, 21 nt, Artificial Sequence
  Marburg virus siRNA sense strand
uagaggaauaccaaaauccug

SEQ ID NO: 22115 - RNA, 21 nt, Artificial Sequence
  Marburg virus siRNA sense strand
agaggaauaccaaaauccugu

SEQ ID NO: 22116 - RNA, 21 nt, Artificial Sequence
  Marburg virus siRNA sense strand
gaggaauaccaaaauccuguc

SEQ ID NO: 22117 - RNA, 21 nt, Artificial Sequence
  Marburg virus siRNA sense strand
aggaauaccaaaauccugucu

SEQ ID NO: 22118 - RNA, 21 nt, Artificial Sequence
  Marburg virus siRNA sense strand
ggaauaccaaaauccugucuc

SEQ ID NO: 22119 - RNA, 21 nt, Artificial Sequence
  Marburg virus siRNA sense strand
gaauaccaaaauccugucuca

SEQ ID NO: 22120 - RNA, 21 nt, Artificial Sequence
  Marburg virus siRNA sense strand
aauaccaaaauccugucucag

SEQ ID NO: 22121 - RNA, 21 nt, Artificial Sequence
  Marburg virus siRNA sense strand
auaccaaaauccugucucagc

SEQ ID NO: 22122 - RNA, 21 nt, Artificial Sequence
  Marburg virus siRNA sense strand
uaccaaaauccugucucagcu

SEQ ID NO: 22123 - RNA, 21 nt, Artificial Sequence
  Marburg virus siRNA sense strand
accaaaauccugucucagcua

SEQ ID NO: 22124 - RNA, 21 nt, Artificial Sequence
  Marburg virus siRNA sense strand
ccaaaauccugucucagcuaa

SEQ ID NO: 22125 - RNA, 21 nt, Artificial Sequence
  Marburg virus siRNA sense strand
caaaauccugucucagcuaag

SEQ ID NO: 22126 - RNA, 21 nt, Artificial Sequence
  Marburg virus siRNA sense strand
aaaauccugucucagcuaagg

SEQ ID NO: 22127 - RNA, 21 nt, Artificial Sequence
  Marburg virus siRNA sense strand
aaauccugucucagcuaagga

SEQ ID NO: 22128 - RNA, 21 nt, Artificial Sequence
  Marburg virus siRNA sense strand
aauccugucucagcuaaggag

SEQ ID NO: 22129 - RNA, 21 nt, Artificial Sequence
  Marburg virus siRNA sense strand
auccugucucagcuaaggagc

SEQ ID NO: 22130 - RNA, 21 nt, Artificial Sequence
  Marburg virus siRNA sense strand
uccugucucagcuaaggagcu

SEQ ID NO: 22131 - RNA, 21 nt, Artificial Sequence
  Marburg virus siRNA sense strand
ccugucucagcuaaggagcuc

SEQ ID NO: 22132 - RNA, 21 nt, Artificial Sequence
  Marburg virus siRNA sense strand
cugucucagcuaaggagcucc

SEQ ID NO: 22133 - RNA, 21 nt, Artificial Sequence
  Marburg virus siRNA sense strand
ugucucagcuaaggagcucca

SEQ ID NO: 22134 - RNA, 21 nt, Artificial Sequence
  Marburg virus siRNA sense strand
gucucagcuaaggagcuccaa

SEQ ID NO: 22135 - RNA, 21 nt, Artificial Sequence
  Marburg virus siRNA sense strand
ucucagcuaaggagcuccaag

SEQ ID NO: 22136 - RNA, 21 nt, Artificial Sequence
  Marburg virus siRNA sense strand
cucagcuaaggagcuccaagc

SEQ ID NO: 22137 - RNA, 21 nt, Artificial Sequence
  Marburg virus siRNA sense strand
ucagcuaaggagcuccaagca

SEQ ID NO: 22138 - RNA, 21 nt, Artificial Sequence
  Marburg virus siRNA sense strand
cagcuaaggagcuccaagcag

SEQ ID NO: 22139 - RNA, 21 nt, Artificial Sequence
  Marburg virus siRNA sense strand
agcuaaggagcuccaagcaga

SEQ ID NO: 22140 - RNA, 21 nt, Artificial Sequence
  Marburg virus siRNA sense strand
gcuaaggagcuccaagcagau

SEQ ID NO: 22141 - RNA, 21 nt, Artificial Sequence
  Marburg virus siRNA sense strand
cuaaggagcuccaagcagauu

SEQ ID NO: 22142 - RNA, 21 nt, Artificial Sequence
  Marburg virus siRNA sense strand
uaaggagcuccaagcagauug

SEQ ID NO: 22143 - RNA, 21 nt, Artificial Sequence
  Marburg virus siRNA sense strand
aaggagcuccaagcagauugg

SEQ ID NO: 22144 - RNA, 21 nt, Artificial Sequence
  Marburg virus siRNA sense strand
aggagcuccaagcagauuggc

SEQ ID NO: 22145 - RNA, 21 nt, Artificial Sequence
  Marburg virus siRNA sense strand
ggagcuccaagcagauuggcc

SEQ ID NO: 22146 - RNA, 21 nt, Artificial Sequence
  Marburg virus siRNA sense strand
gagcuccaagcagauuggccc

SEQ ID NO: 22147 - RNA, 21 nt, Artificial Sequence
  Marburg virus siRNA sense strand
agcuccaagcagauuggcccg

SEQ ID NO: 22148 - RNA, 21 nt, Artificial Sequence
  Marburg virus siRNA sense strand
gcuccaagcagauuggcccga

SEQ ID NO: 22149 - RNA, 21 nt, Artificial Sequence
  Marburg virus siRNA sense strand
cuccaagcagauuggcccgac

SEQ ID NO: 22150 - RNA, 21 nt, Artificial Sequence
  Marburg virus siRNA sense strand
uccaagcagauuggcccgaca

SEQ ID NO: 22151 - RNA, 21 nt, Artificial Sequence
  Marburg virus siRNA sense strand
ccaagcagauuggcccgacau

SEQ ID NO: 22152 - RNA, 21 nt, Artificial Sequence
  Marburg virus siRNA sense strand
caagcagauuggcccgacaug

SEQ ID NO: 22153 - RNA, 21 nt, Artificial Sequence
  Marburg virus siRNA sense strand
aagcagauuggcccgacaugu

SEQ ID NO: 22154 - RNA, 21 nt, Artificial Sequence
  Marburg virus siRNA sense strand
agcagauuggcccgacauguc

SEQ ID NO: 22155 - RNA, 21 nt, Artificial Sequence
  Marburg virus siRNA sense strand
gcagauuggcccgacauguca

SEQ ID NO: 22156 - RNA, 21 nt, Artificial Sequence
  Marburg virus siRNA sense strand
cagauuggcccgacaugucau

SEQ ID NO: 22157 - RNA, 21 nt, Artificial Sequence
  Marburg virus siRNA sense strand
agauuggcccgacaugucauu

SEQ ID NO: 22158 - RNA, 21 nt, Artificial Sequence
  Marburg virus siRNA sense strand
gauuggcccgacaugucauuu

SEQ ID NO: 22159 - RNA, 21 nt, Artificial Sequence
  Marburg virus siRNA sense strand
auuggcccgacaugucauuug

SEQ ID NO: 22160 - RNA, 21 nt, Artificial Sequence
  Marburg virus siRNA sense strand
uuggcccgacaugucauuuga

SEQ ID NO: 22161 - RNA, 21 nt, Artificial Sequence
  Marburg virus siRNA sense strand
uggcccgacaugucauuugau

SEQ ID NO: 22162 - RNA, 21 nt, Artificial Sequence
  Marburg virus siRNA sense strand
ggcccgacaugucauuugaug

SEQ ID NO: 22163 - RNA, 21 nt, Artificial Sequence
  Marburg virus siRNA sense strand
gcccgacaugucauuugauga

SEQ ID NO: 22164 - RNA, 21 nt, Artificial Sequence
  Marburg virus siRNA sense strand
cccgacaugucauuugaugaa

SEQ ID NO: 22165 - RNA, 21 nt, Artificial Sequence
  Marburg virus siRNA sense strand
ccgacaugucauuugaugaaa

SEQ ID NO: 22166 - RNA, 21 nt, Artificial Sequence
  Marburg virus siRNA sense strand
cgacaugucauuugaugaaag

SEQ ID NO: 22167 - RNA, 21 nt, Artificial Sequence
  Marburg virus siRNA sense strand
gacaugucauuugaugaaagg

SEQ ID NO: 22168 - RNA, 21 nt, Artificial Sequence
  Marburg virus siRNA sense strand
acaugucauuugaugaaagga

SEQ ID NO: 22169 - RNA, 21 nt, Artificial Sequence
  Marburg virus siRNA sense strand
caugucauuugaugaaaggag

SEQ ID NO: 22170 - RNA, 21 nt, Artificial Sequence
  Marburg virus siRNA sense strand
augucauuugaugaaaggaga

SEQ ID NO: 22171 - RNA, 21 nt, Artificial Sequence
  Marburg virus siRNA sense strand
ugucauuugaugaaaggagac

SEQ ID NO: 22172 - RNA, 21 nt, Artificial Sequence
  Marburg virus siRNA sense strand
gucauuugaugaaaggagaca

SEQ ID NO: 22173 - RNA, 21 nt, Artificial Sequence
  Marburg virus siRNA sense strand
ucauuugaugaaaggagacau

SEQ ID NO: 22174 - RNA, 21 nt, Artificial Sequence
  Marburg virus siRNA sense strand
cauuugaugaaaggagacaug

SEQ ID NO: 22175 - RNA, 21 nt, Artificial Sequence
  Marburg virus siRNA sense strand
auuugaugaaaggagacaugu

SEQ ID NO: 22176 - RNA, 21 nt, Artificial Sequence
  Marburg virus siRNA sense strand
uuugaugaaaggagacauguu

SEQ ID NO: 22177 - RNA, 21 nt, Artificial Sequence
  Marburg virus siRNA sense strand
uugaugaaaggagacauguug

SEQ ID NO: 22178 - RNA, 21 nt, Artificial Sequence
  Marburg virus siRNA sense strand
ugaugaaaggagacauguugc

SEQ ID NO: 22179 - RNA, 21 nt, Artificial Sequence
  Marburg virus siRNA sense strand
gaugaaaggagacauguugcu

SEQ ID NO: 22180 - RNA, 21 nt, Artificial Sequence
  Marburg virus siRNA sense strand
augaaaggagacauguugcua

SEQ ID NO: 22181 - RNA, 21 nt, Artificial Sequence
  Marburg virus siRNA sense strand
ugaaaggagacauguugcuau

SEQ ID NO: 22182 - RNA, 21 nt, Artificial Sequence
  Marburg virus siRNA sense strand
gaaaggagacauguugcuaug

SEQ ID NO: 22183 - RNA, 21 nt, Artificial Sequence
  Marburg virus siRNA sense strand
aaaggagacauguugcuauga

SEQ ID NO: 22184 - RNA, 21 nt, Artificial Sequence
  Marburg virus siRNA sense strand
aaggagacauguugcuaugaa

SEQ ID NO: 22185 - RNA, 21 nt, Artificial Sequence
  Marburg virus siRNA sense strand
aggagacauguugcuaugaac

SEQ ID NO: 22186 - RNA, 21 nt, Artificial Sequence
  Marburg virus siRNA sense strand
ggagacauguugcuaugaacu

SEQ ID NO: 22187 - RNA, 21 nt, Artificial Sequence
  Marburg virus siRNA sense strand
gagacauguugcuaugaacuu

SEQ ID NO: 22188 - RNA, 21 nt, Artificial Sequence
  Marburg virus siRNA sense strand
agacauguugcuaugaacuug

SEQ ID NO: 22189 - RNA, 21 nt, Artificial Sequence
  Marburg virus siRNA sense strand
gacauguugcuaugaacuugu

SEQ ID NO: 22190 - RNA, 21 nt, Artificial Sequence
  Marburg virus siRNA sense strand
acauguugcuaugaacuugua

SEQ ID NO: 22191 - RNA, 21 nt, Artificial Sequence
  Marburg virus siRNA sense strand
cauguugcuaugaacuuguag

SEQ ID NO: 22192 - RNA, 21 nt, Artificial Sequence
  Marburg virus siRNA sense strand
auguugcuaugaacuuguagu

SEQ ID NO: 22193 - RNA, 21 nt, Artificial Sequence
  Marburg virus siRNA sense strand
uguugcuaugaacuuguaguc

SEQ ID NO: 22194 - RNA, 21 nt, Artificial Sequence
  Marburg virus siRNA sense strand
guugcuaugaacuuguagucc

SEQ ID NO: 22195 - RNA, 21 nt, Artificial Sequence
  Marburg virus siRNA sense strand
uugcuaugaacuuguagucca

SEQ ID NO: 22196 - RNA, 21 nt, Artificial Sequence
  Marburg virus siRNA sense strand
ugcuaugaacuuguaguccag

SEQ ID NO: 22197 - RNA, 21 nt, Artificial Sequence
  Marburg virus siRNA sense strand
gcuaugaacuuguaguccaga

SEQ ID NO: 22198 - RNA, 21 nt, Artificial Sequence
  Marburg virus siRNA sense strand
cuaugaacuuguaguccagau

SEQ ID NO: 22199 - RNA, 21 nt, Artificial Sequence
  Marburg virus siRNA sense strand
uaugaacuuguaguccagaua

SEQ ID NO: 22200 - RNA, 21 nt, Artificial Sequence
  Marburg virus siRNA sense strand
augaacuuguaguccagauaa

SEQ ID NO: 22201 - RNA, 21 nt, Artificial Sequence
  Marburg virus siRNA sense strand
ugaacuuguaguccagauaac

SEQ ID NO: 22202 - RNA, 21 nt, Artificial Sequence
  Marburg virus siRNA sense strand
gaacuuguaguccagauaaca

SEQ ID NO: 22203 - RNA, 21 nt, Artificial Sequence
  Marburg virus siRNA sense strand
aacuuguaguccagauaacac

SEQ ID NO: 22204 - RNA, 21 nt, Artificial Sequence
  Marburg virus siRNA sense strand
acuuguaguccagauaacaca

SEQ ID NO: 22205 - RNA, 21 nt, Artificial Sequence
  Marburg virus siRNA sense strand
cuuguaguccagauaacacag

SEQ ID NO: 22206 - RNA, 21 nt, Artificial Sequence
  Marburg virus siRNA sense strand
uuguaguccagauaacacagc

SEQ ID NO: 22207 - RNA, 21 nt, Artificial Sequence
  Marburg virus siRNA sense strand
uguaguccagauaacacagca

SEQ ID NO: 22208 - RNA, 21 nt, Artificial Sequence
  Marburg virus siRNA sense strand
guaguccagauaacacagcac

SEQ ID NO: 22209 - RNA, 21 nt, Artificial Sequence
  Marburg virus siRNA sense strand
uaguccagauaacacagcacg

SEQ ID NO: 22210 - RNA, 21 nt, Artificial Sequence
  Marburg virus siRNA sense strand
aguccagauaacacagcacgg

SEQ ID NO: 22211 - RNA, 21 nt, Artificial Sequence
  Marburg virus siRNA sense strand
guccagauaacacagcacggu

SEQ ID NO: 22212 - RNA, 21 nt, Artificial Sequence
  Marburg virus siRNA sense strand
uccagauaacacagcacgguu

SEQ ID NO: 22213 - RNA, 21 nt, Artificial Sequence
  Marburg virus siRNA sense strand
ccagauaacacagcacgguua

SEQ ID NO: 22214 - RNA, 21 nt, Artificial Sequence
  Marburg virus siRNA sense strand
cagauaacacagcacgguuac

SEQ ID NO: 22215 - RNA, 21 nt, Artificial Sequence
  Marburg virus siRNA sense strand
agauaacacagcacgguuacc

SEQ ID NO: 22216 - RNA, 21 nt, Artificial Sequence
  Marburg virus siRNA sense strand
gauaacacagcacgguuaccu

SEQ ID NO: 22217 - RNA, 21 nt, Artificial Sequence
  Marburg virus siRNA sense strand
auaacacagcacgguuaccua

SEQ ID NO: 22218 - RNA, 21 nt, Artificial Sequence
  Marburg virus siRNA sense strand
uaacacagcacgguuaccuac

SEQ ID NO: 22219 - RNA, 21 nt, Artificial Sequence
  Marburg virus siRNA sense strand
aacacagcacgguuaccuacu

SEQ ID NO: 22220 - RNA, 21 nt, Artificial Sequence
  Marburg virus siRNA sense strand
acacagcacgguuaccuacuu

SEQ ID NO: 22221 - RNA, 21 nt, Artificial Sequence
  Marburg virus siRNA sense strand
cacagcacgguuaccuacuua

SEQ ID NO: 22222 - RNA, 21 nt, Artificial Sequence
  Marburg virus siRNA sense strand
acagcacgguuaccuacuuau

SEQ ID NO: 22223 - RNA, 21 nt, Artificial Sequence
  Marburg virus siRNA sense strand
cagcacgguuaccuacuuauc

SEQ ID NO: 22224 - RNA, 21 nt, Artificial Sequence
  Marburg virus siRNA sense strand
agcacgguuaccuacuuaucu

SEQ ID NO: 22225 - RNA, 21 nt, Artificial Sequence
  Marburg virus siRNA sense strand
gcacgguuaccuacuuaucua

SEQ ID NO: 22226 - RNA, 21 nt, Artificial Sequence
  Marburg virus siRNA sense strand
cacgguuaccuacuuaucuac

SEQ ID NO: 22227 - RNA, 21 nt, Artificial Sequence
  Marburg virus siRNA sense strand
acgguuaccuacuuaucuacu

SEQ ID NO: 22228 - RNA, 21 nt, Artificial Sequence
  Marburg virus siRNA sense strand
cgguuaccuacuuaucuacuu

SEQ ID NO: 22229 - RNA, 21 nt, Artificial Sequence
  Marburg virus siRNA sense strand
gguuaccuacuuaucuacuuu

SEQ ID NO: 22230 - RNA, 21 nt, Artificial Sequence
  Marburg virus siRNA sense strand
guuaccuacuuaucuacuuug

SEQ ID NO: 22231 - RNA, 21 nt, Artificial Sequence
  Marburg virus siRNA sense strand
uuaccuacuuaucuacuuuga

SEQ ID NO: 22232 - RNA, 21 nt, Artificial Sequence
  Marburg virus siRNA sense strand
uaccuacuuaucuacuuugau

SEQ ID NO: 22233 - RNA, 21 nt, Artificial Sequence
  Marburg virus siRNA sense strand
accuacuuaucuacuuugauc

SEQ ID NO: 22234 - RNA, 21 nt, Artificial Sequence
  Marburg virus siRNA sense strand
ccuacuuaucuacuuugaucc

SEQ ID NO: 22235 - RNA, 21 nt, Artificial Sequence
  Marburg virus siRNA sense strand
cuacuuaucuacuuugauccg

SEQ ID NO: 22236 - RNA, 21 nt, Artificial Sequence
  Marburg virus siRNA sense strand
uacuuaucuacuuugauccga

SEQ ID NO: 22237 - RNA, 21 nt, Artificial Sequence
  Marburg virus siRNA sense strand
acuuaucuacuuugauccgau

SEQ ID NO: 22238 - RNA, 21 nt, Artificial Sequence
  Marburg virus siRNA sense strand
cuuaucuacuuugauccgauu

SEQ ID NO: 22239 - RNA, 21 nt, Artificial Sequence
  Marburg virus siRNA sense strand
uuaucuacuuugauccgauuc

SEQ ID NO: 22240 - RNA, 21 nt, Artificial Sequence
  Marburg virus siRNA sense strand
uaucuacuuugauccgauucg

SEQ ID NO: 22241 - RNA, 21 nt, Artificial Sequence
  Marburg virus siRNA sense strand
aucuacuuugauccgauucgu

SEQ ID NO: 22242 - RNA, 21 nt, Artificial Sequence
  Marburg virus siRNA sense strand
ucuacuuugauccgauucguc

SEQ ID NO: 22243 - RNA, 21 nt, Artificial Sequence
  Marburg virus siRNA sense strand
cuacuuugauccgauucgucc

SEQ ID NO: 22244 - RNA, 21 nt, Artificial Sequence
  Marburg virus siRNA sense strand
uacuuugauccgauucguccu

SEQ ID NO: 22245 - RNA, 21 nt, Artificial Sequence
  Marburg virus siRNA sense strand
acuuugauccgauucguccuc

SEQ ID NO: 22246 - RNA, 21 nt, Artificial Sequence
  Marburg virus siRNA sense strand
cuuugauccgauucguccuca

SEQ ID NO: 22247 - RNA, 21 nt, Artificial Sequence
  Marburg virus siRNA sense strand
uuugauccgauucguccucag

SEQ ID NO: 22248 - RNA, 21 nt, Artificial Sequence
  Marburg virus siRNA sense strand
uugauccgauucguccucaga

SEQ ID NO: 22249 - RNA, 21 nt, Artificial Sequence
  Marburg virus siRNA sense strand
ugauccgauucguccucagau

SEQ ID NO: 22250 - RNA, 21 nt, Artificial Sequence
  Marburg virus siRNA sense strand
gauccgauucguccucagauc

SEQ ID NO: 22251 - RNA, 21 nt, Artificial Sequence
  Marburg virus siRNA sense strand
auccgauucguccucagauca

SEQ ID NO: 22252 - RNA, 21 nt, Artificial Sequence
  Marburg virus siRNA sense strand
uccgauucguccucagaucac

SEQ ID NO: 22253 - RNA, 21 nt, Artificial Sequence
  Marburg virus siRNA sense strand
ccgauucguccucagaucaca

SEQ ID NO: 22254 - RNA, 21 nt, Artificial Sequence
  Marburg virus siRNA sense strand
cgauucguccucagaucacag

SEQ ID NO: 22255 - RNA, 21 nt, Artificial Sequence
  Marburg virus siRNA sense strand
gauucguccucagaucacagu

SEQ ID NO: 22256 - RNA, 21 nt, Artificial Sequence
  Marburg virus siRNA sense strand
auucguccucagaucacagua

SEQ ID NO: 22257 - RNA, 21 nt, Artificial Sequence
  Marburg virus siRNA sense strand
uucguccucagaucacaguaa

SEQ ID NO: 22258 - RNA, 21 nt, Artificial Sequence
  Marburg virus siRNA sense strand
ucguccucagaucacaguaau

SEQ ID NO: 22259 - RNA, 21 nt, Artificial Sequence
  Marburg virus siRNA sense strand
cguccucagaucacaguaauc

SEQ ID NO: 22260 - RNA, 21 nt, Artificial Sequence
  Marburg virus siRNA sense strand
guccucagaucacaguaauca

SEQ ID NO: 22261 - RNA, 21 nt, Artificial Sequence
  Marburg virus siRNA sense strand
uccucagaucacaguaaucaa

SEQ ID NO: 22262 - RNA, 21 nt, Artificial Sequence
  Marburg virus siRNA sense strand
ccucagaucacaguaaucaaa

SEQ ID NO: 22263 - RNA, 21 nt, Artificial Sequence
  Marburg virus siRNA sense strand
cucagaucacaguaaucaaau

SEQ ID NO: 22264 - RNA, 21 nt, Artificial Sequence
  Marburg virus siRNA sense strand
ucagaucacaguaaucaaauu

SEQ ID NO: 22265 - RNA, 21 nt, Artificial Sequence
  Marburg virus siRNA sense strand
cagaucacaguaaucaaauuu

SEQ ID NO: 22266 - RNA, 21 nt, Artificial Sequence
  Marburg virus siRNA sense strand
agaucacaguaaucaaauuua

SEQ ID NO: 22267 - RNA, 21 nt, Artificial Sequence
  Marburg virus siRNA sense strand
gaucacaguaaucaaauuuau

SEQ ID NO: 22268 - RNA, 21 nt, Artificial Sequence
  Marburg virus siRNA sense strand
aucacaguaaucaaauuuauu

SEQ ID NO: 22269 - RNA, 21 nt, Artificial Sequence
  Marburg virus siRNA sense strand
ucacaguaaucaaauuuauuu

SEQ ID NO: 22270 - RNA, 21 nt, Artificial Sequence
  Marburg virus siRNA sense strand
cacaguaaucaaauuuauuug

SEQ ID NO: 22271 - RNA, 21 nt, Artificial Sequence
  Marburg virus siRNA sense strand
acaguaaucaaauuuauuuga

SEQ ID NO: 22272 - RNA, 21 nt, Artificial Sequence
  Marburg virus siRNA sense strand
caguaaucaaauuuauuugaa

SEQ ID NO: 22273 - RNA, 21 nt, Artificial Sequence
  Marburg virus siRNA sense strand
aguaaucaaauuuauuugaau

SEQ ID NO: 22274 - RNA, 21 nt, Artificial Sequence
  Marburg virus siRNA sense strand
guaaucaaauuuauuugaaua

SEQ ID NO: 22275 - RNA, 21 nt, Artificial Sequence
  Marburg virus siRNA sense strand
uaaucaaauuuauuugaauau

SEQ ID NO: 22276 - RNA, 21 nt, Artificial Sequence
  Marburg virus siRNA sense strand
aaucaaauuuauuugaauauu

SEQ ID NO: 22277 - RNA, 21 nt, Artificial Sequence
  Marburg virus siRNA sense strand
aucaaauuuauuugaauauuc

SEQ ID NO: 22278 - RNA, 21 nt, Artificial Sequence
  Marburg virus siRNA sense strand
ucaaauuuauuugaauauuca

SEQ ID NO: 22279 - RNA, 21 nt, Artificial Sequence
  Marburg virus siRNA sense strand
caaauuuauuugaauauucaa

SEQ ID NO: 22280 - RNA, 21 nt, Artificial Sequence
  Marburg virus siRNA sense strand
aaauuuauuugaauauucaaa

SEQ ID NO: 22281 - RNA, 21 nt, Artificial Sequence
  Marburg virus siRNA sense strand
aauuuauuugaauauucaaac

SEQ ID NO: 22282 - RNA, 21 nt, Artificial Sequence
  Marburg virus siRNA sense strand
auuuauuugaauauucaaacu

SEQ ID NO: 22283 - RNA, 21 nt, Artificial Sequence
  Marburg virus siRNA sense strand
uuuauuugaauauucaaacua

SEQ ID NO: 22284 - RNA, 21 nt, Artificial Sequence
  Marburg virus siRNA sense strand
uuauuugaauauucaaacuac

SEQ ID NO: 22285 - RNA, 21 nt, Artificial Sequence
  Marburg virus siRNA sense strand
uauuugaauauucaaacuacu

SEQ ID NO: 22286 - RNA, 21 nt, Artificial Sequence
  Marburg virus siRNA sense strand
auuugaauauucaaacuacuu

SEQ ID NO: 22287 - RNA, 21 nt, Artificial Sequence
  Marburg virus siRNA sense strand
uuugaauauucaaacuacuuu

SEQ ID NO: 22288 - RNA, 21 nt, Artificial Sequence
  Marburg virus siRNA sense strand
uugaauauucaaacuacuuuu

SEQ ID NO: 22289 - RNA, 21 nt, Artificial Sequence
  Marburg virus siRNA sense strand
ugaauauucaaacuacuuuuu

SEQ ID NO: 22290 - RNA, 21 nt, Artificial Sequence
  Marburg virus siRNA sense strand
gaauauucaaacuacuuuuua

SEQ ID NO: 22291 - RNA, 21 nt, Artificial Sequence
  Marburg virus siRNA sense strand
aauauucaaacuacuuuuuag

SEQ ID NO: 22292 - RNA, 21 nt, Artificial Sequence
  Marburg virus siRNA sense strand
auauucaaacuacuuuuuagg

SEQ ID NO: 22293 - RNA, 21 nt, Artificial Sequence
  Marburg virus siRNA sense strand
uauucaaacuacuuuuuagga

SEQ ID NO: 22294 - RNA, 21 nt, Artificial Sequence
  Marburg virus siRNA sense strand
auucaaacuacuuuuuaggau

SEQ ID NO: 22295 - RNA, 21 nt, Artificial Sequence
  Marburg virus siRNA sense strand
uucaaacuacuuuuuaggauc

SEQ ID NO: 22296 - RNA, 21 nt, Artificial Sequence
  Marburg virus siRNA sense strand
ucaaacuacuuuuuaggaucc

SEQ ID NO: 22297 - RNA, 21 nt, Artificial Sequence
  Marburg virus siRNA sense strand
caaacuacuuuuuaggauccu

SEQ ID NO: 22298 - RNA, 21 nt, Artificial Sequence
  Marburg virus siRNA sense strand
aaacuacuuuuuaggauccua

SEQ ID NO: 22299 - RNA, 21 nt, Artificial Sequence
  Marburg virus siRNA sense strand
aacuacuuuuuaggauccuau

SEQ ID NO: 22300 - RNA, 21 nt, Artificial Sequence
  Marburg virus siRNA sense strand
acuacuuuuuaggauccuauu

SEQ ID NO: 22301 - RNA, 21 nt, Artificial Sequence
  Marburg virus siRNA sense strand
cuacuuuuuaggauccuauua

SEQ ID NO: 22302 - RNA, 21 nt, Artificial Sequence
  Marburg virus siRNA sense strand
uacuuuuuaggauccuauuac

SEQ ID NO: 22303 - RNA, 21 nt, Artificial Sequence
  Marburg virus siRNA sense strand
acuuuuuaggauccuauuacu

SEQ ID NO: 22304 - RNA, 21 nt, Artificial Sequence
  Marburg virus siRNA sense strand
cuuuuuaggauccuauuacuu

SEQ ID NO: 22305 - RNA, 21 nt, Artificial Sequence
  Marburg virus siRNA sense strand
uuuuuaggauccuauuacuug

SEQ ID NO: 22306 - RNA, 21 nt, Artificial Sequence
  Marburg virus siRNA sense strand
uuuuaggauccuauuacuugu

SEQ ID NO: 22307 - RNA, 21 nt, Artificial Sequence
  Marburg virus siRNA sense strand
uuuaggauccuauuacuuguu

SEQ ID NO: 22308 - RNA, 21 nt, Artificial Sequence
  Marburg virus siRNA sense strand
uuaggauccuauuacuuguua

SEQ ID NO: 22309 - RNA, 21 nt, Artificial Sequence
  Marburg virus siRNA sense strand
uaggauccuauuacuuguuac

SEQ ID NO: 22310 - RNA, 21 nt, Artificial Sequence
  Marburg virus siRNA sense strand
aggauccuauuacuuguuacu

SEQ ID NO: 22311 - RNA, 21 nt, Artificial Sequence
  Marburg virus siRNA sense strand
ggauccuauuacuuguuacua

SEQ ID NO: 22312 - RNA, 21 nt, Artificial Sequence
  Marburg virus siRNA sense strand
gauccuauuacuuguuacuau

SEQ ID NO: 22313 - RNA, 21 nt, Artificial Sequence
  Marburg virus siRNA sense strand
auccuauuacuuguuacuauu

SEQ ID NO: 22314 - RNA, 21 nt, Artificial Sequence
  Marburg virus siRNA sense strand
uccuauuacuuguuacuauug

SEQ ID NO: 22315 - RNA, 21 nt, Artificial Sequence
  Marburg virus siRNA sense strand
ccuauuacuuguuacuauugu

SEQ ID NO: 22316 - RNA, 21 nt, Artificial Sequence
  Marburg virus siRNA sense strand
cuauuacuuguuacuauugug

SEQ ID NO: 22317 - RNA, 21 nt, Artificial Sequence
  Marburg virus siRNA sense strand
uauuacuuguuacuauugugu

SEQ ID NO: 22318 - RNA, 21 nt, Artificial Sequence
  Marburg virus siRNA sense strand
auuacuuguuacuauugugug

SEQ ID NO: 22319 - RNA, 21 nt, Artificial Sequence
  Marburg virus siRNA sense strand
uuacuuguuacuauuguguga

SEQ ID NO: 22320 - RNA, 21 nt, Artificial Sequence
  Marburg virus siRNA sense strand
uacuuguuacuauugugugag

SEQ ID NO: 22321 - RNA, 21 nt, Artificial Sequence
  Marburg virus siRNA sense strand
acuuguuacuauugugugaga

SEQ ID NO: 22322 - RNA, 21 nt, Artificial Sequence
  Marburg virus siRNA sense strand
cuuguuacuauugugugagac

SEQ ID NO: 22323 - RNA, 21 nt, Artificial Sequence
  Marburg virus siRNA sense strand
uuguuacuauugugugagaca

SEQ ID NO: 22324 - RNA, 21 nt, Artificial Sequence
  Marburg virus siRNA sense strand
uguuacuauugugugagacaa

SEQ ID NO: 22325 - RNA, 21 nt, Artificial Sequence
  Marburg virus siRNA sense strand
guuacuauugugugagacaac

SEQ ID NO: 22326 - RNA, 21 nt, Artificial Sequence
  Marburg virus siRNA sense strand
uuacuauugugugagacaaca

SEQ ID NO: 22327 - RNA, 21 nt, Artificial Sequence
  Marburg virus siRNA sense strand
uacuauugugugagacaacau

SEQ ID NO: 22328 - RNA, 21 nt, Artificial Sequence
  Marburg virus siRNA sense strand
acuauugugugagacaacaua

SEQ ID NO: 22329 - RNA, 21 nt, Artificial Sequence
  Marburg virus siRNA sense strand
cuauugugugagacaacauaa

SEQ ID NO: 22330 - RNA, 21 nt, Artificial Sequence
  Marburg virus siRNA sense strand
uauugugugagacaacauaag

SEQ ID NO: 22331 - RNA, 21 nt, Artificial Sequence
  Marburg virus siRNA sense strand
auugugugagacaacauaagc

SEQ ID NO: 22332 - RNA, 21 nt, Artificial Sequence
  Marburg virus siRNA sense strand
uugugugagacaacauaagcu

SEQ ID NO: 22333 - RNA, 21 nt, Artificial Sequence
  Marburg virus siRNA sense strand
ugugugagacaacauaagcua

SEQ ID NO: 22334 - RNA, 21 nt, Artificial Sequence
  Marburg virus siRNA sense strand
gugugagacaacauaagcuau

SEQ ID NO: 22335 - RNA, 21 nt, Artificial Sequence
  Marburg virus siRNA sense strand
ugugagacaacauaagcuauc

SEQ ID NO: 22336 - RNA, 21 nt, Artificial Sequence
  Marburg virus siRNA sense strand
gugagacaacauaagcuauca

SEQ ID NO: 22337 - RNA, 21 nt, Artificial Sequence
  Marburg virus siRNA sense strand
ugagacaacauaagcuaucaa

SEQ ID NO: 22338 - RNA, 21 nt, Artificial Sequence
  Marburg virus siRNA sense strand
gagacaacauaagcuaucaaa

SEQ ID NO: 22339 - RNA, 21 nt, Artificial Sequence
  Marburg virus siRNA sense strand
agacaacauaagcuaucaaau

SEQ ID NO: 22340 - RNA, 21 nt, Artificial Sequence
  Marburg virus siRNA sense strand
gacaacauaagcuaucaaaua

SEQ ID NO: 22341 - RNA, 21 nt, Artificial Sequence
  Marburg virus siRNA sense strand
acaacauaagcuaucaaauaa

SEQ ID NO: 22342 - RNA, 21 nt, Artificial Sequence
  Marburg virus siRNA sense strand
caacauaagcuaucaaauaac

SEQ ID NO: 22343 - RNA, 21 nt, Artificial Sequence
  Marburg virus siRNA sense strand
aacauaagcuaucaaauaaca

SEQ ID NO: 22344 - RNA, 21 nt, Artificial Sequence
  Marburg virus siRNA sense strand
acauaagcuaucaaauaacaa

SEQ ID NO: 22345 - RNA, 21 nt, Artificial Sequence
  Marburg virus siRNA sense strand
cauaagcuaucaaauaacaau

SEQ ID NO: 22346 - RNA, 21 nt, Artificial Sequence
  Marburg virus siRNA sense strand
auaagcuaucaaauaacaauc

SEQ ID NO: 22347 - RNA, 21 nt, Artificial Sequence
  Marburg virus siRNA sense strand
uaagcuaucaaauaacaauca

SEQ ID NO: 22348 - RNA, 21 nt, Artificial Sequence
  Marburg virus siRNA sense strand
aagcuaucaaauaacaaucac

SEQ ID NO: 22349 - RNA, 21 nt, Artificial Sequence
  Marburg virus siRNA sense strand
agcuaucaaauaacaaucacg

SEQ ID NO: 22350 - RNA, 21 nt, Artificial Sequence
  Marburg virus siRNA sense strand
gcuaucaaauaacaaucacgg

SEQ ID NO: 22351 - RNA, 21 nt, Artificial Sequence
  Marburg virus siRNA sense strand
cuaucaaauaacaaucacggg

SEQ ID NO: 22352 - RNA, 21 nt, Artificial Sequence
  Marburg virus siRNA sense strand
uaucaaauaacaaucacgggc

SEQ ID NO: 22353 - RNA, 21 nt, Artificial Sequence
  Marburg virus siRNA sense strand
aucaaauaacaaucacgggca

SEQ ID NO: 22354 - RNA, 21 nt, Artificial Sequence
  Marburg virus siRNA sense strand
ucaaauaacaaucacgggcaa

SEQ ID NO: 22355 - RNA, 21 nt, Artificial Sequence
  Marburg virus siRNA sense strand
caaauaacaaucacgggcaag

SEQ ID NO: 22356 - RNA, 21 nt, Artificial Sequence
  Marburg virus siRNA sense strand
aaauaacaaucacgggcaaga

SEQ ID NO: 22357 - RNA, 21 nt, Artificial Sequence
  Marburg virus siRNA sense strand
aauaacaaucacgggcaagaa

SEQ ID NO: 22358 - RNA, 21 nt, Artificial Sequence
  Marburg virus siRNA sense strand
auaacaaucacgggcaagaac

SEQ ID NO: 22359 - RNA, 21 nt, Artificial Sequence
  Marburg virus siRNA sense strand
uaacaaucacgggcaagaacc

SEQ ID NO: 22360 - RNA, 21 nt, Artificial Sequence
  Marburg virus siRNA sense strand
aacaaucacgggcaagaaccg

SEQ ID NO: 22361 - RNA, 21 nt, Artificial Sequence
  Marburg virus siRNA sense strand
acaaucacgggcaagaaccgg

SEQ ID NO: 22362 - RNA, 21 nt, Artificial Sequence
  Marburg virus siRNA sense strand
caaucacgggcaagaaccggg

SEQ ID NO: 22363 - RNA, 21 nt, Artificial Sequence
  Marburg virus siRNA sense strand
aaucacgggcaagaaccgggc

SEQ ID NO: 22364 - RNA, 21 nt, Artificial Sequence
  Marburg virus siRNA sense strand
aucacgggcaagaaccgggca

SEQ ID NO: 22365 - RNA, 21 nt, Artificial Sequence
  Marburg virus siRNA sense strand
ucacgggcaagaaccgggcau

SEQ ID NO: 22366 - RNA, 21 nt, Artificial Sequence
  Marburg virus siRNA sense strand
cacgggcaagaaccgggcaua

SEQ ID NO: 22367 - RNA, 21 nt, Artificial Sequence
  Marburg virus siRNA sense strand
acgggcaagaaccgggcauac

SEQ ID NO: 22368 - RNA, 21 nt, Artificial Sequence
  Marburg virus siRNA sense strand
cgggcaagaaccgggcauacu

SEQ ID NO: 22369 - RNA, 21 nt, Artificial Sequence
  Marburg virus siRNA sense strand
gggcaagaaccgggcauacua

SEQ ID NO: 22370 - RNA, 21 nt, Artificial Sequence
  Marburg virus siRNA sense strand
ggcaagaaccgggcauacuau

SEQ ID NO: 22371 - RNA, 21 nt, Artificial Sequence
  Marburg virus siRNA sense strand
gcaagaaccgggcauacuaug

SEQ ID NO: 22372 - RNA, 21 nt, Artificial Sequence
  Marburg virus siRNA sense strand
caagaaccgggcauacuaugg

SEQ ID NO: 22373 - RNA, 21 nt, Artificial Sequence
  Marburg virus siRNA sense strand
aagaaccgggcauacuauggu

SEQ ID NO: 22374 - RNA, 21 nt, Artificial Sequence
  Marburg virus siRNA sense strand
agaaccgggcauacuauggug

SEQ ID NO: 22375 - RNA, 21 nt, Artificial Sequence
  Marburg virus siRNA sense strand
gaaccgggcauacuaugguga

SEQ ID NO: 22376 - RNA, 21 nt, Artificial Sequence
  Marburg virus siRNA sense strand
aaccgggcauacuauggugau

SEQ ID NO: 22377 - RNA, 21 nt, Artificial Sequence
  Marburg virus siRNA sense strand
accgggcauacuauggugaug

SEQ ID NO: 22378 - RNA, 21 nt, Artificial Sequence
  Marburg virus siRNA sense strand
ccgggcauacuauggugaugc

SEQ ID NO: 22379 - RNA, 21 nt, Artificial Sequence
  Marburg virus siRNA sense strand
cgggcauacuauggugaugcg

SEQ ID NO: 22380 - RNA, 21 nt, Artificial Sequence
  Marburg virus siRNA sense strand
gggcauacuauggugaugcga

SEQ ID NO: 22381 - RNA, 21 nt, Artificial Sequence
  Marburg virus siRNA sense strand
ggcauacuauggugaugcgag

SEQ ID NO: 22382 - RNA, 21 nt, Artificial Sequence
  Marburg virus siRNA sense strand
gcauacuauggugaugcgagg

SEQ ID NO: 22383 - RNA, 21 nt, Artificial Sequence
  Marburg virus siRNA sense strand
cauacuauggugaugcgaggg

SEQ ID NO: 22384 - RNA, 21 nt, Artificial Sequence
  Marburg virus siRNA sense strand
auacuauggugaugcgagggc

SEQ ID NO: 22385 - RNA, 21 nt, Artificial Sequence
  Marburg virus siRNA sense strand
uacuauggugaugcgagggca

SEQ ID NO: 22386 - RNA, 21 nt, Artificial Sequence
  Marburg virus siRNA sense strand
acuauggugaugcgagggcau

SEQ ID NO: 22387 - RNA, 21 nt, Artificial Sequence
  Marburg virus siRNA sense strand
cuauggugaugcgagggcauu

SEQ ID NO: 22388 - RNA, 21 nt, Artificial Sequence
  Marburg virus siRNA sense strand
uauggugaugcgagggcauua

SEQ ID NO: 22389 - RNA, 21 nt, Artificial Sequence
  Marburg virus siRNA sense strand
auggugaugcgagggcauuau

SEQ ID NO: 22390 - RNA, 21 nt, Artificial Sequence
  Marburg virus siRNA sense strand
uggugaugcgagggcauuauu

SEQ ID NO: 22391 - RNA, 21 nt, Artificial Sequence
  Marburg virus siRNA sense strand
ggugaugcgagggcauuauuc

SEQ ID NO: 22392 - RNA, 21 nt, Artificial Sequence
  Marburg virus siRNA sense strand
gugaugcgagggcauuauuca

SEQ ID NO: 22393 - RNA, 21 nt, Artificial Sequence
  Marburg virus siRNA sense strand
ugaugcgagggcauuauucag

SEQ ID NO: 22394 - RNA, 21 nt, Artificial Sequence
  Marburg virus siRNA sense strand
gaugcgagggcauuauucagu

SEQ ID NO: 22395 - RNA, 21 nt, Artificial Sequence
  Marburg virus siRNA sense strand
augcgagggcauuauucagug

SEQ ID NO: 22396 - RNA, 21 nt, Artificial Sequence
  Marburg virus siRNA sense strand
ugcgagggcauuauucagugc

SEQ ID NO: 22397 - RNA, 21 nt, Artificial Sequence
  Marburg virus siRNA sense strand
gcgagggcauuauucagugcu

SEQ ID NO: 22398 - RNA, 21 nt, Artificial Sequence
  Marburg virus siRNA sense strand
cgagggcauuauucagugcua

SEQ ID NO: 22399 - RNA, 21 nt, Artificial Sequence
  Marburg virus siRNA sense strand
gagggcauuauucagugcuac

SEQ ID NO: 22400 - RNA, 21 nt, Artificial Sequence
  Marburg virus siRNA sense strand
agggcauuauucagugcuaca

SEQ ID NO: 22401 - RNA, 21 nt, Artificial Sequence
  Marburg virus siRNA sense strand
gggcauuauucagugcuacaa

SEQ ID NO: 22402 - RNA, 21 nt, Artificial Sequence
  Marburg virus siRNA sense strand
ggcauuauucagugcuacaaa

SEQ ID NO: 22403 - RNA, 21 nt, Artificial Sequence
  Marburg virus siRNA sense strand
gcauuauucagugcuacaaau

SEQ ID NO: 22404 - RNA, 21 nt, Artificial Sequence
  Marburg virus siRNA sense strand
cauuauucagugcuacaaauu

SEQ ID NO: 22405 - RNA, 21 nt, Artificial Sequence
  Marburg virus siRNA sense strand
auuauucagugcuacaaauuc

SEQ ID NO: 22406 - RNA, 21 nt, Artificial Sequence
  Marburg virus siRNA sense strand
uuauucagugcuacaaauucu

SEQ ID NO: 22407 - RNA, 21 nt, Artificial Sequence
  Marburg virus siRNA sense strand
uauucagugcuacaaauucuu

SEQ ID NO: 22408 - RNA, 21 nt, Artificial Sequence
  Marburg virus siRNA sense strand
auucagugcuacaaauucuuu

SEQ ID NO: 22409 - RNA, 21 nt, Artificial Sequence
  Marburg virus siRNA sense strand
uucagugcuacaaauucuuuu

SEQ ID NO: 22410 - RNA, 21 nt, Artificial Sequence
  Marburg virus siRNA sense strand
ucagugcuacaaauucuuuuu

SEQ ID NO: 22411 - RNA, 21 nt, Artificial Sequence
  Marburg virus siRNA sense strand
cagugcuacaaauucuuuuuu

SEQ ID NO: 22412 - RNA, 21 nt, Artificial Sequence
  Marburg virus siRNA sense strand
agugcuacaaauucuuuuuuc

SEQ ID NO: 22413 - RNA, 21 nt, Artificial Sequence
  Marburg virus siRNA sense strand
gugcuacaaauucuuuuuuca

SEQ ID NO: 22414 - RNA, 21 nt, Artificial Sequence
  Marburg virus siRNA sense strand
ugcuacaaauucuuuuuucaa

SEQ ID NO: 22415 - RNA, 21 nt, Artificial Sequence
  Marburg virus siRNA sense strand
gcuacaaauucuuuuuucaau

SEQ ID NO: 22416 - RNA, 21 nt, Artificial Sequence
  Marburg virus siRNA sense strand
cuacaaauucuuuuuucaauu

SEQ ID NO: 22417 - RNA, 21 nt, Artificial Sequence
  Marburg virus siRNA sense strand
uacaaauucuuuuuucaauug

SEQ ID NO: 22418 - RNA, 21 nt, Artificial Sequence
  Marburg virus siRNA sense strand
acaaauucuuuuuucaauugc

SEQ ID NO: 22419 - RNA, 21 nt, Artificial Sequence
  Marburg virus siRNA sense strand
caaauucuuuuuucaauugcu

SEQ ID NO: 22420 - RNA, 21 nt, Artificial Sequence
  Marburg virus siRNA sense strand
aaauucuuuuuucaauugcua

SEQ ID NO: 22421 - RNA, 21 nt, Artificial Sequence
  Marburg virus siRNA sense strand
aauucuuuuuucaauugcuau

SEQ ID NO: 22422 - RNA, 21 nt, Artificial Sequence
  Marburg virus siRNA sense strand
auucuuuuuucaauugcuaua

SEQ ID NO: 22423 - RNA, 21 nt, Artificial Sequence
  Marburg virus siRNA sense strand
uucuuuuuucaauugcuauaa

SEQ ID NO: 22424 - RNA, 21 nt, Artificial Sequence
  Marburg virus siRNA sense strand
ucuuuuuucaauugcuauaau

SEQ ID NO: 22425 - RNA, 21 nt, Artificial Sequence
  Marburg virus siRNA sense strand
cuuuuuucaauugcuauaaug

SEQ ID NO: 22426 - RNA, 21 nt, Artificial Sequence
  Marburg virus siRNA sense strand
uuuuuucaauugcuauaauga

SEQ ID NO: 22427 - RNA, 21 nt, Artificial Sequence
  Marburg virus siRNA sense strand
uuuuucaauugcuauaaugau

SEQ ID NO: 22428 - RNA, 21 nt, Artificial Sequence
  Marburg virus siRNA sense strand
uuuucaauugcuauaaugaua

SEQ ID NO: 22429 - RNA, 21 nt, Artificial Sequence
  Marburg virus siRNA sense strand
uuucaauugcuauaaugauac

SEQ ID NO: 22430 - RNA, 21 nt, Artificial Sequence
  Marburg virus siRNA sense strand
uucaauugcuauaaugauaca

SEQ ID NO: 22431 - RNA, 21 nt, Artificial Sequence
  Marburg virus siRNA sense strand
ucaauugcuauaaugauacaa

SEQ ID NO: 22432 - RNA, 21 nt, Artificial Sequence
  Marburg virus siRNA sense strand
caauugcuauaaugauacaac

SEQ ID NO: 22433 - RNA, 21 nt, Artificial Sequence
  Marburg virus siRNA sense strand
aauugcuauaaugauacaacu

SEQ ID NO: 22434 - RNA, 21 nt, Artificial Sequence
  Marburg virus siRNA sense strand
auugcuauaaugauacaacua

SEQ ID NO: 22435 - RNA, 21 nt, Artificial Sequence
  Marburg virus siRNA sense strand
uugcuauaaugauacaacuac

SEQ ID NO: 22436 - RNA, 21 nt, Artificial Sequence
  Marburg virus siRNA sense strand
ugcuauaaugauacaacuacg

SEQ ID NO: 22437 - RNA, 21 nt, Artificial Sequence
  Marburg virus siRNA sense strand
gcuauaaugauacaacuacga

SEQ ID NO: 22438 - RNA, 21 nt, Artificial Sequence
  Marburg virus siRNA sense strand
cuauaaugauacaacuacgaa

SEQ ID NO: 22439 - RNA, 21 nt, Artificial Sequence
  Marburg virus siRNA sense strand
uauaaugauacaacuacgaac

SEQ ID NO: 22440 - RNA, 21 nt, Artificial Sequence
  Marburg virus siRNA sense strand
auaaugauacaacuacgaacc

SEQ ID NO: 22441 - RNA, 21 nt, Artificial Sequence
  Marburg virus siRNA sense strand
uaaugauacaacuacgaaccu

SEQ ID NO: 22442 - RNA, 21 nt, Artificial Sequence
  Marburg virus siRNA sense strand
aaugauacaacuacgaaccuc

SEQ ID NO: 22443 - RNA, 21 nt, Artificial Sequence
  Marburg virus siRNA sense strand
augauacaacuacgaaccucc

SEQ ID NO: 22444 - RNA, 21 nt, Artificial Sequence
  Marburg virus siRNA sense strand
ugauacaacuacgaaccucca

SEQ ID NO: 22445 - RNA, 21 nt, Artificial Sequence
  Marburg virus siRNA sense strand
gauacaacuacgaaccuccau

SEQ ID NO: 22446 - RNA, 21 nt, Artificial Sequence
  Marburg virus siRNA sense strand
auacaacuacgaaccuccaua

SEQ ID NO: 22447 - RNA, 21 nt, Artificial Sequence
  Marburg virus siRNA sense strand
uacaacuacgaaccuccauac

SEQ ID NO: 22448 - RNA, 21 nt, Artificial Sequence
  Marburg virus siRNA sense strand
acaacuacgaaccuccauaca

SEQ ID NO: 22449 - RNA, 21 nt, Artificial Sequence
  Marburg virus siRNA sense strand
caacuacgaaccuccauacau

SEQ ID NO: 22450 - RNA, 21 nt, Artificial Sequence
  Marburg virus siRNA sense strand
aacuacgaaccuccauacauu

SEQ ID NO: 22451 - RNA, 21 nt, Artificial Sequence
  Marburg virus siRNA sense strand
acuacgaaccuccauacauuu

SEQ ID NO: 22452 - RNA, 21 nt, Artificial Sequence
  Marburg virus siRNA sense strand
cuacgaaccuccauacauuug

SEQ ID NO: 22453 - RNA, 21 nt, Artificial Sequence
  Marburg virus siRNA sense strand
uacgaaccuccauacauuugc

SEQ ID NO: 22454 - RNA, 21 nt, Artificial Sequence
  Marburg virus siRNA sense strand
acgaaccuccauacauuugcc

SEQ ID NO: 22455 - RNA, 21 nt, Artificial Sequence
  Marburg virus siRNA sense strand
cgaaccuccauacauuugccg

SEQ ID NO: 22456 - RNA, 21 nt, Artificial Sequence
  Marburg virus siRNA sense strand
gaaccuccauacauuugccgc

SEQ ID NO: 22457 - RNA, 21 nt, Artificial Sequence
  Marburg virus siRNA sense strand
aaccuccauacauuugccgca

SEQ ID NO: 22458 - RNA, 21 nt, Artificial Sequence
  Marburg virus siRNA sense strand
accuccauacauuugccgcaa

SEQ ID NO: 22459 - RNA, 21 nt, Artificial Sequence
  Marburg virus siRNA sense strand
ccuccauacauuugccgcaau

SEQ ID NO: 22460 - RNA, 21 nt, Artificial Sequence
  Marburg virus siRNA sense strand
cuccauacauuugccgcaaua

SEQ ID NO: 22461 - RNA, 21 nt, Artificial Sequence
  Marburg virus siRNA sense strand
uccauacauuugccgcaauac

SEQ ID NO: 22462 - RNA, 21 nt, Artificial Sequence
  Marburg virus siRNA sense strand
ccauacauuugccgcaauacu

SEQ ID NO: 22463 - RNA, 21 nt, Artificial Sequence
  Marburg virus siRNA sense strand
cauacauuugccgcaauacug

SEQ ID NO: 22464 - RNA, 21 nt, Artificial Sequence
  Marburg virus siRNA sense strand
auacauuugccgcaauacugu

SEQ ID NO: 22465 - RNA, 21 nt, Artificial Sequence
  Marburg virus siRNA sense strand
uacauuugccgcaauacugua

SEQ ID NO: 22466 - RNA, 21 nt, Artificial Sequence
  Marburg virus siRNA sense strand
acauuugccgcaauacuguaa

SEQ ID NO: 22467 - RNA, 21 nt, Artificial Sequence
  Marburg virus siRNA sense strand
cauuugccgcaauacuguaau

SEQ ID NO: 22468 - RNA, 21 nt, Artificial Sequence
  Marburg virus siRNA sense strand
auuugccgcaauacuguaauc

SEQ ID NO: 22469 - RNA, 21 nt, Artificial Sequence
  Marburg virus siRNA sense strand
uuugccgcaauacuguaauca

SEQ ID NO: 22470 - RNA, 21 nt, Artificial Sequence
  Marburg virus siRNA sense strand
uugccgcaauacuguaaucaa

SEQ ID NO: 22471 - RNA, 21 nt, Artificial Sequence
  Marburg virus siRNA sense strand
ugccgcaauacuguaaucaac

SEQ ID NO: 22472 - RNA, 21 nt, Artificial Sequence
  Marburg virus siRNA sense strand
gccgcaauacuguaaucaaca

SEQ ID NO: 22473 - RNA, 21 nt, Artificial Sequence
  Marburg virus siRNA sense strand
ccgcaauacuguaaucaacac

SEQ ID NO: 22474 - RNA, 21 nt, Artificial Sequence
  Marburg virus siRNA sense strand
cgcaauacuguaaucaacacu

SEQ ID NO: 22475 - RNA, 21 nt, Artificial Sequence
  Marburg virus siRNA sense strand
gcaauacuguaaucaacacug

SEQ ID NO: 22476 - RNA, 21 nt, Artificial Sequence
  Marburg virus siRNA sense strand
caauacuguaaucaacacugc

SEQ ID NO: 22477 - RNA, 21 nt, Artificial Sequence
  Marburg virus siRNA sense strand
aauacuguaaucaacacugcu

SEQ ID NO: 22478 - RNA, 21 nt, Artificial Sequence
  Marburg virus siRNA sense strand
auacuguaaucaacacugcug

SEQ ID NO: 22479 - RNA, 21 nt, Artificial Sequence
  Marburg virus siRNA sense strand
uacuguaaucaacacugcugu

SEQ ID NO: 22480 - RNA, 21 nt, Artificial Sequence
  Marburg virus siRNA sense strand
acuguaaucaacacugcugua

SEQ ID NO: 22481 - RNA, 21 nt, Artificial Sequence
  Marburg virus siRNA sense strand
cuguaaucaacacugcuguau

SEQ ID NO: 22482 - RNA, 21 nt, Artificial Sequence
  Marburg virus siRNA sense strand
uguaaucaacacugcuguauc

SEQ ID NO: 22483 - RNA, 21 nt, Artificial Sequence
  Marburg virus siRNA sense strand
guaaucaacacugcuguaucu

SEQ ID NO: 22484 - RNA, 21 nt, Artificial Sequence
  Marburg virus siRNA sense strand
uaaucaacacugcuguaucuc

SEQ ID NO: 22485 - RNA, 21 nt, Artificial Sequence
  Marburg virus siRNA sense strand
aaucaacacugcuguaucucu

SEQ ID NO: 22486 - RNA, 21 nt, Artificial Sequence
  Marburg virus siRNA sense strand
aucaacacugcuguaucucuc

SEQ ID NO: 22487 - RNA, 21 nt, Artificial Sequence
  Marburg virus siRNA sense strand
ucaacacugcuguaucucucc

SEQ ID NO: 22488 - RNA, 21 nt, Artificial Sequence
  Marburg virus siRNA sense strand
caacacugcuguaucucuccu

SEQ ID NO: 22489 - RNA, 21 nt, Artificial Sequence
  Marburg virus siRNA sense strand
aacacugcuguaucucuccuu

SEQ ID NO: 22490 - RNA, 21 nt, Artificial Sequence
  Marburg virus siRNA sense strand
acacugcuguaucucuccuuc

SEQ ID NO: 22491 - RNA, 21 nt, Artificial Sequence
  Marburg virus siRNA sense strand
cacugcuguaucucuccuuca

SEQ ID NO: 22492 - RNA, 21 nt, Artificial Sequence
  Marburg virus siRNA sense strand
acugcuguaucucuccuucaa

SEQ ID NO: 22493 - RNA, 21 nt, Artificial Sequence
  Marburg virus siRNA sense strand
cugcuguaucucuccuucaag

SEQ ID NO: 22494 - RNA, 21 nt, Artificial Sequence
  Marburg virus siRNA sense strand
ugcuguaucucuccuucaagc

SEQ ID NO: 22495 - RNA, 21 nt, Artificial Sequence
  Marburg virus siRNA sense strand
gcuguaucucuccuucaagcc

SEQ ID NO: 22496 - RNA, 21 nt, Artificial Sequence
  Marburg virus siRNA sense strand
cuguaucucuccuucaagcca

SEQ ID NO: 22497 - RNA, 21 nt, Artificial Sequence
  Marburg virus siRNA sense strand
uguaucucuccuucaagccau

SEQ ID NO: 22498 - RNA, 21 nt, Artificial Sequence
  Marburg virus siRNA sense strand
guaucucuccuucaagccauc

SEQ ID NO: 22499 - RNA, 21 nt, Artificial Sequence
  Marburg virus siRNA sense strand
uaucucuccuucaagccaucu

SEQ ID NO: 22500 - RNA, 21 nt, Artificial Sequence
  Marburg virus siRNA sense strand
aucucuccuucaagccaucug

SEQ ID NO: 22501 - RNA, 21 nt, Artificial Sequence
  Marburg virus siRNA sense strand
ucucuccuucaagccaucuga

SEQ ID NO: 22502 - RNA, 21 nt, Artificial Sequence
  Marburg virus siRNA sense strand
cucuccuucaagccaucugau

SEQ ID NO: 22503 - RNA, 21 nt, Artificial Sequence
  Marburg virus siRNA sense strand
ucuccuucaagccaucugauu

SEQ ID NO: 22504 - RNA, 21 nt, Artificial Sequence
  Marburg virus siRNA sense strand
cuccuucaagccaucugauuu

SEQ ID NO: 22505 - RNA, 21 nt, Artificial Sequence
  Marburg virus siRNA sense strand
uccuucaagccaucugauuua

SEQ ID NO: 22506 - RNA, 21 nt, Artificial Sequence
  Marburg virus siRNA sense strand
ccuucaagccaucugauuuaa

SEQ ID NO: 22507 - RNA, 21 nt, Artificial Sequence
  Marburg virus siRNA sense strand
cuucaagccaucugauuuaac

SEQ ID NO: 22508 - RNA, 21 nt, Artificial Sequence
  Marburg virus siRNA sense strand
uucaagccaucugauuuaacu

SEQ ID NO: 22509 - RNA, 21 nt, Artificial Sequence
  Marburg virus siRNA sense strand
ucaagccaucugauuuaacuu

SEQ ID NO: 22510 - RNA, 21 nt, Artificial Sequence
  Marburg virus siRNA sense strand
caagccaucugauuuaacuua

SEQ ID NO: 22511 - RNA, 21 nt, Artificial Sequence
  Marburg virus siRNA sense strand
aagccaucugauuuaacuuaa

SEQ ID NO: 22512 - RNA, 21 nt, Artificial Sequence
  Marburg virus siRNA sense strand
agccaucugauuuaacuuaau

SEQ ID NO: 22513 - RNA, 21 nt, Artificial Sequence
  Marburg virus siRNA sense strand
gccaucugauuuaacuuaaua

SEQ ID NO: 22514 - RNA, 21 nt, Artificial Sequence
  Marburg virus siRNA sense strand
ccaucugauuuaacuuaauaa

SEQ ID NO: 22515 - RNA, 21 nt, Artificial Sequence
  Marburg virus siRNA sense strand
caucugauuuaacuuaauaaa

SEQ ID NO: 22516 - RNA, 21 nt, Artificial Sequence
  Marburg virus siRNA sense strand
aucugauuuaacuuaauaaac

SEQ ID NO: 22517 - RNA, 21 nt, Artificial Sequence
  Marburg virus siRNA sense strand
ucugauuuaacuuaauaaaca

SEQ ID NO: 22518 - RNA, 21 nt, Artificial Sequence
  Marburg virus siRNA sense strand
cugauuuaacuuaauaaacau

SEQ ID NO: 22519 - RNA, 21 nt, Artificial Sequence
  Marburg virus siRNA sense strand
ugauuuaacuuaauaaacaug

SEQ ID NO: 22520 - RNA, 21 nt, Artificial Sequence
  Marburg virus siRNA sense strand
gauuuaacuuaauaaacauga

SEQ ID NO: 22521 - RNA, 21 nt, Artificial Sequence
  Marburg virus siRNA sense strand
auuuaacuuaauaaacaugac

SEQ ID NO: 22522 - RNA, 21 nt, Artificial Sequence
  Marburg virus siRNA sense strand
uuuaacuuaauaaacaugacu

SEQ ID NO: 22523 - RNA, 21 nt, Artificial Sequence
  Marburg virus siRNA sense strand
uuaacuuaauaaacaugacuu

SEQ ID NO: 22524 - RNA, 21 nt, Artificial Sequence
  Marburg virus siRNA sense strand
uaacuuaauaaacaugacuug

SEQ ID NO: 22525 - RNA, 21 nt, Artificial Sequence
  Marburg virus siRNA sense strand
aacuuaauaaacaugacuuga

SEQ ID NO: 22526 - RNA, 21 nt, Artificial Sequence
  Marburg virus siRNA sense strand
acuuaauaaacaugacuugau

SEQ ID NO: 22527 - RNA, 21 nt, Artificial Sequence
  Marburg virus siRNA sense strand
cuuaauaaacaugacuugauu

SEQ ID NO: 22528 - RNA, 21 nt, Artificial Sequence
  Marburg virus siRNA sense strand
uuaauaaacaugacuugauuc

SEQ ID NO: 22529 - RNA, 21 nt, Artificial Sequence
  Marburg virus siRNA sense strand
uaauaaacaugacuugauuca

SEQ ID NO: 22530 - RNA, 21 nt, Artificial Sequence
  Marburg virus siRNA sense strand
aauaaacaugacuugauucag

SEQ ID NO: 22531 - RNA, 21 nt, Artificial Sequence
  Marburg virus siRNA sense strand
auaaacaugacuugauucaga

SEQ ID NO: 22532 - RNA, 21 nt, Artificial Sequence
  Marburg virus siRNA sense strand
uaaacaugacuugauucagag

SEQ ID NO: 22533 - RNA, 21 nt, Artificial Sequence
  Marburg virus siRNA sense strand
aaacaugacuugauucagaga

SEQ ID NO: 22534 - RNA, 21 nt, Artificial Sequence
  Marburg virus siRNA sense strand
aacaugacuugauucagagag

SEQ ID NO: 22535 - RNA, 21 nt, Artificial Sequence
  Marburg virus siRNA sense strand
acaugacuugauucagagagu

SEQ ID NO: 22536 - RNA, 21 nt, Artificial Sequence
  Marburg virus siRNA sense strand
caugacuugauucagagagug

SEQ ID NO: 22537 - RNA, 21 nt, Artificial Sequence
  Marburg virus siRNA sense strand
augacuugauucagagagugu

SEQ ID NO: 22538 - RNA, 21 nt, Artificial Sequence
  Marburg virus siRNA sense strand
ugacuugauucagagagugug

SEQ ID NO: 22539 - RNA, 21 nt, Artificial Sequence
  Marburg virus siRNA sense strand
gacuugauucagagagugugc

SEQ ID NO: 22540 - RNA, 21 nt, Artificial Sequence
  Marburg virus siRNA sense strand
acuugauucagagagugugcu

SEQ ID NO: 22541 - RNA, 21 nt, Artificial Sequence
  Marburg virus siRNA sense strand
cuugauucagagagugugcug

SEQ ID NO: 22542 - RNA, 21 nt, Artificial Sequence
  Marburg virus siRNA sense strand
uugauucagagagugugcuga

SEQ ID NO: 22543 - RNA, 21 nt, Artificial Sequence
  Marburg virus siRNA sense strand
ugauucagagagugugcugaa

SEQ ID NO: 22544 - RNA, 21 nt, Artificial Sequence
  Marburg virus siRNA sense strand
gauucagagagugugcugaaa

SEQ ID NO: 22545 - RNA, 21 nt, Artificial Sequence
  Marburg virus siRNA sense strand
auucagagagugugcugaaaa

SEQ ID NO: 22546 - RNA, 21 nt, Artificial Sequence
  Marburg virus siRNA sense strand
uucagagagugugcugaaaau

SEQ ID NO: 22547 - RNA, 21 nt, Artificial Sequence
  Marburg virus siRNA sense strand
ucagagagugugcugaaaaug

SEQ ID NO: 22548 - RNA, 21 nt, Artificial Sequence
  Marburg virus siRNA sense strand
cagagagugugcugaaaaugu

SEQ ID NO: 22549 - RNA, 21 nt, Artificial Sequence
  Marburg virus siRNA sense strand
agagagugugcugaaaauguu

SEQ ID NO: 22550 - RNA, 21 nt, Artificial Sequence
  Marburg virus siRNA sense strand
gagagugugcugaaaauguua

SEQ ID NO: 22551 - RNA, 21 nt, Artificial Sequence
  Marburg virus siRNA sense strand
agagugugcugaaaauguuau

SEQ ID NO: 22552 - RNA, 21 nt, Artificial Sequence
  Marburg virus siRNA sense strand
gagugugcugaaaauguuauu

SEQ ID NO: 22553 - RNA, 21 nt, Artificial Sequence
  Marburg virus siRNA sense strand
agugugcugaaaauguuauug

SEQ ID NO: 22554 - RNA, 21 nt, Artificial Sequence
  Marburg virus siRNA sense strand
gugugcugaaaauguuauuga

SEQ ID NO: 22555 - RNA, 21 nt, Artificial Sequence
  Marburg virus siRNA sense strand
ugugcugaaaauguuauugau

SEQ ID NO: 22556 - RNA, 21 nt, Artificial Sequence
  Marburg virus siRNA sense strand
gugcugaaaauguuauugauu

SEQ ID NO: 22557 - RNA, 21 nt, Artificial Sequence
  Marburg virus siRNA sense strand
ugcugaaaauguuauugauug

SEQ ID NO: 22558 - RNA, 21 nt, Artificial Sequence
  Marburg virus siRNA sense strand
gcugaaaauguuauugauuga

SEQ ID NO: 22559 - RNA, 21 nt, Artificial Sequence
  Marburg virus siRNA sense strand
cugaaaauguuauugauugag

SEQ ID NO: 22560 - RNA, 21 nt, Artificial Sequence
  Marburg virus siRNA sense strand
ugaaaauguuauugauugagc

SEQ ID NO: 22561 - RNA, 21 nt, Artificial Sequence
  Marburg virus siRNA sense strand
gaaaauguuauugauugagcu

SEQ ID NO: 22562 - RNA, 21 nt, Artificial Sequence
  Marburg virus siRNA sense strand
aaaauguuauugauugagcuu

SEQ ID NO: 22563 - RNA, 21 nt, Artificial Sequence
  Marburg virus siRNA sense strand
aaauguuauugauugagcuuc

SEQ ID NO: 22564 - RNA, 21 nt, Artificial Sequence
  Marburg virus siRNA sense strand
aauguuauugauugagcuucu

SEQ ID NO: 22565 - RNA, 21 nt, Artificial Sequence
  Marburg virus siRNA sense strand
auguuauugauugagcuucuc

SEQ ID NO: 22566 - RNA, 21 nt, Artificial Sequence
  Marburg virus siRNA sense strand
uguuauugauugagcuucuca

SEQ ID NO: 22567 - RNA, 21 nt, Artificial Sequence
  Marburg virus siRNA sense strand
guuauugauugagcuucucaa

SEQ ID NO: 22568 - RNA, 21 nt, Artificial Sequence
  Marburg virus siRNA sense strand
uuauugauugagcuucucaaa

SEQ ID NO: 22569 - RNA, 21 nt, Artificial Sequence
  Marburg virus siRNA sense strand
uauugauugagcuucucaaau

SEQ ID NO: 22570 - RNA, 21 nt, Artificial Sequence
  Marburg virus siRNA sense strand
auugauugagcuucucaaaug

SEQ ID NO: 22571 - RNA, 21 nt, Artificial Sequence
  Marburg virus siRNA sense strand
uugauugagcuucucaaaugg

SEQ ID NO: 22572 - RNA, 21 nt, Artificial Sequence
  Marburg virus siRNA sense strand
ugauugagcuucucaaauggu

SEQ ID NO: 22573 - RNA, 21 nt, Artificial Sequence
  Marburg virus siRNA sense strand
gauugagcuucucaaauggug

SEQ ID NO: 22574 - RNA, 21 nt, Artificial Sequence
  Marburg virus siRNA sense strand
auugagcuucucaaauggugc

SEQ ID NO: 22575 - RNA, 21 nt, Artificial Sequence
  Marburg virus siRNA sense strand
uugagcuucucaaauggugca

SEQ ID NO: 22576 - RNA, 21 nt, Artificial Sequence
  Marburg virus siRNA sense strand
ugagcuucucaaauggugcac

SEQ ID NO: 22577 - RNA, 21 nt, Artificial Sequence
  Marburg virus siRNA sense strand
gagcuucucaaauggugcacu

SEQ ID NO: 22578 - RNA, 21 nt, Artificial Sequence
  Marburg virus siRNA sense strand
agcuucucaaauggugcacua

SEQ ID NO: 22579 - RNA, 21 nt, Artificial Sequence
  Marburg virus siRNA sense strand
gcuucucaaauggugcacuau

SEQ ID NO: 22580 - RNA, 21 nt, Artificial Sequence
  Marburg virus siRNA sense strand
cuucucaaauggugcacuauc

SEQ ID NO: 22581 - RNA, 21 nt, Artificial Sequence
  Marburg virus siRNA sense strand
uucucaaauggugcacuaucc

SEQ ID NO: 22582 - RNA, 21 nt, Artificial Sequence
  Marburg virus siRNA sense strand
ucucaaauggugcacuauccu

SEQ ID NO: 22583 - RNA, 21 nt, Artificial Sequence
  Marburg virus siRNA sense strand
cucaaauggugcacuauccua

SEQ ID NO: 22584 - RNA, 21 nt, Artificial Sequence
  Marburg virus siRNA sense strand
ucaaauggugcacuauccuac

SEQ ID NO: 22585 - RNA, 21 nt, Artificial Sequence
  Marburg virus siRNA sense strand
caaauggugcacuauccuacu

SEQ ID NO: 22586 - RNA, 21 nt, Artificial Sequence
  Marburg virus siRNA sense strand
aaauggugcacuauccuacug

SEQ ID NO: 22587 - RNA, 21 nt, Artificial Sequence
  Marburg virus siRNA sense strand
aauggugcacuauccuacugu

SEQ ID NO: 22588 - RNA, 21 nt, Artificial Sequence
  Marburg virus siRNA sense strand
auggugcacuauccuacuguu

SEQ ID NO: 22589 - RNA, 21 nt, Artificial Sequence
  Marburg virus siRNA sense strand
uggugcacuauccuacuguuu

SEQ ID NO: 22590 - RNA, 21 nt, Artificial Sequence
  Marburg virus siRNA sense strand
ggugcacuauccuacuguuuu

SEQ ID NO: 22591 - RNA, 21 nt, Artificial Sequence
  Marburg virus siRNA sense strand
gugcacuauccuacuguuuug

SEQ ID NO: 22592 - RNA, 21 nt, Artificial Sequence
  Marburg virus siRNA sense strand
ugcacuauccuacuguuuugc

SEQ ID NO: 22593 - RNA, 21 nt, Artificial Sequence
  Marburg virus siRNA sense strand
gcacuauccuacuguuuugcu

SEQ ID NO: 22594 - RNA, 21 nt, Artificial Sequence
  Marburg virus siRNA sense strand
cacuauccuacuguuuugcuc

SEQ ID NO: 22595 - RNA, 21 nt, Artificial Sequence
  Marburg virus siRNA sense strand
acuauccuacuguuuugcuca

SEQ ID NO: 22596 - RNA, 21 nt, Artificial Sequence
  Marburg virus siRNA sense strand
cuauccuacuguuuugcucag

SEQ ID NO: 22597 - RNA, 21 nt, Artificial Sequence
  Marburg virus siRNA sense strand
uauccuacuguuuugcucagc

SEQ ID NO: 22598 - RNA, 21 nt, Artificial Sequence
  Marburg virus siRNA sense strand
auccuacuguuuugcucagcc

SEQ ID NO: 22599 - RNA, 21 nt, Artificial Sequence
  Marburg virus siRNA sense strand
uccuacuguuuugcucagccu

SEQ ID NO: 22600 - RNA, 21 nt, Artificial Sequence
  Marburg virus siRNA sense strand
ccuacuguuuugcucagccua

SEQ ID NO: 22601 - RNA, 21 nt, Artificial Sequence
  Marburg virus siRNA sense strand
cuacuguuuugcucagccuag

SEQ ID NO: 22602 - RNA, 21 nt, Artificial Sequence
  Marburg virus siRNA sense strand
uacuguuuugcucagccuagu

SEQ ID NO: 22603 - RNA, 21 nt, Artificial Sequence
  Marburg virus siRNA sense strand
acuguuuugcucagccuagua

SEQ ID NO: 22604 - RNA, 21 nt, Artificial Sequence
  Marburg virus siRNA sense strand
cuguuuugcucagccuaguau

SEQ ID NO: 22605 - RNA, 21 nt, Artificial Sequence
  Marburg virus siRNA sense strand
uguuuugcucagccuaguaua

SEQ ID NO: 22606 - RNA, 21 nt, Artificial Sequence
  Marburg virus siRNA sense strand
guuuugcucagccuaguauac

SEQ ID NO: 22607 - RNA, 21 nt, Artificial Sequence
  Marburg virus siRNA sense strand
uuuugcucagccuaguauacu

SEQ ID NO: 22608 - RNA, 21 nt, Artificial Sequence
  Marburg virus siRNA sense strand
uuugcucagccuaguauacug

SEQ ID NO: 22609 - RNA, 21 nt, Artificial Sequence
  Marburg virus siRNA sense strand
uugcucagccuaguauacugu

SEQ ID NO: 22610 - RNA, 21 nt, Artificial Sequence
  Marburg virus siRNA sense strand
ugcucagccuaguauacugua

SEQ ID NO: 22611 - RNA, 21 nt, Artificial Sequence
  Marburg virus siRNA sense strand
gcucagccuaguauacuguaa

SEQ ID NO: 22612 - RNA, 21 nt, Artificial Sequence
  Marburg virus siRNA sense strand
cucagccuaguauacuguaac

SEQ ID NO: 22613 - RNA, 21 nt, Artificial Sequence
  Marburg virus siRNA sense strand
ucagccuaguauacuguaaca

SEQ ID NO: 22614 - RNA, 21 nt, Artificial Sequence
  Marburg virus siRNA sense strand
cagccuaguauacuguaacau

SEQ ID NO: 22615 - RNA, 21 nt, Artificial Sequence
  Marburg virus siRNA sense strand
agccuaguauacuguaacaua

SEQ ID NO: 22616 - RNA, 21 nt, Artificial Sequence
  Marburg virus siRNA sense strand
gccuaguauacuguaacauau

SEQ ID NO: 22617 - RNA, 21 nt, Artificial Sequence
  Marburg virus siRNA sense strand
ccuaguauacuguaacauaua

SEQ ID NO: 22618 - RNA, 21 nt, Artificial Sequence
  Marburg virus siRNA sense strand
cuaguauacuguaacauauaa

SEQ ID NO: 22619 - RNA, 21 nt, Artificial Sequence
  Marburg virus siRNA sense strand
uaguauacuguaacauauaag

SEQ ID NO: 22620 - RNA, 21 nt, Artificial Sequence
  Marburg virus siRNA sense strand
aguauacuguaacauauaagu

SEQ ID NO: 22621 - RNA, 21 nt, Artificial Sequence
  Marburg virus siRNA sense strand
guauacuguaacauauaagug

SEQ ID NO: 22622 - RNA, 21 nt, Artificial Sequence
  Marburg virus siRNA sense strand
uauacuguaacauauaagugg

SEQ ID NO: 22623 - RNA, 21 nt, Artificial Sequence
  Marburg virus siRNA sense strand
auacuguaacauauaagugga

SEQ ID NO: 22624 - RNA, 21 nt, Artificial Sequence
  Marburg virus siRNA sense strand
uacuguaacauauaaguggac

SEQ ID NO: 22625 - RNA, 21 nt, Artificial Sequence
  Marburg virus siRNA sense strand
acuguaacauauaaguggacu

SEQ ID NO: 22626 - RNA, 21 nt, Artificial Sequence
  Marburg virus siRNA sense strand
cuguaacauauaaguggacuc

SEQ ID NO: 22627 - RNA, 21 nt, Artificial Sequence
  Marburg virus siRNA sense strand
uguaacauauaaguggacucu

SEQ ID NO: 22628 - RNA, 21 nt, Artificial Sequence
  Marburg virus siRNA sense strand
guaacauauaaguggacucuc

SEQ ID NO: 22629 - RNA, 21 nt, Artificial Sequence
  Marburg virus siRNA sense strand
uaacauauaaguggacucucc

SEQ ID NO: 22630 - RNA, 21 nt, Artificial Sequence
  Marburg virus siRNA sense strand
aacauauaaguggacucucca

SEQ ID NO: 22631 - RNA, 21 nt, Artificial Sequence
  Marburg virus siRNA sense strand
acauauaaguggacucuccac

SEQ ID NO: 22632 - RNA, 21 nt, Artificial Sequence
  Marburg virus siRNA sense strand
cauauaaguggacucuccacu

SEQ ID NO: 22633 - RNA, 21 nt, Artificial Sequence
  Marburg virus siRNA sense strand
auauaaguggacucuccacuu

SEQ ID NO: 22634 - RNA, 21 nt, Artificial Sequence
  Marburg virus siRNA sense strand
uauaaguggacucuccacuuc

SEQ ID NO: 22635 - RNA, 21 nt, Artificial Sequence
  Marburg virus siRNA sense strand
auaaguggacucuccacuucu

SEQ ID NO: 22636 - RNA, 21 nt, Artificial Sequence
  Marburg virus siRNA sense strand
uaaguggacucuccacuucuc

SEQ ID NO: 22637 - RNA, 21 nt, Artificial Sequence
  Marburg virus siRNA sense strand
aaguggacucuccacuucucu

SEQ ID NO: 22638 - RNA, 21 nt, Artificial Sequence
  Marburg virus siRNA sense strand
aguggacucuccacuucucuu

SEQ ID NO: 22639 - RNA, 21 nt, Artificial Sequence
  Marburg virus siRNA sense strand
guggacucuccacuucucuuc

SEQ ID NO: 22640 - RNA, 21 nt, Artificial Sequence
  Marburg virus siRNA sense strand
uggacucuccacuucucuucu

SEQ ID NO: 22641 - RNA, 21 nt, Artificial Sequence
  Marburg virus siRNA sense strand
ggacucuccacuucucuucuc

SEQ ID NO: 22642 - RNA, 21 nt, Artificial Sequence
  Marburg virus siRNA sense strand
gacucuccacuucucuucucg

SEQ ID NO: 22643 - RNA, 21 nt, Artificial Sequence
  Marburg virus siRNA sense strand
acucuccacuucucuucucga

SEQ ID NO: 22644 - RNA, 21 nt, Artificial Sequence
  Marburg virus siRNA sense strand
cucuccacuucucuucucgag

SEQ ID NO: 22645 - RNA, 21 nt, Artificial Sequence
  Marburg virus siRNA sense strand
ucuccacuucucuucucgagu

SEQ ID NO: 22646 - RNA, 21 nt, Artificial Sequence
  Marburg virus siRNA sense strand
cuccacuucucuucucgagua

SEQ ID NO: 22647 - RNA, 21 nt, Artificial Sequence
  Marburg virus siRNA sense strand
uccacuucucuucucgaguau

SEQ ID NO: 22648 - RNA, 21 nt, Artificial Sequence
  Marburg virus siRNA sense strand
ccacuucucuucucgaguauu

SEQ ID NO: 22649 - RNA, 21 nt, Artificial Sequence
  Marburg virus siRNA sense strand
cacuucucuucucgaguauuc

SEQ ID NO: 22650 - RNA, 21 nt, Artificial Sequence
  Marburg virus siRNA sense strand
acuucucuucucgaguauucc

SEQ ID NO: 22651 - RNA, 21 nt, Artificial Sequence
  Marburg virus siRNA sense strand
cuucucuucucgaguauuccc

SEQ ID NO: 22652 - RNA, 21 nt, Artificial Sequence
  Marburg virus siRNA sense strand
uucucuucucgaguauucccu

SEQ ID NO: 22653 - RNA, 21 nt, Artificial Sequence
  Marburg virus siRNA sense strand
ucucuucucgaguauucccua

SEQ ID NO: 22654 - RNA, 21 nt, Artificial Sequence
  Marburg virus siRNA sense strand
cucuucucgaguauucccuau

SEQ ID NO: 22655 - RNA, 21 nt, Artificial Sequence
  Marburg virus siRNA sense strand
ucuucucgaguauucccuaua

SEQ ID NO: 22656 - RNA, 21 nt, Artificial Sequence
  Marburg virus siRNA sense strand
cuucucgaguauucccuauaa

SEQ ID NO: 22657 - RNA, 21 nt, Artificial Sequence
  Marburg virus siRNA sense strand
uucucgaguauucccuauaag

SEQ ID NO: 22658 - RNA, 21 nt, Artificial Sequence
  Marburg virus siRNA sense strand
ucucgaguauucccuauaagu

SEQ ID NO: 22659 - RNA, 21 nt, Artificial Sequence
  Marburg virus siRNA sense strand
cucgaguauucccuauaagug

SEQ ID NO: 22660 - RNA, 21 nt, Artificial Sequence
  Marburg virus siRNA sense strand
ucgaguauucccuauaaguga

SEQ ID NO: 22661 - RNA, 21 nt, Artificial Sequence
  Marburg virus siRNA sense strand
cgaguauucccuauaagugau

SEQ ID NO: 22662 - RNA, 21 nt, Artificial Sequence
  Marburg virus siRNA sense strand
gaguauucccuauaagugauu

SEQ ID NO: 22663 - RNA, 21 nt, Artificial Sequence
  Marburg virus siRNA sense strand
aguauucccuauaagugauuu

SEQ ID NO: 22664 - RNA, 21 nt, Artificial Sequence
  Marburg virus siRNA sense strand
guauucccuauaagugauuua

SEQ ID NO: 22665 - RNA, 21 nt, Artificial Sequence
  Marburg virus siRNA sense strand
uauucccuauaagugauuuac

SEQ ID NO: 22666 - RNA, 21 nt, Artificial Sequence
  Marburg virus siRNA sense strand
auucccuauaagugauuuacu

SEQ ID NO: 22667 - RNA, 21 nt, Artificial Sequence
  Marburg virus siRNA sense strand
uucccuauaagugauuuacuu

SEQ ID NO: 22668 - RNA, 21 nt, Artificial Sequence
  Marburg virus siRNA sense strand
ucccuauaagugauuuacuug

SEQ ID NO: 22669 - RNA, 21 nt, Artificial Sequence
  Marburg virus siRNA sense strand
cccuauaagugauuuacuuga

SEQ ID NO: 22670 - RNA, 21 nt, Artificial Sequence
  Marburg virus siRNA sense strand
ccuauaagugauuuacuugau

SEQ ID NO: 22671 - RNA, 21 nt, Artificial Sequence
  Marburg virus siRNA sense strand
cuauaagugauuuacuugaua

SEQ ID NO: 22672 - RNA, 21 nt, Artificial Sequence
  Marburg virus siRNA sense strand
uauaagugauuuacuugauag

SEQ ID NO: 22673 - RNA, 21 nt, Artificial Sequence
  Marburg virus siRNA sense strand
auaagugauuuacuugauaga

SEQ ID NO: 22674 - RNA, 21 nt, Artificial Sequence
  Marburg virus siRNA sense strand
uaagugauuuacuugauagaa

SEQ ID NO: 22675 - RNA, 21 nt, Artificial Sequence
  Marburg virus siRNA sense strand
aagugauuuacuugauagaau

SEQ ID NO: 22676 - RNA, 21 nt, Artificial Sequence
  Marburg virus siRNA sense strand
agugauuuacuugauagaaug

SEQ ID NO: 22677 - RNA, 21 nt, Artificial Sequence
  Marburg virus siRNA sense strand
gugauuuacuugauagaaugu

SEQ ID NO: 22678 - RNA, 21 nt, Artificial Sequence
  Marburg virus siRNA sense strand
ugauuuacuugauagaauguc

SEQ ID NO: 22679 - RNA, 21 nt, Artificial Sequence
  Marburg virus siRNA sense strand
gauuuacuugauagaauguca

SEQ ID NO: 22680 - RNA, 21 nt, Artificial Sequence
  Marburg virus siRNA sense strand
auuuacuugauagaaugucaa

SEQ ID NO: 22681 - RNA, 21 nt, Artificial Sequence
  Marburg virus siRNA sense strand
uuuacuugauagaaugucaag

SEQ ID NO: 22682 - RNA, 21 nt, Artificial Sequence
  Marburg virus siRNA sense strand
uuacuugauagaaugucaagu

SEQ ID NO: 22683 - RNA, 21 nt, Artificial Sequence
  Marburg virus siRNA sense strand
uacuugauagaaugucaaguc

SEQ ID NO: 22684 - RNA, 21 nt, Artificial Sequence
  Marburg virus siRNA sense strand
acuugauagaaugucaagucc

SEQ ID NO: 22685 - RNA, 21 nt, Artificial Sequence
  Marburg virus siRNA sense strand
cuugauagaaugucaagucca

SEQ ID NO: 22686 - RNA, 21 nt, Artificial Sequence
  Marburg virus siRNA sense strand
uugauagaaugucaaguccac

SEQ ID NO: 22687 - RNA, 21 nt, Artificial Sequence
  Marburg virus siRNA sense strand
ugauagaaugucaaguccacu

SEQ ID NO: 22688 - RNA, 21 nt, Artificial Sequence
  Marburg virus siRNA sense strand
gauagaaugucaaguccacug

SEQ ID NO: 22689 - RNA, 21 nt, Artificial Sequence
  Marburg virus siRNA sense strand
auagaaugucaaguccacugg

SEQ ID NO: 22690 - RNA, 21 nt, Artificial Sequence
  Marburg virus siRNA sense strand
uagaaugucaaguccacuggu

SEQ ID NO: 22691 - RNA, 21 nt, Artificial Sequence
  Marburg virus siRNA sense strand
agaaugucaaguccacugguu

SEQ ID NO: 22692 - RNA, 21 nt, Artificial Sequence
  Marburg virus siRNA sense strand
gaaugucaaguccacugguuu

SEQ ID NO: 22693 - RNA, 21 nt, Artificial Sequence
  Marburg virus siRNA sense strand
aaugucaaguccacugguuug

SEQ ID NO: 22694 - RNA, 21 nt, Artificial Sequence
  Marburg virus siRNA sense strand
augucaaguccacugguuugg

SEQ ID NO: 22695 - RNA, 21 nt, Artificial Sequence
  Marburg virus siRNA sense strand
ugucaaguccacugguuugga

SEQ ID NO: 22696 - RNA, 21 nt, Artificial Sequence
  Marburg virus siRNA sense strand
gucaaguccacugguuuggag

SEQ ID NO: 22697 - RNA, 21 nt, Artificial Sequence
  Marburg virus siRNA sense strand
ucaaguccacugguuuggagu

SEQ ID NO: 22698 - RNA, 21 nt, Artificial Sequence
  Marburg virus siRNA sense strand
caaguccacugguuuggaguu

SEQ ID NO: 22699 - RNA, 21 nt, Artificial Sequence
  Marburg virus siRNA sense strand
aaguccacugguuuggaguuu

SEQ ID NO: 22700 - RNA, 21 nt, Artificial Sequence
  Marburg virus siRNA sense strand
aguccacugguuuggaguuuc

SEQ ID NO: 22701 - RNA, 21 nt, Artificial Sequence
  Marburg virus siRNA sense strand
guccacugguuuggaguuucc

SEQ ID NO: 22702 - RNA, 21 nt, Artificial Sequence
  Marburg virus siRNA sense strand
uccacugguuuggaguuuccu

SEQ ID NO: 22703 - RNA, 21 nt, Artificial Sequence
  Marburg virus siRNA sense strand
ccacugguuuggaguuuccuu

SEQ ID NO: 22704 - RNA, 21 nt, Artificial Sequence
  Marburg virus siRNA sense strand
cacugguuuggaguuuccuua

SEQ ID NO: 22705 - RNA, 21 nt, Artificial Sequence
  Marburg virus siRNA sense strand
acugguuuggaguuuccuuac

SEQ ID NO: 22706 - RNA, 21 nt, Artificial Sequence
  Marburg virus siRNA sense strand
cugguuuggaguuuccuuacu

SEQ ID NO: 22707 - RNA, 21 nt, Artificial Sequence
  Marburg virus siRNA sense strand
ugguuuggaguuuccuuacuc

SEQ ID NO: 22708 - RNA, 21 nt, Artificial Sequence
  Marburg virus siRNA sense strand
gguuuggaguuuccuuacucu

SEQ ID NO: 22709 - RNA, 21 nt, Artificial Sequence
  Marburg virus siRNA sense strand
guuuggaguuuccuuacucua

SEQ ID NO: 22710 - RNA, 21 nt, Artificial Sequence
  Marburg virus siRNA sense strand
uuuggaguuuccuuacucuaa

SEQ ID NO: 22711 - RNA, 21 nt, Artificial Sequence
  Marburg virus siRNA sense strand
uuggaguuuccuuacucuaau

SEQ ID NO: 22712 - RNA, 21 nt, Artificial Sequence
  Marburg virus siRNA sense strand
uggaguuuccuuacucuaaug

SEQ ID NO: 22713 - RNA, 21 nt, Artificial Sequence
  Marburg virus siRNA sense strand
ggaguuuccuuacucuaauga

SEQ ID NO: 22714 - RNA, 21 nt, Artificial Sequence
  Marburg virus siRNA sense strand
gaguuuccuuacucuaaugau

SEQ ID NO: 22715 - RNA, 21 nt, Artificial Sequence
  Marburg virus siRNA sense strand
aguuuccuuacucuaaugauu

SEQ ID NO: 22716 - RNA, 21 nt, Artificial Sequence
  Marburg virus siRNA sense strand
guuuccuuacucuaaugauug

SEQ ID NO: 22717 - RNA, 21 nt, Artificial Sequence
  Marburg virus siRNA sense strand
uuuccuuacucuaaugauugu

SEQ ID NO: 22718 - RNA, 21 nt, Artificial Sequence
  Marburg virus siRNA sense strand
uuccuuacucuaaugauugua

SEQ ID NO: 22719 - RNA, 21 nt, Artificial Sequence
  Marburg virus siRNA sense strand
uccuuacucuaaugauuguaa

SEQ ID NO: 22720 - RNA, 21 nt, Artificial Sequence
  Marburg virus siRNA sense strand
ccuuacucuaaugauuguaau

SEQ ID NO: 22721 - RNA, 21 nt, Artificial Sequence
  Marburg virus siRNA sense strand
cuuacucuaaugauuguaaua

SEQ ID NO: 22722 - RNA, 21 nt, Artificial Sequence
  Marburg virus siRNA sense strand
uuacucuaaugauuguaauaa

SEQ ID NO: 22723 - RNA, 21 nt, Artificial Sequence
  Marburg virus siRNA sense strand
uacucuaaugauuguaauaau

SEQ ID NO: 22724 - RNA, 21 nt, Artificial Sequence
  Marburg virus siRNA sense strand
acucuaaugauuguaauaauu

SEQ ID NO: 22725 - RNA, 21 nt, Artificial Sequence
  Marburg virus siRNA sense strand
cucuaaugauuguaauaauua

SEQ ID NO: 22726 - RNA, 21 nt, Artificial Sequence
  Marburg virus siRNA sense strand
ucuaaugauuguaauaauuaa

SEQ ID NO: 22727 - RNA, 21 nt, Artificial Sequence
  Marburg virus siRNA sense strand
cuaaugauuguaauaauuaac

SEQ ID NO: 22728 - RNA, 21 nt, Artificial Sequence
  Marburg virus siRNA sense strand
uaaugauuguaauaauuaacu

SEQ ID NO: 22729 - RNA, 21 nt, Artificial Sequence
  Marburg virus siRNA sense strand
aaugauuguaauaauuaacug

SEQ ID NO: 22730 - RNA, 21 nt, Artificial Sequence
  Marburg virus siRNA sense strand
augauuguaauaauuaacugu

SEQ ID NO: 22731 - RNA, 21 nt, Artificial Sequence
  Marburg virus siRNA sense strand
ugauuguaauaauuaacuguu

SEQ ID NO: 22732 - RNA, 21 nt, Artificial Sequence
  Marburg virus siRNA sense strand
gauuguaauaauuaacuguug

SEQ ID NO: 22733 - RNA, 21 nt, Artificial Sequence
  Marburg virus siRNA sense strand
auuguaauaauuaacuguugg

SEQ ID NO: 22734 - RNA, 21 nt, Artificial Sequence
  Marburg virus siRNA sense strand
uuguaauaauuaacuguuggc

SEQ ID NO: 22735 - RNA, 21 nt, Artificial Sequence
  Marburg virus siRNA sense strand
uguaauaauuaacuguuggcu

SEQ ID NO: 22736 - RNA, 21 nt, Artificial Sequence
  Marburg virus siRNA sense strand
guaauaauuaacuguuggcuu

SEQ ID NO: 22737 - RNA, 21 nt, Artificial Sequence
  Marburg virus siRNA sense strand
uaauaauuaacuguuggcuua

SEQ ID NO: 22738 - RNA, 21 nt, Artificial Sequence
  Marburg virus siRNA sense strand
aauaauuaacuguuggcuuag

SEQ ID NO: 22739 - RNA, 21 nt, Artificial Sequence
  Marburg virus siRNA sense strand
auaauuaacuguuggcuuaga

SEQ ID NO: 22740 - RNA, 21 nt, Artificial Sequence
  Marburg virus siRNA sense strand
uaauuaacuguuggcuuagau

SEQ ID NO: 22741 - RNA, 21 nt, Artificial Sequence
  Marburg virus siRNA sense strand
aauuaacuguuggcuuagaug

SEQ ID NO: 22742 - RNA, 21 nt, Artificial Sequence
  Marburg virus siRNA sense strand
auuaacuguuggcuuagauga

SEQ ID NO: 22743 - RNA, 21 nt, Artificial Sequence
  Marburg virus siRNA sense strand
uuaacuguuggcuuagaugau

SEQ ID NO: 22744 - RNA, 21 nt, Artificial Sequence
  Marburg virus siRNA sense strand
uaacuguuggcuuagaugaua

SEQ ID NO: 22745 - RNA, 21 nt, Artificial Sequence
  Marburg virus siRNA sense strand
aacuguuggcuuagaugauaa

SEQ ID NO: 22746 - RNA, 21 nt, Artificial Sequence
  Marburg virus siRNA sense strand
acuguuggcuuagaugauaac

SEQ ID NO: 22747 - RNA, 21 nt, Artificial Sequence
  Marburg virus siRNA sense strand
cuguuggcuuagaugauaaca

SEQ ID NO: 22748 - RNA, 21 nt, Artificial Sequence
  Marburg virus siRNA sense strand
uguuggcuuagaugauaacag

SEQ ID NO: 22749 - RNA, 21 nt, Artificial Sequence
  Marburg virus siRNA sense strand
guuggcuuagaugauaacaga

SEQ ID NO: 22750 - RNA, 21 nt, Artificial Sequence
  Marburg virus siRNA sense strand
uuggcuuagaugauaacagau

SEQ ID NO: 22751 - RNA, 21 nt, Artificial Sequence
  Marburg virus siRNA sense strand
uggcuuagaugauaacagaua

SEQ ID NO: 22752 - RNA, 21 nt, Artificial Sequence
  Marburg virus siRNA sense strand
ggcuuagaugauaacagauac

SEQ ID NO: 22753 - RNA, 21 nt, Artificial Sequence
  Marburg virus siRNA sense strand
gcuuagaugauaacagauacg

SEQ ID NO: 22754 - RNA, 21 nt, Artificial Sequence
  Marburg virus siRNA sense strand
cuuagaugauaacagauacga

SEQ ID NO: 22755 - RNA, 21 nt, Artificial Sequence
  Marburg virus siRNA sense strand
uuagaugauaacagauacgag

SEQ ID NO: 22756 - RNA, 21 nt, Artificial Sequence
  Marburg virus siRNA sense strand
uagaugauaacagauacgagg

SEQ ID NO: 22757 - RNA, 21 nt, Artificial Sequence
  Marburg virus siRNA sense strand
agaugauaacagauacgaggu

SEQ ID NO: 22758 - RNA, 21 nt, Artificial Sequence
  Marburg virus siRNA sense strand
gaugauaacagauacgagguu

SEQ ID NO: 22759 - RNA, 21 nt, Artificial Sequence
  Marburg virus siRNA sense strand
augauaacagauacgagguua

SEQ ID NO: 22760 - RNA, 21 nt, Artificial Sequence
  Marburg virus siRNA sense strand
ugauaacagauacgagguuau

SEQ ID NO: 22761 - RNA, 21 nt, Artificial Sequence
  Marburg virus siRNA sense strand
gauaacagauacgagguuaua

SEQ ID NO: 22762 - RNA, 21 nt, Artificial Sequence
  Marburg virus siRNA sense strand
auaacagauacgagguuauau

SEQ ID NO: 22763 - RNA, 21 nt, Artificial Sequence
  Marburg virus siRNA sense strand
uaacagauacgagguuauaua

SEQ ID NO: 22764 - RNA, 21 nt, Artificial Sequence
  Marburg virus siRNA sense strand
aacagauacgagguuauauaa

SEQ ID NO: 22765 - RNA, 21 nt, Artificial Sequence
  Marburg virus siRNA sense strand
acagauacgagguuauauaau

SEQ ID NO: 22766 - RNA, 21 nt, Artificial Sequence
  Marburg virus siRNA sense strand
cagauacgagguuauauaauu

SEQ ID NO: 22767 - RNA, 21 nt, Artificial Sequence
  Marburg virus siRNA sense strand
agauacgagguuauauaauua

SEQ ID NO: 22768 - RNA, 21 nt, Artificial Sequence
  Marburg virus siRNA sense strand
gauacgagguuauauaauuac

SEQ ID NO: 22769 - RNA, 21 nt, Artificial Sequence
  Marburg virus siRNA sense strand
auacgagguuauauaauuacu

SEQ ID NO: 22770 - RNA, 21 nt, Artificial Sequence
  Marburg virus siRNA sense strand
uacgagguuauauaauuacuc

SEQ ID NO: 22771 - RNA, 21 nt, Artificial Sequence
  Marburg virus siRNA sense strand
acgagguuauauaauuacuca

SEQ ID NO: 22772 - RNA, 21 nt, Artificial Sequence
  Marburg virus siRNA sense strand
cgagguuauauaauuacucau

SEQ ID NO: 22773 - RNA, 21 nt, Artificial Sequence
  Marburg virus siRNA sense strand
gagguuauauaauuacucaua

SEQ ID NO: 22774 - RNA, 21 nt, Artificial Sequence
  Marburg virus siRNA sense strand
agguuauauaauuacucauag

SEQ ID NO: 22775 - RNA, 21 nt, Artificial Sequence
  Marburg virus siRNA sense strand
gguuauauaauuacucauagu

SEQ ID NO: 22776 - RNA, 21 nt, Artificial Sequence
  Marburg virus siRNA sense strand
guuauauaauuacucauagua

SEQ ID NO: 22777 - RNA, 21 nt, Artificial Sequence
  Marburg virus siRNA sense strand
uuauauaauuacucauaguau

SEQ ID NO: 22778 - RNA, 21 nt, Artificial Sequence
  Marburg virus siRNA sense strand
uauauaauuacucauaguaua

SEQ ID NO: 22779 - RNA, 21 nt, Artificial Sequence
  Marburg virus siRNA sense strand
auauaauuacucauaguauaa

SEQ ID NO: 22780 - RNA, 21 nt, Artificial Sequence
  Marburg virus siRNA sense strand
uauaauuacucauaguauaaa

SEQ ID NO: 22781 - RNA, 21 nt, Artificial Sequence
  Marburg virus siRNA sense strand
auaauuacucauaguauaaag

SEQ ID NO: 22782 - RNA, 21 nt, Artificial Sequence
  Marburg virus siRNA sense strand
uaauuacucauaguauaaagu

SEQ ID NO: 22783 - RNA, 21 nt, Artificial Sequence
  Marburg virus siRNA sense strand
aauuacucauaguauaaagua

SEQ ID NO: 22784 - RNA, 21 nt, Artificial Sequence
  Marburg virus siRNA sense strand
auuacucauaguauaaaguau

SEQ ID NO: 22785 - RNA, 21 nt, Artificial Sequence
  Marburg virus siRNA sense strand
uuacucauaguauaaaguaua

SEQ ID NO: 22786 - RNA, 21 nt, Artificial Sequence
  Marburg virus siRNA sense strand
uacucauaguauaaaguauaa

SEQ ID NO: 22787 - RNA, 21 nt, Artificial Sequence
  Marburg virus siRNA sense strand
acucauaguauaaaguauaau

SEQ ID NO: 22788 - RNA, 21 nt, Artificial Sequence
  Marburg virus siRNA sense strand
cucauaguauaaaguauaauu

SEQ ID NO: 22789 - RNA, 21 nt, Artificial Sequence
  Marburg virus siRNA sense strand
ucauaguauaaaguauaauuc

SEQ ID NO: 22790 - RNA, 21 nt, Artificial Sequence
  Marburg virus siRNA sense strand
cauaguauaaaguauaauucu

SEQ ID NO: 22791 - RNA, 21 nt, Artificial Sequence
  Marburg virus siRNA sense strand
auaguauaaaguauaauucuu

SEQ ID NO: 22792 - RNA, 21 nt, Artificial Sequence
  Marburg virus siRNA sense strand
uaguauaaaguauaauucuug

SEQ ID NO: 22793 - RNA, 21 nt, Artificial Sequence
  Marburg virus siRNA sense strand
aguauaaaguauaauucuugc

SEQ ID NO: 22794 - RNA, 21 nt, Artificial Sequence
  Marburg virus siRNA sense strand
guauaaaguauaauucuugcc

SEQ ID NO: 22795 - RNA, 21 nt, Artificial Sequence
  Marburg virus siRNA sense strand
uauaaaguauaauucuugccu

SEQ ID NO: 22796 - RNA, 21 nt, Artificial Sequence
  Marburg virus siRNA sense strand
auaaaguauaauucuugccuc

SEQ ID NO: 22797 - RNA, 21 nt, Artificial Sequence
  Marburg virus siRNA sense strand
uaaaguauaauucuugccucu

SEQ ID NO: 22798 - RNA, 21 nt, Artificial Sequence
  Marburg virus siRNA sense strand
aaaguauaauucuugccucug

SEQ ID NO: 22799 - RNA, 21 nt, Artificial Sequence
  Marburg virus siRNA sense strand
aaguauaauucuugccucugu

SEQ ID NO: 22800 - RNA, 21 nt, Artificial Sequence
  Marburg virus siRNA sense strand
aguauaauucuugccucuguu

SEQ ID NO: 22801 - RNA, 21 nt, Artificial Sequence
  Marburg virus siRNA sense strand
guauaauucuugccucuguuu

SEQ ID NO: 22802 - RNA, 21 nt, Artificial Sequence
  Marburg virus siRNA sense strand
uauaauucuugccucuguuuc

SEQ ID NO: 22803 - RNA, 21 nt, Artificial Sequence
  Marburg virus siRNA sense strand
auaauucuugccucuguuucu

SEQ ID NO: 22804 - RNA, 21 nt, Artificial Sequence
  Marburg virus siRNA sense strand
uaauucuugccucuguuucuu

SEQ ID NO: 22805 - RNA, 21 nt, Artificial Sequence
  Marburg virus siRNA sense strand
aauucuugccucuguuucuuc

SEQ ID NO: 22806 - RNA, 21 nt, Artificial Sequence
  Marburg virus siRNA sense strand
auucuugccucuguuucuucu

SEQ ID NO: 22807 - RNA, 21 nt, Artificial Sequence
  Marburg virus siRNA sense strand
uucuugccucuguuucuucug

SEQ ID NO: 22808 - RNA, 21 nt, Artificial Sequence
  Marburg virus siRNA sense strand
ucuugccucuguuucuucugu

SEQ ID NO: 22809 - RNA, 21 nt, Artificial Sequence
  Marburg virus siRNA sense strand
cuugccucuguuucuucuguu

SEQ ID NO: 22810 - RNA, 21 nt, Artificial Sequence
  Marburg virus siRNA sense strand
uugccucuguuucuucuguuu

SEQ ID NO: 22811 - RNA, 21 nt, Artificial Sequence
  Marburg virus siRNA sense strand
ugccucuguuucuucuguuuu

SEQ ID NO: 22812 - RNA, 21 nt, Artificial Sequence
  Marburg virus siRNA sense strand
gccucuguuucuucuguuuuc

SEQ ID NO: 22813 - RNA, 21 nt, Artificial Sequence
  Marburg virus siRNA sense strand
ccucuguuucuucuguuuucu

SEQ ID NO: 22814 - RNA, 21 nt, Artificial Sequence
  Marburg virus siRNA sense strand
cucuguuucuucuguuuucuc

SEQ ID NO: 22815 - RNA, 21 nt, Artificial Sequence
  Marburg virus siRNA sense strand
ucuguuucuucuguuuucucu

SEQ ID NO: 22816 - RNA, 21 nt, Artificial Sequence
  Marburg virus siRNA sense strand
cuguuucuucuguuuucucuu

SEQ ID NO: 22817 - RNA, 21 nt, Artificial Sequence
  Marburg virus siRNA sense strand
uguuucuucuguuuucucuuu

SEQ ID NO: 22818 - RNA, 21 nt, Artificial Sequence
  Marburg virus siRNA sense strand
guuucuucuguuuucucuuuc

SEQ ID NO: 22819 - RNA, 21 nt, Artificial Sequence
  Marburg virus siRNA sense strand
uuucuucuguuuucucuuucc

SEQ ID NO: 22820 - RNA, 21 nt, Artificial Sequence
  Marburg virus siRNA sense strand
uucuucuguuuucucuuuccu

SEQ ID NO: 22821 - RNA, 21 nt, Artificial Sequence
  Marburg virus siRNA sense strand
ucuucuguuuucucuuuccuu

SEQ ID NO: 22822 - RNA, 21 nt, Artificial Sequence
  Marburg virus siRNA sense strand
cuucuguuuucucuuuccuuu

SEQ ID NO: 22823 - RNA, 21 nt, Artificial Sequence
  Marburg virus siRNA sense strand
uucuguuuucucuuuccuuug

SEQ ID NO: 22824 - RNA, 21 nt, Artificial Sequence
  Marburg virus siRNA sense strand
ucuguuuucucuuuccuuugu

SEQ ID NO: 22825 - RNA, 21 nt, Artificial Sequence
  Marburg virus siRNA sense strand
cuguuuucucuuuccuuugua

SEQ ID NO: 22826 - RNA, 21 nt, Artificial Sequence
  Marburg virus siRNA sense strand
uguuuucucuuuccuuuguaa

SEQ ID NO: 22827 - RNA, 21 nt, Artificial Sequence
  Marburg virus siRNA sense strand
guuuucucuuuccuuuguaau

SEQ ID NO: 22828 - RNA, 21 nt, Artificial Sequence
  Marburg virus siRNA sense strand
uuuucucuuuccuuuguaaua

SEQ ID NO: 22829 - RNA, 21 nt, Artificial Sequence
  Marburg virus siRNA sense strand
uuucucuuuccuuuguaauau

SEQ ID NO: 22830 - RNA, 21 nt, Artificial Sequence
  Marburg virus siRNA sense strand
uucucuuuccuuuguaauaug

SEQ ID NO: 22831 - RNA, 21 nt, Artificial Sequence
  Marburg virus siRNA sense strand
ucucuuuccuuuguaauaugc

SEQ ID NO: 22832 - RNA, 21 nt, Artificial Sequence
  Marburg virus siRNA sense strand
cucuuuccuuuguaauaugcc

SEQ ID NO: 22833 - RNA, 21 nt, Artificial Sequence
  Marburg virus siRNA sense strand
ucuuuccuuuguaauaugcca

SEQ ID NO: 22834 - RNA, 21 nt, Artificial Sequence
  Marburg virus siRNA sense strand
cuuuccuuuguaauaugccaa

SEQ ID NO: 22835 - RNA, 21 nt, Artificial Sequence
  Marburg virus siRNA sense strand
uuuccuuuguaauaugccaau

SEQ ID NO: 22836 - RNA, 21 nt, Artificial Sequence
  Marburg virus siRNA sense strand
uuccuuuguaauaugccaauu

SEQ ID NO: 22837 - RNA, 21 nt, Artificial Sequence
  Marburg virus siRNA sense strand
uccuuuguaauaugccaauua

SEQ ID NO: 22838 - RNA, 21 nt, Artificial Sequence
  Marburg virus siRNA sense strand
ccuuuguaauaugccaauuaa

SEQ ID NO: 22839 - RNA, 21 nt, Artificial Sequence
  Marburg virus siRNA sense strand
cuuuguaauaugccaauuaag

SEQ ID NO: 22840 - RNA, 21 nt, Artificial Sequence
  Marburg virus siRNA sense strand
uuuguaauaugccaauuaaga

SEQ ID NO: 22841 - RNA, 21 nt, Artificial Sequence
  Marburg virus siRNA sense strand
uuguaauaugccaauuaagaa

SEQ ID NO: 22842 - RNA, 21 nt, Artificial Sequence
  Marburg virus siRNA sense strand
uguaauaugccaauuaagaaa

SEQ ID NO: 22843 - RNA, 21 nt, Artificial Sequence
  Marburg virus siRNA sense strand
guaauaugccaauuaagaaaa

SEQ ID NO: 22844 - RNA, 21 nt, Artificial Sequence
  Marburg virus siRNA sense strand
uaauaugccaauuaagaaaaa

SEQ ID NO: 22845 - RNA, 21 nt, Artificial Sequence
  Marburg virus siRNA sense strand
aauaugccaauuaagaaaaac

SEQ ID NO: 22846 - RNA, 21 nt, Artificial Sequence
  Marburg virus siRNA sense strand
auaugccaauuaagaaaaacu

SEQ ID NO: 22847 - RNA, 21 nt, Artificial Sequence
  Marburg virus siRNA sense strand
uaugccaauuaagaaaaacua

SEQ ID NO: 22848 - RNA, 21 nt, Artificial Sequence
  Marburg virus siRNA sense strand
augccaauuaagaaaaacuaa

SEQ ID NO: 22849 - RNA, 21 nt, Artificial Sequence
  Marburg virus siRNA sense strand
ugccaauuaagaaaaacuaaa

SEQ ID NO: 22850 - RNA, 21 nt, Artificial Sequence
  Marburg virus siRNA sense strand
gccaauuaagaaaaacuaaaa

SEQ ID NO: 22851 - RNA, 21 nt, Artificial Sequence
  Marburg virus siRNA sense strand
ccaauuaagaaaaacuaaaaa

SEQ ID NO: 22852 - RNA, 21 nt, Artificial Sequence
  Marburg virus siRNA sense strand
caauuaagaaaaacuaaaaau

SEQ ID NO: 22853 - RNA, 21 nt, Artificial Sequence
  Marburg virus siRNA sense strand
aauuaagaaaaacuaaaaauc

SEQ ID NO: 22854 - RNA, 21 nt, Artificial Sequence
  Marburg virus siRNA sense strand
auuaagaaaaacuaaaaaucg

SEQ ID NO: 22855 - RNA, 21 nt, Artificial Sequence
  Marburg virus siRNA sense strand
uuaagaaaaacuaaaaaucga

SEQ ID NO: 22856 - RNA, 21 nt, Artificial Sequence
  Marburg virus siRNA sense strand
uaagaaaaacuaaaaaucgaa

SEQ ID NO: 22857 - RNA, 21 nt, Artificial Sequence
  Marburg virus siRNA sense strand
aagaaaaacuaaaaaucgaag

SEQ ID NO: 22858 - RNA, 21 nt, Artificial Sequence
  Marburg virus siRNA sense strand
agaaaaacuaaaaaucgaaga

SEQ ID NO: 22859 - RNA, 21 nt, Artificial Sequence
  Marburg virus siRNA sense strand
gaaaaacuaaaaaucgaagaa

SEQ ID NO: 22860 - RNA, 21 nt, Artificial Sequence
  Marburg virus siRNA sense strand
aaaaacuaaaaaucgaagaau

SEQ ID NO: 22861 - RNA, 21 nt, Artificial Sequence
  Marburg virus siRNA sense strand
aaaacuaaaaaucgaagaaua

SEQ ID NO: 22862 - RNA, 21 nt, Artificial Sequence
  Marburg virus siRNA sense strand
aaacuaaaaaucgaagaauau

SEQ ID NO: 22863 - RNA, 21 nt, Artificial Sequence
  Marburg virus siRNA sense strand
aacuaaaaaucgaagaauauu

SEQ ID NO: 22864 - RNA, 21 nt, Artificial Sequence
  Marburg virus siRNA sense strand
acuaaaaaucgaagaauauua

SEQ ID NO: 22865 - RNA, 21 nt, Artificial Sequence
  Marburg virus siRNA sense strand
cuaaaaaucgaagaauauuaa

SEQ ID NO: 22866 - RNA, 21 nt, Artificial Sequence
  Marburg virus siRNA sense strand
uaaaaaucgaagaauauuaaa

SEQ ID NO: 22867 - RNA, 21 nt, Artificial Sequence
  Marburg virus siRNA sense strand
aaaaaucgaagaauauuaaag

SEQ ID NO: 22868 - RNA, 21 nt, Artificial Sequence
  Marburg virus siRNA sense strand
aaaaucgaagaauauuaaagg

SEQ ID NO: 22869 - RNA, 21 nt, Artificial Sequence
  Marburg virus siRNA sense strand
aaaucgaagaauauuaaaggu

SEQ ID NO: 22870 - RNA, 21 nt, Artificial Sequence
  Marburg virus siRNA sense strand
aaucgaagaauauuaaagguu

SEQ ID NO: 22871 - RNA, 21 nt, Artificial Sequence
  Marburg virus siRNA sense strand
aucgaagaauauuaaagguuu

SEQ ID NO: 22872 - RNA, 21 nt, Artificial Sequence
  Marburg virus siRNA sense strand
ucgaagaauauuaaagguuuu

SEQ ID NO: 22873 - RNA, 21 nt, Artificial Sequence
  Marburg virus siRNA sense strand
cgaagaauauuaaagguuuuc

SEQ ID NO: 22874 - RNA, 21 nt, Artificial Sequence
  Marburg virus siRNA sense strand
gaagaauauuaaagguuuucu

SEQ ID NO: 22875 - RNA, 21 nt, Artificial Sequence
  Marburg virus siRNA sense strand
aagaauauuaaagguuuucuu

SEQ ID NO: 22876 - RNA, 21 nt, Artificial Sequence
  Marburg virus siRNA sense strand
agaauauuaaagguuuucuuu

SEQ ID NO: 22877 - RNA, 21 nt, Artificial Sequence
  Marburg virus siRNA sense strand
gaauauuaaagguuuucuuua

SEQ ID NO: 22878 - RNA, 21 nt, Artificial Sequence
  Marburg virus siRNA sense strand
aauauuaaagguuuucuuuaa

SEQ ID NO: 22879 - RNA, 21 nt, Artificial Sequence
  Marburg virus siRNA sense strand
auauuaaagguuuucuuuaau

SEQ ID NO: 22880 - RNA, 21 nt, Artificial Sequence
  Marburg virus siRNA sense strand
uauuaaagguuuucuuuaaua

SEQ ID NO: 22881 - RNA, 21 nt, Artificial Sequence
  Marburg virus siRNA sense strand
auuaaagguuuucuuuaauau

SEQ ID NO: 22882 - RNA, 21 nt, Artificial Sequence
  Marburg virus siRNA sense strand
uuaaagguuuucuuuaauauu

SEQ ID NO: 22883 - RNA, 21 nt, Artificial Sequence
  Marburg virus siRNA sense strand
uaaagguuuucuuuaauauuc

SEQ ID NO: 22884 - RNA, 21 nt, Artificial Sequence
  Marburg virus siRNA sense strand
aaagguuuucuuuaauauuca

SEQ ID NO: 22885 - RNA, 21 nt, Artificial Sequence
  Marburg virus siRNA sense strand
aagguuuucuuuaauauucag

SEQ ID NO: 22886 - RNA, 21 nt, Artificial Sequence
  Marburg virus siRNA sense strand
agguuuucuuuaauauucaga

SEQ ID NO: 22887 - RNA, 21 nt, Artificial Sequence
  Marburg virus siRNA sense strand
gguuuucuuuaauauucagaa

SEQ ID NO: 22888 - RNA, 21 nt, Artificial Sequence
  Marburg virus siRNA sense strand
guuuucuuuaauauucagaaa

SEQ ID NO: 22889 - RNA, 21 nt, Artificial Sequence
  Marburg virus siRNA sense strand
uuuucuuuaauauucagaaaa

SEQ ID NO: 22890 - RNA, 21 nt, Artificial Sequence
  Marburg virus siRNA sense strand
uuucuuuaauauucagaaaag

SEQ ID NO: 22891 - RNA, 21 nt, Artificial Sequence
  Marburg virus siRNA sense strand
uucuuuaauauucagaaaagg

SEQ ID NO: 22892 - RNA, 21 nt, Artificial Sequence
  Marburg virus siRNA sense strand
ucuuuaauauucagaaaaggu

SEQ ID NO: 22893 - RNA, 21 nt, Artificial Sequence
  Marburg virus siRNA sense strand
cuuuaauauucagaaaagguu

SEQ ID NO: 22894 - RNA, 21 nt, Artificial Sequence
  Marburg virus siRNA sense strand
uuuaauauucagaaaagguuu

SEQ ID NO: 22895 - RNA, 21 nt, Artificial Sequence
  Marburg virus siRNA sense strand
uuaauauucagaaaagguuuu

SEQ ID NO: 22896 - RNA, 21 nt, Artificial Sequence
  Marburg virus siRNA sense strand
uaauauucagaaaagguuuuu

SEQ ID NO: 22897 - RNA, 21 nt, Artificial Sequence
  Marburg virus siRNA sense strand
aauauucagaaaagguuuuuu

SEQ ID NO: 22898 - RNA, 21 nt, Artificial Sequence
  Marburg virus siRNA sense strand
auauucagaaaagguuuuuua

SEQ ID NO: 22899 - RNA, 21 nt, Artificial Sequence
  Marburg virus siRNA sense strand
uauucagaaaagguuuuuuau

SEQ ID NO: 22900 - RNA, 21 nt, Artificial Sequence
  Marburg virus siRNA sense strand
auucagaaaagguuuuuuauu

SEQ ID NO: 22901 - RNA, 21 nt, Artificial Sequence
  Marburg virus siRNA sense strand
uucagaaaagguuuuuuauuc

SEQ ID NO: 22902 - RNA, 21 nt, Artificial Sequence
  Marburg virus siRNA sense strand
ucagaaaagguuuuuuauucu

SEQ ID NO: 22903 - RNA, 21 nt, Artificial Sequence
  Marburg virus siRNA sense strand
cagaaaagguuuuuuauucuc

SEQ ID NO: 22904 - RNA, 21 nt, Artificial Sequence
  Marburg virus siRNA sense strand
agaaaagguuuuuuauucucu

SEQ ID NO: 22905 - RNA, 21 nt, Artificial Sequence
  Marburg virus siRNA sense strand
gaaaagguuuuuuauucucuu

SEQ ID NO: 22906 - RNA, 21 nt, Artificial Sequence
  Marburg virus siRNA sense strand
aaaagguuuuuuauucucuuc

SEQ ID NO: 22907 - RNA, 21 nt, Artificial Sequence
  Marburg virus siRNA sense strand
aaagguuuuuuauucucuucu

SEQ ID NO: 22908 - RNA, 21 nt, Artificial Sequence
  Marburg virus siRNA sense strand
aagguuuuuuauucucuucuu

SEQ ID NO: 22909 - RNA, 21 nt, Artificial Sequence
  Marburg virus siRNA sense strand
agguuuuuuauucucuucuuu

SEQ ID NO: 22910 - RNA, 21 nt, Artificial Sequence
  Marburg virus siRNA sense strand
gguuuuuuauucucuucuuuc

SEQ ID NO: 22911 - RNA, 21 nt, Artificial Sequence
  Marburg virus siRNA sense strand
guuuuuuauucucuucuuucu

SEQ ID NO: 22912 - RNA, 21 nt, Artificial Sequence
  Marburg virus siRNA sense strand
uuuuuuauucucuucuuucuu

SEQ ID NO: 22913 - RNA, 21 nt, Artificial Sequence
  Marburg virus siRNA sense strand
uuuuuauucucuucuuucuuu

SEQ ID NO: 22914 - RNA, 21 nt, Artificial Sequence
  Marburg virus siRNA sense strand
uuuuauucucuucuuucuuuu

SEQ ID NO: 22915 - RNA, 21 nt, Artificial Sequence
  Marburg virus siRNA sense strand
uuuauucucuucuuucuuuuu

SEQ ID NO: 22916 - RNA, 21 nt, Artificial Sequence
  Marburg virus siRNA sense strand
uuauucucuucuuucuuuuug

SEQ ID NO: 22917 - RNA, 21 nt, Artificial Sequence
  Marburg virus siRNA sense strand
uauucucuucuuucuuuuugc

SEQ ID NO: 22918 - RNA, 21 nt, Artificial Sequence
  Marburg virus siRNA sense strand
auucucuucuuucuuuuugca

SEQ ID NO: 22919 - RNA, 21 nt, Artificial Sequence
  Marburg virus siRNA sense strand
uucucuucuuucuuuuugcaa

SEQ ID NO: 22920 - RNA, 21 nt, Artificial Sequence
  Marburg virus siRNA sense strand
ucucuucuuucuuuuugcaaa

SEQ ID NO: 22921 - RNA, 21 nt, Artificial Sequence
  Marburg virus siRNA sense strand
cucuucuuucuuuuugcaaac

SEQ ID NO: 22922 - RNA, 21 nt, Artificial Sequence
  Marburg virus siRNA sense strand
ucuucuuucuuuuugcaaaca

SEQ ID NO: 22923 - RNA, 21 nt, Artificial Sequence
  Marburg virus siRNA sense strand
cuucuuucuuuuugcaaacau

SEQ ID NO: 22924 - RNA, 21 nt, Artificial Sequence
  Marburg virus siRNA sense strand
uucuuucuuuuugcaaacaua

SEQ ID NO: 22925 - RNA, 21 nt, Artificial Sequence
  Marburg virus siRNA sense strand
ucuuucuuuuugcaaacauau

SEQ ID NO: 22926 - RNA, 21 nt, Artificial Sequence
  Marburg virus siRNA sense strand
cuuucuuuuugcaaacauauu

SEQ ID NO: 22927 - RNA, 21 nt, Artificial Sequence
  Marburg virus siRNA sense strand
uuucuuuuugcaaacauauug

SEQ ID NO: 22928 - RNA, 21 nt, Artificial Sequence
  Marburg virus siRNA sense strand
uucuuuuugcaaacauauuga

SEQ ID NO: 22929 - RNA, 21 nt, Artificial Sequence
  Marburg virus siRNA sense strand
ucuuuuugcaaacauauugaa

SEQ ID NO: 22930 - RNA, 21 nt, Artificial Sequence
  Marburg virus siRNA sense strand
cuuuuugcaaacauauugaaa

SEQ ID NO: 22931 - RNA, 21 nt, Artificial Sequence
  Marburg virus siRNA sense strand
uuuuugcaaacauauugaaau

SEQ ID NO: 22932 - RNA, 21 nt, Artificial Sequence
  Marburg virus siRNA sense strand
uuuugcaaacauauugaaaua

SEQ ID NO: 22933 - RNA, 21 nt, Artificial Sequence
  Marburg virus siRNA sense strand
uuugcaaacauauugaaauaa

SEQ ID NO: 22934 - RNA, 21 nt, Artificial Sequence
  Marburg virus siRNA sense strand
uugcaaacauauugaaauaau

SEQ ID NO: 22935 - RNA, 21 nt, Artificial Sequence
  Marburg virus siRNA sense strand
ugcaaacauauugaaauaaua

SEQ ID NO: 22936 - RNA, 21 nt, Artificial Sequence
  Marburg virus siRNA sense strand
gcaaacauauugaaauaauaa

SEQ ID NO: 22937 - RNA, 21 nt, Artificial Sequence
  Marburg virus siRNA sense strand
caaacauauugaaauaauaau

SEQ ID NO: 22938 - RNA, 21 nt, Artificial Sequence
  Marburg virus siRNA sense strand
aaacauauugaaauaauaauu

SEQ ID NO: 22939 - RNA, 21 nt, Artificial Sequence
  Marburg virus siRNA sense strand
aacauauugaaauaauaauuu

SEQ ID NO: 22940 - RNA, 21 nt, Artificial Sequence
  Marburg virus siRNA sense strand
acauauugaaauaauaauuuu

SEQ ID NO: 22941 - RNA, 21 nt, Artificial Sequence
  Marburg virus siRNA sense strand
cauauugaaauaauaauuuuc

SEQ ID NO: 22942 - RNA, 21 nt, Artificial Sequence
  Marburg virus siRNA sense strand
auauugaaauaauaauuuuca

SEQ ID NO: 22943 - RNA, 21 nt, Artificial Sequence
  Marburg virus siRNA sense strand
uauugaaauaauaauuuucac

SEQ ID NO: 22944 - RNA, 21 nt, Artificial Sequence
  Marburg virus siRNA sense strand
auugaaauaauaauuuucaca

SEQ ID NO: 22945 - RNA, 21 nt, Artificial Sequence
  Marburg virus siRNA sense strand
uugaaauaauaauuuucacaa

SEQ ID NO: 22946 - RNA, 21 nt, Artificial Sequence
  Marburg virus siRNA sense strand
ugaaauaauaauuuucacaau

SEQ ID NO: 22947 - RNA, 21 nt, Artificial Sequence
  Marburg virus siRNA sense strand
gaaauaauaauuuucacaaug

SEQ ID NO: 22948 - RNA, 21 nt, Artificial Sequence
  Marburg virus siRNA sense strand
aaauaauaauuuucacaaugu

SEQ ID NO: 22949 - RNA, 21 nt, Artificial Sequence
  Marburg virus siRNA sense strand
aauaauaauuuucacaaugug

SEQ ID NO: 22950 - RNA, 21 nt, Artificial Sequence
  Marburg virus siRNA sense strand
auaauaauuuucacaaugugg

SEQ ID NO: 22951 - RNA, 21 nt, Artificial Sequence
  Marburg virus siRNA sense strand
uaauaauuuucacaauguggg

SEQ ID NO: 22952 - RNA, 21 nt, Artificial Sequence
  Marburg virus siRNA sense strand
aauaauuuucacaauguggga

SEQ ID NO: 22953 - RNA, 21 nt, Artificial Sequence
  Marburg virus siRNA sense strand
auaauuuucacaaugugggac

SEQ ID NO: 22954 - RNA, 21 nt, Artificial Sequence
  Marburg virus siRNA sense strand
uaauuuucacaaugugggacu

SEQ ID NO: 22955 - RNA, 21 nt, Artificial Sequence
  Marburg virus siRNA sense strand
aauuuucacaaugugggacuc

SEQ ID NO: 22956 - RNA, 21 nt, Artificial Sequence
  Marburg virus siRNA sense strand
auuuucacaaugugggacuca

SEQ ID NO: 22957 - RNA, 21 nt, Artificial Sequence
  Marburg virus siRNA sense strand
uuuucacaaugugggacucau

SEQ ID NO: 22958 - RNA, 21 nt, Artificial Sequence
  Marburg virus siRNA sense strand
uuucacaaugugggacucauc

SEQ ID NO: 22959 - RNA, 21 nt, Artificial Sequence
  Marburg virus siRNA sense strand
uucacaaugugggacucauca

SEQ ID NO: 22960 - RNA, 21 nt, Artificial Sequence
  Marburg virus siRNA sense strand
ucacaaugugggacucaucau

SEQ ID NO: 22961 - RNA, 21 nt, Artificial Sequence
  Marburg virus siRNA sense strand
cacaaugugggacucaucaua

SEQ ID NO: 22962 - RNA, 21 nt, Artificial Sequence
  Marburg virus siRNA sense strand
acaaugugggacucaucauau

SEQ ID NO: 22963 - RNA, 21 nt, Artificial Sequence
  Marburg virus siRNA sense strand
caaugugggacucaucauaua

SEQ ID NO: 22964 - RNA, 21 nt, Artificial Sequence
  Marburg virus siRNA sense strand
aaugugggacucaucauauau

SEQ ID NO: 22965 - RNA, 21 nt, Artificial Sequence
  Marburg virus siRNA sense strand
augugggacucaucauauaug

SEQ ID NO: 22966 - RNA, 21 nt, Artificial Sequence
  Marburg virus siRNA sense strand
ugugggacucaucauauaugc

SEQ ID NO: 22967 - RNA, 21 nt, Artificial Sequence
  Marburg virus siRNA sense strand
gugggacucaucauauaugca

SEQ ID NO: 22968 - RNA, 21 nt, Artificial Sequence
  Marburg virus siRNA sense strand
ugggacucaucauauaugcaa

SEQ ID NO: 22969 - RNA, 21 nt, Artificial Sequence
  Marburg virus siRNA sense strand
gggacucaucauauaugcaac

SEQ ID NO: 22970 - RNA, 21 nt, Artificial Sequence
  Marburg virus siRNA sense strand
ggacucaucauauaugcaaca

SEQ ID NO: 22971 - RNA, 21 nt, Artificial Sequence
  Marburg virus siRNA sense strand
gacucaucauauaugcaacaa

SEQ ID NO: 22972 - RNA, 21 nt, Artificial Sequence
  Marburg virus siRNA sense strand
acucaucauauaugcaacaag

SEQ ID NO: 22973 - RNA, 21 nt, Artificial Sequence
  Marburg virus siRNA sense strand
cucaucauauaugcaacaagu

SEQ ID NO: 22974 - RNA, 21 nt, Artificial Sequence
  Marburg virus siRNA sense strand
ucaucauauaugcaacaaguc

SEQ ID NO: 22975 - RNA, 21 nt, Artificial Sequence
  Marburg virus siRNA sense strand
caucauauaugcaacaaguca

SEQ ID NO: 22976 - RNA, 21 nt, Artificial Sequence
  Marburg virus siRNA sense strand
aucauauaugcaacaagucag

SEQ ID NO: 22977 - RNA, 21 nt, Artificial Sequence
  Marburg virus siRNA sense strand
ucauauaugcaacaagucagu

SEQ ID NO: 22978 - RNA, 21 nt, Artificial Sequence
  Marburg virus siRNA sense strand
cauauaugcaacaagucagug

SEQ ID NO: 22979 - RNA, 21 nt, Artificial Sequence
  Marburg virus siRNA sense strand
auauaugcaacaagucaguga

SEQ ID NO: 22980 - RNA, 21 nt, Artificial Sequence
  Marburg virus siRNA sense strand
uauaugcaacaagucagugag

SEQ ID NO: 22981 - RNA, 21 nt, Artificial Sequence
  Marburg virus siRNA sense strand
auaugcaacaagucagugagg

SEQ ID NO: 22982 - RNA, 21 nt, Artificial Sequence
  Marburg virus siRNA sense strand
uaugcaacaagucagugaggg

SEQ ID NO: 22983 - RNA, 21 nt, Artificial Sequence
  Marburg virus siRNA sense strand
augcaacaagucagugagggg

SEQ ID NO: 22984 - RNA, 21 nt, Artificial Sequence
  Marburg virus siRNA sense strand
ugcaacaagucagugaggggu

SEQ ID NO: 22985 - RNA, 21 nt, Artificial Sequence
  Marburg virus siRNA sense strand
gcaacaagucagugagggguu

SEQ ID NO: 22986 - RNA, 21 nt, Artificial Sequence
  Marburg virus siRNA sense strand
caacaagucagugagggguug

SEQ ID NO: 22987 - RNA, 21 nt, Artificial Sequence
  Marburg virus siRNA sense strand
aacaagucagugagggguuga

SEQ ID NO: 22988 - RNA, 21 nt, Artificial Sequence
  Marburg virus siRNA sense strand
acaagucagugagggguugau

SEQ ID NO: 22989 - RNA, 21 nt, Artificial Sequence
  Marburg virus siRNA sense strand
caagucagugagggguugaug

SEQ ID NO: 22990 - RNA, 21 nt, Artificial Sequence
  Marburg virus siRNA sense strand
aagucagugagggguugauga

SEQ ID NO: 22991 - RNA, 21 nt, Artificial Sequence
  Marburg virus siRNA sense strand
agucagugagggguugaugac

SEQ ID NO: 22992 - RNA, 21 nt, Artificial Sequence
  Marburg virus siRNA sense strand
gucagugagggguugaugacu

SEQ ID NO: 22993 - RNA, 21 nt, Artificial Sequence
  Marburg virus siRNA sense strand
ucagugagggguugaugacug

SEQ ID NO: 22994 - RNA, 21 nt, Artificial Sequence
  Marburg virus siRNA sense strand
cagugagggguugaugacugg

SEQ ID NO: 22995 - RNA, 21 nt, Artificial Sequence
  Marburg virus siRNA sense strand
agugagggguugaugacugga

SEQ ID NO: 22996 - RNA, 21 nt, Artificial Sequence
  Marburg virus siRNA sense strand
gugagggguugaugacuggaa

SEQ ID NO: 22997 - RNA, 21 nt, Artificial Sequence
  Marburg virus siRNA sense strand
ugagggguugaugacuggaaa

SEQ ID NO: 22998 - RNA, 21 nt, Artificial Sequence
  Marburg virus siRNA sense strand
gagggguugaugacuggaaaa

SEQ ID NO: 22999 - RNA, 21 nt, Artificial Sequence
  Marburg virus siRNA sense strand
agggguugaugacuggaaaag

SEQ ID NO: 23000 - RNA, 21 nt, Artificial Sequence
  Marburg virus siRNA sense strand
gggguugaugacuggaaaagu

SEQ ID NO: 23001 - RNA, 21 nt, Artificial Sequence
  Marburg virus siRNA sense strand
ggguugaugacuggaaaaguu

SEQ ID NO: 23002 - RNA, 21 nt, Artificial Sequence
  Marburg virus siRNA sense strand
gguugaugacuggaaaaguuc

SEQ ID NO: 23003 - RNA, 21 nt, Artificial Sequence
  Marburg virus siRNA sense strand
guugaugacuggaaaaguucc

SEQ ID NO: 23004 - RNA, 21 nt, Artificial Sequence
  Marburg virus siRNA sense strand
uugaugacuggaaaaguuccc

SEQ ID NO: 23005 - RNA, 21 nt, Artificial Sequence
  Marburg virus siRNA sense strand
ugaugacuggaaaaguuccca

SEQ ID NO: 23006 - RNA, 21 nt, Artificial Sequence
  Marburg virus siRNA sense strand
gaugacuggaaaaguucccau

SEQ ID NO: 23007 - RNA, 21 nt, Artificial Sequence
  Marburg virus siRNA sense strand
augacuggaaaaguucccaua

SEQ ID NO: 23008 - RNA, 21 nt, Artificial Sequence
  Marburg virus siRNA sense strand
ugacuggaaaaguucccauag

SEQ ID NO: 23009 - RNA, 21 nt, Artificial Sequence
  Marburg virus siRNA sense strand
gacuggaaaaguucccauaga

SEQ ID NO: 23010 - RNA, 21 nt, Artificial Sequence
  Marburg virus siRNA sense strand
acuggaaaaguucccauagau

SEQ ID NO: 23011 - RNA, 21 nt, Artificial Sequence
  Marburg virus siRNA sense strand
cuggaaaaguucccauagauc

SEQ ID NO: 23012 - RNA, 21 nt, Artificial Sequence
  Marburg virus siRNA sense strand
uggaaaaguucccauagauca

SEQ ID NO: 23013 - RNA, 21 nt, Artificial Sequence
  Marburg virus siRNA sense strand
ggaaaaguucccauagaucaa

SEQ ID NO: 23014 - RNA, 21 nt, Artificial Sequence
  Marburg virus siRNA sense strand
gaaaaguucccauagaucaag

SEQ ID NO: 23015 - RNA, 21 nt, Artificial Sequence
  Marburg virus siRNA sense strand
aaaaguucccauagaucaagu

SEQ ID NO: 23016 - RNA, 21 nt, Artificial Sequence
  Marburg virus siRNA sense strand
aaaguucccauagaucaagug

SEQ ID NO: 23017 - RNA, 21 nt, Artificial Sequence
  Marburg virus siRNA sense strand
aaguucccauagaucaagugu

SEQ ID NO: 23018 - RNA, 21 nt, Artificial Sequence
  Marburg virus siRNA sense strand
aguucccauagaucaaguguu

SEQ ID NO: 23019 - RNA, 21 nt, Artificial Sequence
  Marburg virus siRNA sense strand
guucccauagaucaaguguuu

SEQ ID NO: 23020 - RNA, 21 nt, Artificial Sequence
  Marburg virus siRNA sense strand
uucccauagaucaaguguuug

SEQ ID NO: 23021 - RNA, 21 nt, Artificial Sequence
  Marburg virus siRNA sense strand
ucccauagaucaaguguuugg

SEQ ID NO: 23022 - RNA, 21 nt, Artificial Sequence
  Marburg virus siRNA sense strand
cccauagaucaaguguuuggu

SEQ ID NO: 23023 - RNA, 21 nt, Artificial Sequence
  Marburg virus siRNA sense strand
ccauagaucaaguguuuggug

SEQ ID NO: 23024 - RNA, 21 nt, Artificial Sequence
  Marburg virus siRNA sense strand
cauagaucaaguguuuggugc

SEQ ID NO: 23025 - RNA, 21 nt, Artificial Sequence
  Marburg virus siRNA sense strand
auagaucaaguguuuggugcc

SEQ ID NO: 23026 - RNA, 21 nt, Artificial Sequence
  Marburg virus siRNA sense strand
uagaucaaguguuuggugcca

SEQ ID NO: 23027 - RNA, 21 nt, Artificial Sequence
  Marburg virus siRNA sense strand
agaucaaguguuuggugccaa

SEQ ID NO: 23028 - RNA, 21 nt, Artificial Sequence
  Marburg virus siRNA sense strand
gaucaaguguuuggugccaau

SEQ ID NO: 23029 - RNA, 21 nt, Artificial Sequence
  Marburg virus siRNA sense strand
aucaaguguuuggugccaauc

SEQ ID NO: 23030 - RNA, 21 nt, Artificial Sequence
  Marburg virus siRNA sense strand
ucaaguguuuggugccaaucc

SEQ ID NO: 23031 - RNA, 21 nt, Artificial Sequence
  Marburg virus siRNA sense strand
caaguguuuggugccaauccc

SEQ ID NO: 23032 - RNA, 21 nt, Artificial Sequence
  Marburg virus siRNA sense strand
aaguguuuggugccaaucccu

SEQ ID NO: 23033 - RNA, 21 nt, Artificial Sequence
  Marburg virus siRNA sense strand
aguguuuggugccaaucccuc

SEQ ID NO: 23034 - RNA, 21 nt, Artificial Sequence
  Marburg virus siRNA sense strand
guguuuggugccaaucccuca

SEQ ID NO: 23035 - RNA, 21 nt, Artificial Sequence
  Marburg virus siRNA sense strand
uguuuggugccaaucccucag

SEQ ID NO: 23036 - RNA, 21 nt, Artificial Sequence
  Marburg virus siRNA sense strand
guuuggugccaaucccucaga

SEQ ID NO: 23037 - RNA, 21 nt, Artificial Sequence
  Marburg virus siRNA sense strand
uuuggugccaaucccucagag

SEQ ID NO: 23038 - RNA, 21 nt, Artificial Sequence
  Marburg virus siRNA sense strand
uuggugccaaucccucagaga

SEQ ID NO: 23039 - RNA, 21 nt, Artificial Sequence
  Marburg virus siRNA sense strand
uggugccaaucccucagagaa

SEQ ID NO: 23040 - RNA, 21 nt, Artificial Sequence
  Marburg virus siRNA sense strand
ggugccaaucccucagagaag

SEQ ID NO: 23041 - RNA, 21 nt, Artificial Sequence
  Marburg virus siRNA sense strand
gugccaaucccucagagaagu

SEQ ID NO: 23042 - RNA, 21 nt, Artificial Sequence
  Marburg virus siRNA sense strand
ugccaaucccucagagaaguu

SEQ ID NO: 23043 - RNA, 21 nt, Artificial Sequence
  Marburg virus siRNA sense strand
gccaaucccucagagaaguua

SEQ ID NO: 23044 - RNA, 21 nt, Artificial Sequence
  Marburg virus siRNA sense strand
ccaaucccucagagaaguuac

SEQ ID NO: 23045 - RNA, 21 nt, Artificial Sequence
  Marburg virus siRNA sense strand
caaucccucagagaaguuaca

SEQ ID NO: 23046 - RNA, 21 nt, Artificial Sequence
  Marburg virus siRNA sense strand
aaucccucagagaaguuacac

SEQ ID NO: 23047 - RNA, 21 nt, Artificial Sequence
  Marburg virus siRNA sense strand
aucccucagagaaguuacaca

SEQ ID NO: 23048 - RNA, 21 nt, Artificial Sequence
  Marburg virus siRNA sense strand
ucccucagagaaguuacacaa

SEQ ID NO: 23049 - RNA, 21 nt, Artificial Sequence
  Marburg virus siRNA sense strand
cccucagagaaguuacacaag

SEQ ID NO: 23050 - RNA, 21 nt, Artificial Sequence
  Marburg virus siRNA sense strand
ccucagagaaguuacacaaga

SEQ ID NO: 23051 - RNA, 21 nt, Artificial Sequence
  Marburg virus siRNA sense strand
cucagagaaguuacacaagag

SEQ ID NO: 23052 - RNA, 21 nt, Artificial Sequence
  Marburg virus siRNA sense strand
ucagagaaguuacacaagaga

SEQ ID NO: 23053 - RNA, 21 nt, Artificial Sequence
  Marburg virus siRNA sense strand
cagagaaguuacacaagagaa

SEQ ID NO: 23054 - RNA, 21 nt, Artificial Sequence
  Marburg virus siRNA sense strand
agagaaguuacacaagagaag

SEQ ID NO: 23055 - RNA, 21 nt, Artificial Sequence
  Marburg virus siRNA sense strand
gagaaguuacacaagagaagg

SEQ ID NO: 23056 - RNA, 21 nt, Artificial Sequence
  Marburg virus siRNA sense strand
agaaguuacacaagagaagga

SEQ ID NO: 23057 - RNA, 21 nt, Artificial Sequence
  Marburg virus siRNA sense strand
gaaguuacacaagagaaggaa

SEQ ID NO: 23058 - RNA, 21 nt, Artificial Sequence
  Marburg virus siRNA sense strand
aaguuacacaagagaaggaaa

SEQ ID NO: 23059 - RNA, 21 nt, Artificial Sequence
  Marburg virus siRNA sense strand
aguuacacaagagaaggaaac

SEQ ID NO: 23060 - RNA, 21 nt, Artificial Sequence
  Marburg virus siRNA sense strand
guuacacaagagaaggaaacc

SEQ ID NO: 23061 - RNA, 21 nt, Artificial Sequence
  Marburg virus siRNA sense strand
uuacacaagagaaggaaacca

SEQ ID NO: 23062 - RNA, 21 nt, Artificial Sequence
  Marburg virus siRNA sense strand
uacacaagagaaggaaaccaa

SEQ ID NO: 23063 - RNA, 21 nt, Artificial Sequence
  Marburg virus siRNA sense strand
acacaagagaaggaaaccaaa

SEQ ID NO: 23064 - RNA, 21 nt, Artificial Sequence
  Marburg virus siRNA sense strand
cacaagagaaggaaaccaaaa

SEQ ID NO: 23065 - RNA, 21 nt, Artificial Sequence
  Marburg virus siRNA sense strand
acaagagaaggaaaccaaaag

SEQ ID NO: 23066 - RNA, 21 nt, Artificial Sequence
  Marburg virus siRNA sense strand
caagagaaggaaaccaaaagg

SEQ ID NO: 23067 - RNA, 21 nt, Artificial Sequence
  Marburg virus siRNA sense strand
aagagaaggaaaccaaaaggc

SEQ ID NO: 23068 - RNA, 21 nt, Artificial Sequence
  Marburg virus siRNA sense strand
agagaaggaaaccaaaaggca

SEQ ID NO: 23069 - RNA, 21 nt, Artificial Sequence
  Marburg virus siRNA sense strand
gagaaggaaaccaaaaggcac

SEQ ID NO: 23070 - RNA, 21 nt, Artificial Sequence
  Marburg virus siRNA sense strand
agaaggaaaccaaaaggcaca

SEQ ID NO: 23071 - RNA, 21 nt, Artificial Sequence
  Marburg virus siRNA sense strand
gaaggaaaccaaaaggcacag

SEQ ID NO: 23072 - RNA, 21 nt, Artificial Sequence
  Marburg virus siRNA sense strand
aaggaaaccaaaaggcacagu

SEQ ID NO: 23073 - RNA, 21 nt, Artificial Sequence
  Marburg virus siRNA sense strand
aggaaaccaaaaggcacaguu

SEQ ID NO: 23074 - RNA, 21 nt, Artificial Sequence
  Marburg virus siRNA sense strand
ggaaaccaaaaggcacaguug

SEQ ID NO: 23075 - RNA, 21 nt, Artificial Sequence
  Marburg virus siRNA sense strand
gaaaccaaaaggcacaguugg

SEQ ID NO: 23076 - RNA, 21 nt, Artificial Sequence
  Marburg virus siRNA sense strand
aaaccaaaaggcacaguugga

SEQ ID NO: 23077 - RNA, 21 nt, Artificial Sequence
  Marburg virus siRNA sense strand
aaccaaaaggcacaguuggac

SEQ ID NO: 23078 - RNA, 21 nt, Artificial Sequence
  Marburg virus siRNA sense strand
accaaaaggcacaguuggacu

SEQ ID NO: 23079 - RNA, 21 nt, Artificial Sequence
  Marburg virus siRNA sense strand
ccaaaaggcacaguuggacua

SEQ ID NO: 23080 - RNA, 21 nt, Artificial Sequence
  Marburg virus siRNA sense strand
caaaaggcacaguuggacuac

SEQ ID NO: 23081 - RNA, 21 nt, Artificial Sequence
  Marburg virus siRNA sense strand
aaaaggcacaguuggacuaca

SEQ ID NO: 23082 - RNA, 21 nt, Artificial Sequence
  Marburg virus siRNA sense strand
aaaggcacaguuggacuacaa

SEQ ID NO: 23083 - RNA, 21 nt, Artificial Sequence
  Marburg virus siRNA sense strand
aaggcacaguuggacuacaau

SEQ ID NO: 23084 - RNA, 21 nt, Artificial Sequence
  Marburg virus siRNA sense strand
aggcacaguuggacuacaaug

SEQ ID NO: 23085 - RNA, 21 nt, Artificial Sequence
  Marburg virus siRNA sense strand
ggcacaguuggacuacaaugc

SEQ ID NO: 23086 - RNA, 21 nt, Artificial Sequence
  Marburg virus siRNA sense strand
gcacaguuggacuacaaugca

SEQ ID NO: 23087 - RNA, 21 nt, Artificial Sequence
  Marburg virus siRNA sense strand
cacaguuggacuacaaugcag

SEQ ID NO: 23088 - RNA, 21 nt, Artificial Sequence
  Marburg virus siRNA sense strand
acaguuggacuacaaugcagc

SEQ ID NO: 23089 - RNA, 21 nt, Artificial Sequence
  Marburg virus siRNA sense strand
caguuggacuacaaugcagcc

SEQ ID NO: 23090 - RNA, 21 nt, Artificial Sequence
  Marburg virus siRNA sense strand
aguuggacuacaaugcagccc

SEQ ID NO: 23091 - RNA, 21 nt, Artificial Sequence
  Marburg virus siRNA sense strand
guuggacuacaaugcagcccu

SEQ ID NO: 23092 - RNA, 21 nt, Artificial Sequence
  Marburg virus siRNA sense strand
uuggacuacaaugcagcccuu

SEQ ID NO: 23093 - RNA, 21 nt, Artificial Sequence
  Marburg virus siRNA sense strand
uggacuacaaugcagcccuug

SEQ ID NO: 23094 - RNA, 21 nt, Artificial Sequence
  Marburg virus siRNA sense strand
ggacuacaaugcagcccuugu

SEQ ID NO: 23095 - RNA, 21 nt, Artificial Sequence
  Marburg virus siRNA sense strand
gacuacaaugcagcccuuguc

SEQ ID NO: 23096 - RNA, 21 nt, Artificial Sequence
  Marburg virus siRNA sense strand
acuacaaugcagcccuugucu

SEQ ID NO: 23097 - RNA, 21 nt, Artificial Sequence
  Marburg virus siRNA sense strand
cuacaaugcagcccuugucua

SEQ ID NO: 23098 - RNA, 21 nt, Artificial Sequence
  Marburg virus siRNA sense strand
uacaaugcagcccuugucuaa

SEQ ID NO: 23099 - RNA, 21 nt, Artificial Sequence
  Marburg virus siRNA sense strand
acaaugcagcccuugucuaau

SEQ ID NO: 23100 - RNA, 21 nt, Artificial Sequence
  Marburg virus siRNA sense strand
caaugcagcccuugucuaaug

SEQ ID NO: 23101 - RNA, 21 nt, Artificial Sequence
  Marburg virus siRNA sense strand
aaugcagcccuugucuaaugu

SEQ ID NO: 23102 - RNA, 21 nt, Artificial Sequence
  Marburg virus siRNA sense strand
augcagcccuugucuaauguc

SEQ ID NO: 23103 - RNA, 21 nt, Artificial Sequence
  Marburg virus siRNA sense strand
ugcagcccuugucuaauguca

SEQ ID NO: 23104 - RNA, 21 nt, Artificial Sequence
  Marburg virus siRNA sense strand
gcagcccuugucuaaugucaa

SEQ ID NO: 23105 - RNA, 21 nt, Artificial Sequence
  Marburg virus siRNA sense strand
cagcccuugucuaaugucaaa

SEQ ID NO: 23106 - RNA, 21 nt, Artificial Sequence
  Marburg virus siRNA sense strand
agcccuugucuaaugucaaag

SEQ ID NO: 23107 - RNA, 21 nt, Artificial Sequence
  Marburg virus siRNA sense strand
gcccuugucuaaugucaaagg

SEQ ID NO: 23108 - RNA, 21 nt, Artificial Sequence
  Marburg virus siRNA sense strand
cccuugucuaaugucaaaggc

SEQ ID NO: 23109 - RNA, 21 nt, Artificial Sequence
  Marburg virus siRNA sense strand
ccuugucuaaugucaaaggcg

SEQ ID NO: 23110 - RNA, 21 nt, Artificial Sequence
  Marburg virus siRNA sense strand
cuugucuaaugucaaaggcga

SEQ ID NO: 23111 - RNA, 21 nt, Artificial Sequence
  Marburg virus siRNA sense strand
uugucuaaugucaaaggcgac

SEQ ID NO: 23112 - RNA, 21 nt, Artificial Sequence
  Marburg virus siRNA sense strand
ugucuaaugucaaaggcgaca

SEQ ID NO: 23113 - RNA, 21 nt, Artificial Sequence
  Marburg virus siRNA sense strand
gucuaaugucaaaggcgacaa

SEQ ID NO: 23114 - RNA, 21 nt, Artificial Sequence
  Marburg virus siRNA sense strand
ucuaaugucaaaggcgacaag

SEQ ID NO: 23115 - RNA, 21 nt, Artificial Sequence
  Marburg virus siRNA sense strand
cuaaugucaaaggcgacaagc

SEQ ID NO: 23116 - RNA, 21 nt, Artificial Sequence
  Marburg virus siRNA sense strand
uaaugucaaaggcgacaagca

SEQ ID NO: 23117 - RNA, 21 nt, Artificial Sequence
  Marburg virus siRNA sense strand
aaugucaaaggcgacaagcac

SEQ ID NO: 23118 - RNA, 21 nt, Artificial Sequence
  Marburg virus siRNA sense strand
augucaaaggcgacaagcacu

SEQ ID NO: 23119 - RNA, 21 nt, Artificial Sequence
  Marburg virus siRNA sense strand
ugucaaaggcgacaagcacug

SEQ ID NO: 23120 - RNA, 21 nt, Artificial Sequence
  Marburg virus siRNA sense strand
gucaaaggcgacaagcacuga

SEQ ID NO: 23121 - RNA, 21 nt, Artificial Sequence
  Marburg virus siRNA sense strand
ucaaaggcgacaagcacugau

SEQ ID NO: 23122 - RNA, 21 nt, Artificial Sequence
  Marburg virus siRNA sense strand
caaaggcgacaagcacugaug

SEQ ID NO: 23123 - RNA, 21 nt, Artificial Sequence
  Marburg virus siRNA sense strand
aaaggcgacaagcacugauga

SEQ ID NO: 23124 - RNA, 21 nt, Artificial Sequence
  Marburg virus siRNA sense strand
aaggcgacaagcacugaugau

SEQ ID NO: 23125 - RNA, 21 nt, Artificial Sequence
  Marburg virus siRNA sense strand
aggcgacaagcacugaugaua

SEQ ID NO: 23126 - RNA, 21 nt, Artificial Sequence
  Marburg virus siRNA sense strand
ggcgacaagcacugaugauau

SEQ ID NO: 23127 - RNA, 21 nt, Artificial Sequence
  Marburg virus siRNA sense strand
gcgacaagcacugaugauauu

SEQ ID NO: 23128 - RNA, 21 nt, Artificial Sequence
  Marburg virus siRNA sense strand
cgacaagcacugaugauauug

SEQ ID NO: 23129 - RNA, 21 nt, Artificial Sequence
  Marburg virus siRNA sense strand
gacaagcacugaugauauugu

SEQ ID NO: 23130 - RNA, 21 nt, Artificial Sequence
  Marburg virus siRNA sense strand
acaagcacugaugauauuguu

SEQ ID NO: 23131 - RNA, 21 nt, Artificial Sequence
  Marburg virus siRNA sense strand
caagcacugaugauauuguuu

SEQ ID NO: 23132 - RNA, 21 nt, Artificial Sequence
  Marburg virus siRNA sense strand
aagcacugaugauauuguuug

SEQ ID NO: 23133 - RNA, 21 nt, Artificial Sequence
  Marburg virus siRNA sense strand
agcacugaugauauuguuugg

SEQ ID NO: 23134 - RNA, 21 nt, Artificial Sequence
  Marburg virus siRNA sense strand
gcacugaugauauuguuuggg

SEQ ID NO: 23135 - RNA, 21 nt, Artificial Sequence
  Marburg virus siRNA sense strand
cacugaugauauuguuuggga

SEQ ID NO: 23136 - RNA, 21 nt, Artificial Sequence
  Marburg virus siRNA sense strand
acugaugauauuguuugggac

SEQ ID NO: 23137 - RNA, 21 nt, Artificial Sequence
  Marburg virus siRNA sense strand
cugaugauauuguuugggacc

SEQ ID NO: 23138 - RNA, 21 nt, Artificial Sequence
  Marburg virus siRNA sense strand
ugaugauauuguuugggacca

SEQ ID NO: 23139 - RNA, 21 nt, Artificial Sequence
  Marburg virus siRNA sense strand
gaugauauuguuugggaccaa

SEQ ID NO: 23140 - RNA, 21 nt, Artificial Sequence
  Marburg virus siRNA sense strand
augauauuguuugggaccaac

SEQ ID NO: 23141 - RNA, 21 nt, Artificial Sequence
  Marburg virus siRNA sense strand
ugauauuguuugggaccaacu

SEQ ID NO: 23142 - RNA, 21 nt, Artificial Sequence
  Marburg virus siRNA sense strand
gauauuguuugggaccaacug

SEQ ID NO: 23143 - RNA, 21 nt, Artificial Sequence
  Marburg virus siRNA sense strand
auauuguuugggaccaacuga

SEQ ID NO: 23144 - RNA, 21 nt, Artificial Sequence
  Marburg virus siRNA sense strand
uauuguuugggaccaacugau

SEQ ID NO: 23145 - RNA, 21 nt, Artificial Sequence
  Marburg virus siRNA sense strand
auuguuugggaccaacugauc

SEQ ID NO: 23146 - RNA, 21 nt, Artificial Sequence
  Marburg virus siRNA sense strand
uuguuugggaccaacugaucg

SEQ ID NO: 23147 - RNA, 21 nt, Artificial Sequence
  Marburg virus siRNA sense strand
uguuugggaccaacugaucgu

SEQ ID NO: 23148 - RNA, 21 nt, Artificial Sequence
  Marburg virus siRNA sense strand
guuugggaccaacugaucgug

SEQ ID NO: 23149 - RNA, 21 nt, Artificial Sequence
  Marburg virus siRNA sense strand
uuugggaccaacugaucguga

SEQ ID NO: 23150 - RNA, 21 nt, Artificial Sequence
  Marburg virus siRNA sense strand
uugggaccaacugaucgugaa

SEQ ID NO: 23151 - RNA, 21 nt, Artificial Sequence
  Marburg virus siRNA sense strand
ugggaccaacugaucgugaag

SEQ ID NO: 23152 - RNA, 21 nt, Artificial Sequence
  Marburg virus siRNA sense strand
gggaccaacugaucgugaaga

SEQ ID NO: 23153 - RNA, 21 nt, Artificial Sequence
  Marburg virus siRNA sense strand
ggaccaacugaucgugaagaa

SEQ ID NO: 23154 - RNA, 21 nt, Artificial Sequence
  Marburg virus siRNA sense strand
gaccaacugaucgugaagaaa

SEQ ID NO: 23155 - RNA, 21 nt, Artificial Sequence
  Marburg virus siRNA sense strand
accaacugaucgugaagaaaa

SEQ ID NO: 23156 - RNA, 21 nt, Artificial Sequence
  Marburg virus siRNA sense strand
ccaacugaucgugaagaaaac

SEQ ID NO: 23157 - RNA, 21 nt, Artificial Sequence
  Marburg virus siRNA sense strand
caacugaucgugaagaaaaca

SEQ ID NO: 23158 - RNA, 21 nt, Artificial Sequence
  Marburg virus siRNA sense strand
aacugaucgugaagaaaacac

SEQ ID NO: 23159 - RNA, 21 nt, Artificial Sequence
  Marburg virus siRNA sense strand
acugaucgugaagaaaacacu

SEQ ID NO: 23160 - RNA, 21 nt, Artificial Sequence
  Marburg virus siRNA sense strand
cugaucgugaagaaaacacua

SEQ ID NO: 23161 - RNA, 21 nt, Artificial Sequence
  Marburg virus siRNA sense strand
ugaucgugaagaaaacacuag

SEQ ID NO: 23162 - RNA, 21 nt, Artificial Sequence
  Marburg virus siRNA sense strand
gaucgugaagaaaacacuagc

SEQ ID NO: 23163 - RNA, 21 nt, Artificial Sequence
  Marburg virus siRNA sense strand
aucgugaagaaaacacuagcu

SEQ ID NO: 23164 - RNA, 21 nt, Artificial Sequence
  Marburg virus siRNA sense strand
ucgugaagaaaacacuagcug

SEQ ID NO: 23165 - RNA, 21 nt, Artificial Sequence
  Marburg virus siRNA sense strand
cgugaagaaaacacuagcuga

SEQ ID NO: 23166 - RNA, 21 nt, Artificial Sequence
  Marburg virus siRNA sense strand
gugaagaaaacacuagcugau

SEQ ID NO: 23167 - RNA, 21 nt, Artificial Sequence
  Marburg virus siRNA sense strand
ugaagaaaacacuagcugauc

SEQ ID NO: 23168 - RNA, 21 nt, Artificial Sequence
  Marburg virus siRNA sense strand
gaagaaaacacuagcugaucu

SEQ ID NO: 23169 - RNA, 21 nt, Artificial Sequence
  Marburg virus siRNA sense strand
aagaaaacacuagcugaucua

SEQ ID NO: 23170 - RNA, 21 nt, Artificial Sequence
  Marburg virus siRNA sense strand
agaaaacacuagcugaucuac

SEQ ID NO: 23171 - RNA, 21 nt, Artificial Sequence
  Marburg virus siRNA sense strand
gaaaacacuagcugaucuacu

SEQ ID NO: 23172 - RNA, 21 nt, Artificial Sequence
  Marburg virus siRNA sense strand
aaaacacuagcugaucuacuu

SEQ ID NO: 23173 - RNA, 21 nt, Artificial Sequence
  Marburg virus siRNA sense strand
aaacacuagcugaucuacuua

SEQ ID NO: 23174 - RNA, 21 nt, Artificial Sequence
  Marburg virus siRNA sense strand
aacacuagcugaucuacuuau

SEQ ID NO: 23175 - RNA, 21 nt, Artificial Sequence
  Marburg virus siRNA sense strand
acacuagcugaucuacuuaua

SEQ ID NO: 23176 - RNA, 21 nt, Artificial Sequence
  Marburg virus siRNA sense strand
cacuagcugaucuacuuauac

SEQ ID NO: 23177 - RNA, 21 nt, Artificial Sequence
  Marburg virus siRNA sense strand
acuagcugaucuacuuauacc

SEQ ID NO: 23178 - RNA, 21 nt, Artificial Sequence
  Marburg virus siRNA sense strand
cuagcugaucuacuuauaccg

SEQ ID NO: 23179 - RNA, 21 nt, Artificial Sequence
  Marburg virus siRNA sense strand
uagcugaucuacuuauaccga

SEQ ID NO: 23180 - RNA, 21 nt, Artificial Sequence
  Marburg virus siRNA sense strand
agcugaucuacuuauaccgau

SEQ ID NO: 23181 - RNA, 21 nt, Artificial Sequence
  Marburg virus siRNA sense strand
gcugaucuacuuauaccgaua

SEQ ID NO: 23182 - RNA, 21 nt, Artificial Sequence
  Marburg virus siRNA sense strand
cugaucuacuuauaccgauaa

SEQ ID NO: 23183 - RNA, 21 nt, Artificial Sequence
  Marburg virus siRNA sense strand
ugaucuacuuauaccgauaaa

SEQ ID NO: 23184 - RNA, 21 nt, Artificial Sequence
  Marburg virus siRNA sense strand
gaucuacuuauaccgauaaau

SEQ ID NO: 23185 - RNA, 21 nt, Artificial Sequence
  Marburg virus siRNA sense strand
aucuacuuauaccgauaaaua

SEQ ID NO: 23186 - RNA, 21 nt, Artificial Sequence
  Marburg virus siRNA sense strand
ucuacuuauaccgauaaauag

SEQ ID NO: 23187 - RNA, 21 nt, Artificial Sequence
  Marburg virus siRNA sense strand
cuacuuauaccgauaaauagg

SEQ ID NO: 23188 - RNA, 21 nt, Artificial Sequence
  Marburg virus siRNA sense strand
uacuuauaccgauaaauaggc

SEQ ID NO: 23189 - RNA, 21 nt, Artificial Sequence
  Marburg virus siRNA sense strand
acuuauaccgauaaauaggca

SEQ ID NO: 23190 - RNA, 21 nt, Artificial Sequence
  Marburg virus siRNA sense strand
cuuauaccgauaaauaggcag

SEQ ID NO: 23191 - RNA, 21 nt, Artificial Sequence
  Marburg virus siRNA sense strand
uuauaccgauaaauaggcaga

SEQ ID NO: 23192 - RNA, 21 nt, Artificial Sequence
  Marburg virus siRNA sense strand
uauaccgauaaauaggcagau

SEQ ID NO: 23193 - RNA, 21 nt, Artificial Sequence
  Marburg virus siRNA sense strand
auaccgauaaauaggcagaua

SEQ ID NO: 23194 - RNA, 21 nt, Artificial Sequence
  Marburg virus siRNA sense strand
uaccgauaaauaggcagauau

SEQ ID NO: 23195 - RNA, 21 nt, Artificial Sequence
  Marburg virus siRNA sense strand
accgauaaauaggcagauauc

SEQ ID NO: 23196 - RNA, 21 nt, Artificial Sequence
  Marburg virus siRNA sense strand
ccgauaaauaggcagauaucg

SEQ ID NO: 23197 - RNA, 21 nt, Artificial Sequence
  Marburg virus siRNA sense strand
cgauaaauaggcagauaucgg

SEQ ID NO: 23198 - RNA, 21 nt, Artificial Sequence
  Marburg virus siRNA sense strand
gauaaauaggcagauaucgga

SEQ ID NO: 23199 - RNA, 21 nt, Artificial Sequence
  Marburg virus siRNA sense strand
auaaauaggcagauaucggac

SEQ ID NO: 23200 - RNA, 21 nt, Artificial Sequence
  Marburg virus siRNA sense strand
uaaauaggcagauaucggaca

SEQ ID NO: 23201 - RNA, 21 nt, Artificial Sequence
  Marburg virus siRNA sense strand
aaauaggcagauaucggacau

SEQ ID NO: 23202 - RNA, 21 nt, Artificial Sequence
  Marburg virus siRNA sense strand
aauaggcagauaucggacauu

SEQ ID NO: 23203 - RNA, 21 nt, Artificial Sequence
  Marburg virus siRNA sense strand
auaggcagauaucggacauuc

SEQ ID NO: 23204 - RNA, 21 nt, Artificial Sequence
  Marburg virus siRNA sense strand
uaggcagauaucggacauuca

SEQ ID NO: 23205 - RNA, 21 nt, Artificial Sequence
  Marburg virus siRNA sense strand
aggcagauaucggacauucaa

SEQ ID NO: 23206 - RNA, 21 nt, Artificial Sequence
  Marburg virus siRNA sense strand
ggcagauaucggacauucaaa

SEQ ID NO: 23207 - RNA, 21 nt, Artificial Sequence
  Marburg virus siRNA sense strand
gcagauaucggacauucaaag

SEQ ID NO: 23208 - RNA, 21 nt, Artificial Sequence
  Marburg virus siRNA sense strand
cagauaucggacauucaaagc

SEQ ID NO: 23209 - RNA, 21 nt, Artificial Sequence
  Marburg virus siRNA sense strand
agauaucggacauucaaagca

SEQ ID NO: 23210 - RNA, 21 nt, Artificial Sequence
  Marburg virus siRNA sense strand
gauaucggacauucaaagcac

SEQ ID NO: 23211 - RNA, 21 nt, Artificial Sequence
  Marburg virus siRNA sense strand
auaucggacauucaaagcacu

SEQ ID NO: 23212 - RNA, 21 nt, Artificial Sequence
  Marburg virus siRNA sense strand
uaucggacauucaaagcacuc

SEQ ID NO: 23213 - RNA, 21 nt, Artificial Sequence
  Marburg virus siRNA sense strand
aucggacauucaaagcacucu

SEQ ID NO: 23214 - RNA, 21 nt, Artificial Sequence
  Marburg virus siRNA sense strand
ucggacauucaaagcacucua

SEQ ID NO: 23215 - RNA, 21 nt, Artificial Sequence
  Marburg virus siRNA sense strand
cggacauucaaagcacucuaa

SEQ ID NO: 23216 - RNA, 21 nt, Artificial Sequence
  Marburg virus siRNA sense strand
ggacauucaaagcacucuaaa

SEQ ID NO: 23217 - RNA, 21 nt, Artificial Sequence
  Marburg virus siRNA sense strand
gacauucaaagcacucuaaac

SEQ ID NO: 23218 - RNA, 21 nt, Artificial Sequence
  Marburg virus siRNA sense strand
acauucaaagcacucuaaacg

SEQ ID NO: 23219 - RNA, 21 nt, Artificial Sequence
  Marburg virus siRNA sense strand
cauucaaagcacucuaaacga

SEQ ID NO: 23220 - RNA, 21 nt, Artificial Sequence
  Marburg virus siRNA sense strand
auucaaagcacucuaaacgaa

SEQ ID NO: 23221 - RNA, 21 nt, Artificial Sequence
  Marburg virus siRNA sense strand
uucaaagcacucuaaacgaag

SEQ ID NO: 23222 - RNA, 21 nt, Artificial Sequence
  Marburg virus siRNA sense strand
ucaaagcacucuaaacgaagu

SEQ ID NO: 23223 - RNA, 21 nt, Artificial Sequence
  Marburg virus siRNA sense strand
caaagcacucuaaacgaagua

SEQ ID NO: 23224 - RNA, 21 nt, Artificial Sequence
  Marburg virus siRNA sense strand
aaagcacucuaaacgaaguaa

SEQ ID NO: 23225 - RNA, 21 nt, Artificial Sequence
  Marburg virus siRNA sense strand
aagcacucuaaacgaaguaac

SEQ ID NO: 23226 - RNA, 21 nt, Artificial Sequence
  Marburg virus siRNA sense strand
agcacucuaaacgaaguaaca

SEQ ID NO: 23227 - RNA, 21 nt, Artificial Sequence
  Marburg virus siRNA sense strand
gcacucuaaacgaaguaacaa

SEQ ID NO: 23228 - RNA, 21 nt, Artificial Sequence
  Marburg virus siRNA sense strand
cacucuaaacgaaguaacaac

SEQ ID NO: 23229 - RNA, 21 nt, Artificial Sequence
  Marburg virus siRNA sense strand
acucuaaacgaaguaacaaca

SEQ ID NO: 23230 - RNA, 21 nt, Artificial Sequence
  Marburg virus siRNA sense strand
cucuaaacgaaguaacaacaa

SEQ ID NO: 23231 - RNA, 21 nt, Artificial Sequence
  Marburg virus siRNA sense strand
ucuaaacgaaguaacaacaag

SEQ ID NO: 23232 - RNA, 21 nt, Artificial Sequence
  Marburg virus siRNA sense strand
cuaaacgaaguaacaacaaga

SEQ ID NO: 23233 - RNA, 21 nt, Artificial Sequence
  Marburg virus siRNA sense strand
uaaacgaaguaacaacaagag

SEQ ID NO: 23234 - RNA, 21 nt, Artificial Sequence
  Marburg virus siRNA sense strand
aaacgaaguaacaacaagagu

SEQ ID NO: 23235 - RNA, 21 nt, Artificial Sequence
  Marburg virus siRNA sense strand
aacgaaguaacaacaagaguc

SEQ ID NO: 23236 - RNA, 21 nt, Artificial Sequence
  Marburg virus siRNA sense strand
acgaaguaacaacaagagucc

SEQ ID NO: 23237 - RNA, 21 nt, Artificial Sequence
  Marburg virus siRNA sense strand
cgaaguaacaacaagagucca

SEQ ID NO: 23238 - RNA, 21 nt, Artificial Sequence
  Marburg virus siRNA sense strand
gaaguaacaacaagaguccau

SEQ ID NO: 23239 - RNA, 21 nt, Artificial Sequence
  Marburg virus siRNA sense strand
aaguaacaacaagaguccaug

SEQ ID NO: 23240 - RNA, 21 nt, Artificial Sequence
  Marburg virus siRNA sense strand
aguaacaacaagaguccauga

SEQ ID NO: 23241 - RNA, 21 nt, Artificial Sequence
  Marburg virus siRNA sense strand
guaacaacaagaguccaugaa

SEQ ID NO: 23242 - RNA, 21 nt, Artificial Sequence
  Marburg virus siRNA sense strand
uaacaacaagaguccaugaaa

SEQ ID NO: 23243 - RNA, 21 nt, Artificial Sequence
  Marburg virus siRNA sense strand
aacaacaagaguccaugaaau

SEQ ID NO: 23244 - RNA, 21 nt, Artificial Sequence
  Marburg virus siRNA sense strand
acaacaagaguccaugaaauu

SEQ ID NO: 23245 - RNA, 21 nt, Artificial Sequence
  Marburg virus siRNA sense strand
caacaagaguccaugaaauug

SEQ ID NO: 23246 - RNA, 21 nt, Artificial Sequence
  Marburg virus siRNA sense strand
aacaagaguccaugaaauuga

SEQ ID NO: 23247 - RNA, 21 nt, Artificial Sequence
  Marburg virus siRNA sense strand
acaagaguccaugaaauugag

SEQ ID NO: 23248 - RNA, 21 nt, Artificial Sequence
  Marburg virus siRNA sense strand
caagaguccaugaaauugagc

SEQ ID NO: 23249 - RNA, 21 nt, Artificial Sequence
  Marburg virus siRNA sense strand
aagaguccaugaaauugagcg

SEQ ID NO: 23250 - RNA, 21 nt, Artificial Sequence
  Marburg virus siRNA sense strand
agaguccaugaaauugagcgg

SEQ ID NO: 23251 - RNA, 21 nt, Artificial Sequence
  Marburg virus siRNA sense strand
gaguccaugaaauugagcggc

SEQ ID NO: 23252 - RNA, 21 nt, Artificial Sequence
  Marburg virus siRNA sense strand
aguccaugaaauugagcggca

SEQ ID NO: 23253 - RNA, 21 nt, Artificial Sequence
  Marburg virus siRNA sense strand
guccaugaaauugagcggcaa

SEQ ID NO: 23254 - RNA, 21 nt, Artificial Sequence
  Marburg virus siRNA sense strand
uccaugaaauugagcggcaau

SEQ ID NO: 23255 - RNA, 21 nt, Artificial Sequence
  Marburg virus siRNA sense strand
ccaugaaauugagcggcaauu

SEQ ID NO: 23256 - RNA, 21 nt, Artificial Sequence
  Marburg virus siRNA sense strand
caugaaauugagcggcaauua

SEQ ID NO: 23257 - RNA, 21 nt, Artificial Sequence
  Marburg virus siRNA sense strand
augaaauugagcggcaauuac

SEQ ID NO: 23258 - RNA, 21 nt, Artificial Sequence
  Marburg virus siRNA sense strand
ugaaauugagcggcaauuaca

SEQ ID NO: 23259 - RNA, 21 nt, Artificial Sequence
  Marburg virus siRNA sense strand
gaaauugagcggcaauuacau

SEQ ID NO: 23260 - RNA, 21 nt, Artificial Sequence
  Marburg virus siRNA sense strand
aaauugagcggcaauuacaug

SEQ ID NO: 23261 - RNA, 21 nt, Artificial Sequence
  Marburg virus siRNA sense strand
aauugagcggcaauuacauga

SEQ ID NO: 23262 - RNA, 21 nt, Artificial Sequence
  Marburg virus siRNA sense strand
auugagcggcaauuacaugag

SEQ ID NO: 23263 - RNA, 21 nt, Artificial Sequence
  Marburg virus siRNA sense strand
uugagcggcaauuacaugaga

SEQ ID NO: 23264 - RNA, 21 nt, Artificial Sequence
  Marburg virus siRNA sense strand
ugagcggcaauuacaugagau

SEQ ID NO: 23265 - RNA, 21 nt, Artificial Sequence
  Marburg virus siRNA sense strand
gagcggcaauuacaugagaua

SEQ ID NO: 23266 - RNA, 21 nt, Artificial Sequence
  Marburg virus siRNA sense strand
agcggcaauuacaugagauaa

SEQ ID NO: 23267 - RNA, 21 nt, Artificial Sequence
  Marburg virus siRNA sense strand
gcggcaauuacaugagauaac

SEQ ID NO: 23268 - RNA, 21 nt, Artificial Sequence
  Marburg virus siRNA sense strand
cggcaauuacaugagauaacc

SEQ ID NO: 23269 - RNA, 21 nt, Artificial Sequence
  Marburg virus siRNA sense strand
ggcaauuacaugagauaaccc

SEQ ID NO: 23270 - RNA, 21 nt, Artificial Sequence
  Marburg virus siRNA sense strand
gcaauuacaugagauaacccc

SEQ ID NO: 23271 - RNA, 21 nt, Artificial Sequence
  Marburg virus siRNA sense strand
caauuacaugagauaacccca

SEQ ID NO: 23272 - RNA, 21 nt, Artificial Sequence
  Marburg virus siRNA sense strand
aauuacaugagauaaccccag

SEQ ID NO: 23273 - RNA, 21 nt, Artificial Sequence
  Marburg virus siRNA sense strand
auuacaugagauaaccccagu

SEQ ID NO: 23274 - RNA, 21 nt, Artificial Sequence
  Marburg virus siRNA sense strand
uuacaugagauaaccccagug

SEQ ID NO: 23275 - RNA, 21 nt, Artificial Sequence
  Marburg virus siRNA sense strand
uacaugagauaaccccagugu

SEQ ID NO: 23276 - RNA, 21 nt, Artificial Sequence
  Marburg virus siRNA sense strand
acaugagauaaccccaguguu

SEQ ID NO: 23277 - RNA, 21 nt, Artificial Sequence
  Marburg virus siRNA sense strand
caugagauaaccccaguguua

SEQ ID NO: 23278 - RNA, 21 nt, Artificial Sequence
  Marburg virus siRNA sense strand
augagauaaccccaguguuaa

SEQ ID NO: 23279 - RNA, 21 nt, Artificial Sequence
  Marburg virus siRNA sense strand
ugagauaaccccaguguuaaa

SEQ ID NO: 23280 - RNA, 21 nt, Artificial Sequence
  Marburg virus siRNA sense strand
gagauaaccccaguguuaaaa

SEQ ID NO: 23281 - RNA, 21 nt, Artificial Sequence
  Marburg virus siRNA sense strand
agauaaccccaguguuaaaaa

SEQ ID NO: 23282 - RNA, 21 nt, Artificial Sequence
  Marburg virus siRNA sense strand
gauaaccccaguguuaaaaau

SEQ ID NO: 23283 - RNA, 21 nt, Artificial Sequence
  Marburg virus siRNA sense strand
auaaccccaguguuaaaaaug

SEQ ID NO: 23284 - RNA, 21 nt, Artificial Sequence
  Marburg virus siRNA sense strand
uaaccccaguguuaaaaaugg

SEQ ID NO: 23285 - RNA, 21 nt, Artificial Sequence
  Marburg virus siRNA sense strand
aaccccaguguuaaaaauggg

SEQ ID NO: 23286 - RNA, 21 nt, Artificial Sequence
  Marburg virus siRNA sense strand
accccaguguuaaaaauggga

SEQ ID NO: 23287 - RNA, 21 nt, Artificial Sequence
  Marburg virus siRNA sense strand
ccccaguguuaaaaaugggaa

SEQ ID NO: 23288 - RNA, 21 nt, Artificial Sequence
  Marburg virus siRNA sense strand
cccaguguuaaaaaugggaag

SEQ ID NO: 23289 - RNA, 21 nt, Artificial Sequence
  Marburg virus siRNA sense strand
ccaguguuaaaaaugggaagg

SEQ ID NO: 23290 - RNA, 21 nt, Artificial Sequence
  Marburg virus siRNA sense strand
caguguuaaaaaugggaagga

SEQ ID NO: 23291 - RNA, 21 nt, Artificial Sequence
  Marburg virus siRNA sense strand
aguguuaaaaaugggaaggac

SEQ ID NO: 23292 - RNA, 21 nt, Artificial Sequence
  Marburg virus siRNA sense strand
guguuaaaaaugggaaggaca

SEQ ID NO: 23293 - RNA, 21 nt, Artificial Sequence
  Marburg virus siRNA sense strand
uguuaaaaaugggaaggacac

SEQ ID NO: 23294 - RNA, 21 nt, Artificial Sequence
  Marburg virus siRNA sense strand
guuaaaaaugggaaggacacu

SEQ ID NO: 23295 - RNA, 21 nt, Artificial Sequence
  Marburg virus siRNA sense strand
uuaaaaaugggaaggacacug

SEQ ID NO: 23296 - RNA, 21 nt, Artificial Sequence
  Marburg virus siRNA sense strand
uaaaaaugggaaggacacugg

SEQ ID NO: 23297 - RNA, 21 nt, Artificial Sequence
  Marburg virus siRNA sense strand
aaaaaugggaaggacacugga

SEQ ID NO: 23298 - RNA, 21 nt, Artificial Sequence
  Marburg virus siRNA sense strand
aaaaugggaaggacacuggaa

SEQ ID NO: 23299 - RNA, 21 nt, Artificial Sequence
  Marburg virus siRNA sense strand
aaaugggaaggacacuggaag

SEQ ID NO: 23300 - RNA, 21 nt, Artificial Sequence
  Marburg virus siRNA sense strand
aaugggaaggacacuggaagc

SEQ ID NO: 23301 - RNA, 21 nt, Artificial Sequence
  Marburg virus siRNA sense strand
augggaaggacacuggaagca

SEQ ID NO: 23302 - RNA, 21 nt, Artificial Sequence
  Marburg virus siRNA sense strand
ugggaaggacacuggaagcaa

SEQ ID NO: 23303 - RNA, 21 nt, Artificial Sequence
  Marburg virus siRNA sense strand
gggaaggacacuggaagcaau

SEQ ID NO: 23304 - RNA, 21 nt, Artificial Sequence
  Marburg virus siRNA sense strand
ggaaggacacuggaagcaauu

SEQ ID NO: 23305 - RNA, 21 nt, Artificial Sequence
  Marburg virus siRNA sense strand
gaaggacacuggaagcaauuu

SEQ ID NO: 23306 - RNA, 21 nt, Artificial Sequence
  Marburg virus siRNA sense strand
aaggacacuggaagcaauuuc

SEQ ID NO: 23307 - RNA, 21 nt, Artificial Sequence
  Marburg virus siRNA sense strand
aggacacuggaagcaauuucc

SEQ ID NO: 23308 - RNA, 21 nt, Artificial Sequence
  Marburg virus siRNA sense strand
ggacacuggaagcaauuucca

SEQ ID NO: 23309 - RNA, 21 nt, Artificial Sequence
  Marburg virus siRNA sense strand
gacacuggaagcaauuuccaa

SEQ ID NO: 23310 - RNA, 21 nt, Artificial Sequence
  Marburg virus siRNA sense strand
acacuggaagcaauuuccaag

SEQ ID NO: 23311 - RNA, 21 nt, Artificial Sequence
  Marburg virus siRNA sense strand
cacuggaagcaauuuccaagg

SEQ ID NO: 23312 - RNA, 21 nt, Artificial Sequence
  Marburg virus siRNA sense strand
acuggaagcaauuuccaaggg

SEQ ID NO: 23313 - RNA, 21 nt, Artificial Sequence
  Marburg virus siRNA sense strand
cuggaagcaauuuccaagggg

SEQ ID NO: 23314 - RNA, 21 nt, Artificial Sequence
  Marburg virus siRNA sense strand
uggaagcaauuuccaagggga

SEQ ID NO: 23315 - RNA, 21 nt, Artificial Sequence
  Marburg virus siRNA sense strand
ggaagcaauuuccaaggggau

SEQ ID NO: 23316 - RNA, 21 nt, Artificial Sequence
  Marburg virus siRNA sense strand
gaagcaauuuccaaggggaug

SEQ ID NO: 23317 - RNA, 21 nt, Artificial Sequence
  Marburg virus siRNA sense strand
aagcaauuuccaaggggaugu

SEQ ID NO: 23318 - RNA, 21 nt, Artificial Sequence
  Marburg virus siRNA sense strand
agcaauuuccaaggggauguc

SEQ ID NO: 23319 - RNA, 21 nt, Artificial Sequence
  Marburg virus siRNA sense strand
gcaauuuccaaggggauguca

SEQ ID NO: 23320 - RNA, 21 nt, Artificial Sequence
  Marburg virus siRNA sense strand
caauuuccaaggggaugucag

SEQ ID NO: 23321 - RNA, 21 nt, Artificial Sequence
  Marburg virus siRNA sense strand
aauuuccaaggggaugucaga

SEQ ID NO: 23322 - RNA, 21 nt, Artificial Sequence
  Marburg virus siRNA sense strand
auuuccaaggggaugucagaa

SEQ ID NO: 23323 - RNA, 21 nt, Artificial Sequence
  Marburg virus siRNA sense strand
uuuccaaggggaugucagaaa

SEQ ID NO: 23324 - RNA, 21 nt, Artificial Sequence
  Marburg virus siRNA sense strand
uuccaaggggaugucagaaau

SEQ ID NO: 23325 - RNA, 21 nt, Artificial Sequence
  Marburg virus siRNA sense strand
uccaaggggaugucagaaaug

SEQ ID NO: 23326 - RNA, 21 nt, Artificial Sequence
  Marburg virus siRNA sense strand
ccaaggggaugucagaaaugu

SEQ ID NO: 23327 - RNA, 21 nt, Artificial Sequence
  Marburg virus siRNA sense strand
caaggggaugucagaaauguu

SEQ ID NO: 23328 - RNA, 21 nt, Artificial Sequence
  Marburg virus siRNA sense strand
aaggggaugucagaaauguua

SEQ ID NO: 23329 - RNA, 21 nt, Artificial Sequence
  Marburg virus siRNA sense strand
aggggaugucagaaauguuag

SEQ ID NO: 23330 - RNA, 21 nt, Artificial Sequence
  Marburg virus siRNA sense strand
ggggaugucagaaauguuagc

SEQ ID NO: 23331 - RNA, 21 nt, Artificial Sequence
  Marburg virus siRNA sense strand
gggaugucagaaauguuagcc

SEQ ID NO: 23332 - RNA, 21 nt, Artificial Sequence
  Marburg virus siRNA sense strand
ggaugucagaaauguuagcca

SEQ ID NO: 23333 - RNA, 21 nt, Artificial Sequence
  Marburg virus siRNA sense strand
gaugucagaaauguuagccaa

SEQ ID NO: 23334 - RNA, 21 nt, Artificial Sequence
  Marburg virus siRNA sense strand
augucagaaauguuagccaaa

SEQ ID NO: 23335 - RNA, 21 nt, Artificial Sequence
  Marburg virus siRNA sense strand
ugucagaaauguuagccaaau

SEQ ID NO: 23336 - RNA, 21 nt, Artificial Sequence
  Marburg virus siRNA sense strand
gucagaaauguuagccaaaua

SEQ ID NO: 23337 - RNA, 21 nt, Artificial Sequence
  Marburg virus siRNA sense strand
ucagaaauguuagccaaauac

SEQ ID NO: 23338 - RNA, 21 nt, Artificial Sequence
  Marburg virus siRNA sense strand
cagaaauguuagccaaauacg

SEQ ID NO: 23339 - RNA, 21 nt, Artificial Sequence
  Marburg virus siRNA sense strand
agaaauguuagccaaauacga

SEQ ID NO: 23340 - RNA, 21 nt, Artificial Sequence
  Marburg virus siRNA sense strand
gaaauguuagccaaauacgac

SEQ ID NO: 23341 - RNA, 21 nt, Artificial Sequence
  Marburg virus siRNA sense strand
aaauguuagccaaauacgacc

SEQ ID NO: 23342 - RNA, 21 nt, Artificial Sequence
  Marburg virus siRNA sense strand
aauguuagccaaauacgacca

SEQ ID NO: 23343 - RNA, 21 nt, Artificial Sequence
  Marburg virus siRNA sense strand
auguuagccaaauacgaccac

SEQ ID NO: 23344 - RNA, 21 nt, Artificial Sequence
  Marburg virus siRNA sense strand
uguuagccaaauacgaccacc

SEQ ID NO: 23345 - RNA, 21 nt, Artificial Sequence
  Marburg virus siRNA sense strand
guuagccaaauacgaccaccu

SEQ ID NO: 23346 - RNA, 21 nt, Artificial Sequence
  Marburg virus siRNA sense strand
uuagccaaauacgaccaccuc

SEQ ID NO: 23347 - RNA, 21 nt, Artificial Sequence
  Marburg virus siRNA sense strand
uagccaaauacgaccaccucg

SEQ ID NO: 23348 - RNA, 21 nt, Artificial Sequence
  Marburg virus siRNA sense strand
agccaaauacgaccaccucgu

SEQ ID NO: 23349 - RNA, 21 nt, Artificial Sequence
  Marburg virus siRNA sense strand
gccaaauacgaccaccucgua

SEQ ID NO: 23350 - RNA, 21 nt, Artificial Sequence
  Marburg virus siRNA sense strand
ccaaauacgaccaccucguaa

SEQ ID NO: 23351 - RNA, 21 nt, Artificial Sequence
  Marburg virus siRNA sense strand
caaauacgaccaccucguaau

SEQ ID NO: 23352 - RNA, 21 nt, Artificial Sequence
  Marburg virus siRNA sense strand
aaauacgaccaccucguaauu

SEQ ID NO: 23353 - RNA, 21 nt, Artificial Sequence
  Marburg virus siRNA sense strand
aauacgaccaccucguaauuu

SEQ ID NO: 23354 - RNA, 21 nt, Artificial Sequence
  Marburg virus siRNA sense strand
auacgaccaccucguaauuuc

SEQ ID NO: 23355 - RNA, 21 nt, Artificial Sequence
  Marburg virus siRNA sense strand
uacgaccaccucguaauuuca

SEQ ID NO: 23356 - RNA, 21 nt, Artificial Sequence
  Marburg virus siRNA sense strand
acgaccaccucguaauuucaa

SEQ ID NO: 23357 - RNA, 21 nt, Artificial Sequence
  Marburg virus siRNA sense strand
cgaccaccucguaauuucaac

SEQ ID NO: 23358 - RNA, 21 nt, Artificial Sequence
  Marburg virus siRNA sense strand
gaccaccucguaauuucaacu

SEQ ID NO: 23359 - RNA, 21 nt, Artificial Sequence
  Marburg virus siRNA sense strand
accaccucguaauuucaacug

SEQ ID NO: 23360 - RNA, 21 nt, Artificial Sequence
  Marburg virus siRNA sense strand
ccaccucguaauuucaacugg

SEQ ID NO: 23361 - RNA, 21 nt, Artificial Sequence
  Marburg virus siRNA sense strand
caccucguaauuucaacugga

SEQ ID NO: 23362 - RNA, 21 nt, Artificial Sequence
  Marburg virus siRNA sense strand
accucguaauuucaacuggaa

SEQ ID NO: 23363 - RNA, 21 nt, Artificial Sequence
  Marburg virus siRNA sense strand
ccucguaauuucaacuggaag

SEQ ID NO: 23364 - RNA, 21 nt, Artificial Sequence
  Marburg virus siRNA sense strand
cucguaauuucaacuggaaga

SEQ ID NO: 23365 - RNA, 21 nt, Artificial Sequence
  Marburg virus siRNA sense strand
ucguaauuucaacuggaagaa

SEQ ID NO: 23366 - RNA, 21 nt, Artificial Sequence
  Marburg virus siRNA sense strand
cguaauuucaacuggaagaac

SEQ ID NO: 23367 - RNA, 21 nt, Artificial Sequence
  Marburg virus siRNA sense strand
guaauuucaacuggaagaacc

SEQ ID NO: 23368 - RNA, 21 nt, Artificial Sequence
  Marburg virus siRNA sense strand
uaauuucaacuggaagaacca

SEQ ID NO: 23369 - RNA, 21 nt, Artificial Sequence
  Marburg virus siRNA sense strand
aauuucaacuggaagaaccac

SEQ ID NO: 23370 - RNA, 21 nt, Artificial Sequence
  Marburg virus siRNA sense strand
auuucaacuggaagaaccacu

SEQ ID NO: 23371 - RNA, 21 nt, Artificial Sequence
  Marburg virus siRNA sense strand
uuucaacuggaagaaccacug

SEQ ID NO: 23372 - RNA, 21 nt, Artificial Sequence
  Marburg virus siRNA sense strand
uucaacuggaagaaccacugc

SEQ ID NO: 23373 - RNA, 21 nt, Artificial Sequence
  Marburg virus siRNA sense strand
ucaacuggaagaaccacugca

SEQ ID NO: 23374 - RNA, 21 nt, Artificial Sequence
  Marburg virus siRNA sense strand
caacuggaagaaccacugcac

SEQ ID NO: 23375 - RNA, 21 nt, Artificial Sequence
  Marburg virus siRNA sense strand
aacuggaagaaccacugcacc

SEQ ID NO: 23376 - RNA, 21 nt, Artificial Sequence
  Marburg virus siRNA sense strand
acuggaagaaccacugcacca

SEQ ID NO: 23377 - RNA, 21 nt, Artificial Sequence
  Marburg virus siRNA sense strand
cuggaagaaccacugcaccag

SEQ ID NO: 23378 - RNA, 21 nt, Artificial Sequence
  Marburg virus siRNA sense strand
uggaagaaccacugcaccagc

SEQ ID NO: 23379 - RNA, 21 nt, Artificial Sequence
  Marburg virus siRNA sense strand
ggaagaaccacugcaccagcu

SEQ ID NO: 23380 - RNA, 21 nt, Artificial Sequence
  Marburg virus siRNA sense strand
gaagaaccacugcaccagcug

SEQ ID NO: 23381 - RNA, 21 nt, Artificial Sequence
  Marburg virus siRNA sense strand
aagaaccacugcaccagcugc

SEQ ID NO: 23382 - RNA, 21 nt, Artificial Sequence
  Marburg virus siRNA sense strand
agaaccacugcaccagcugcu

SEQ ID NO: 23383 - RNA, 21 nt, Artificial Sequence
  Marburg virus siRNA sense strand
gaaccacugcaccagcugcug

SEQ ID NO: 23384 - RNA, 21 nt, Artificial Sequence
  Marburg virus siRNA sense strand
aaccacugcaccagcugcugc

SEQ ID NO: 23385 - RNA, 21 nt, Artificial Sequence
  Marburg virus siRNA sense strand
accacugcaccagcugcugcc

SEQ ID NO: 23386 - RNA, 21 nt, Artificial Sequence
  Marburg virus siRNA sense strand
ccacugcaccagcugcugccu

SEQ ID NO: 23387 - RNA, 21 nt, Artificial Sequence
  Marburg virus siRNA sense strand
cacugcaccagcugcugccuu

SEQ ID NO: 23388 - RNA, 21 nt, Artificial Sequence
  Marburg virus siRNA sense strand
acugcaccagcugcugccuuu

SEQ ID NO: 23389 - RNA, 21 nt, Artificial Sequence
  Marburg virus siRNA sense strand
cugcaccagcugcugccuuug

SEQ ID NO: 23390 - RNA, 21 nt, Artificial Sequence
  Marburg virus siRNA sense strand
ugcaccagcugcugccuuuga

SEQ ID NO: 23391 - RNA, 21 nt, Artificial Sequence
  Marburg virus siRNA sense strand
gcaccagcugcugccuuugau

SEQ ID NO: 23392 - RNA, 21 nt, Artificial Sequence
  Marburg virus siRNA sense strand
caccagcugcugccuuugaug

SEQ ID NO: 23393 - RNA, 21 nt, Artificial Sequence
  Marburg virus siRNA sense strand
accagcugcugccuuugaugc

SEQ ID NO: 23394 - RNA, 21 nt, Artificial Sequence
  Marburg virus siRNA sense strand
ccagcugcugccuuugaugcu

SEQ ID NO: 23395 - RNA, 21 nt, Artificial Sequence
  Marburg virus siRNA sense strand
cagcugcugccuuugaugcuu

SEQ ID NO: 23396 - RNA, 21 nt, Artificial Sequence
  Marburg virus siRNA sense strand
agcugcugccuuugaugcuua

SEQ ID NO: 23397 - RNA, 21 nt, Artificial Sequence
  Marburg virus siRNA sense strand
gcugcugccuuugaugcuuac

SEQ ID NO: 23398 - RNA, 21 nt, Artificial Sequence
  Marburg virus siRNA sense strand
cugcugccuuugaugcuuacu

SEQ ID NO: 23399 - RNA, 21 nt, Artificial Sequence
  Marburg virus siRNA sense strand
ugcugccuuugaugcuuacuu

SEQ ID NO: 23400 - RNA, 21 nt, Artificial Sequence
  Marburg virus siRNA sense strand
gcugccuuugaugcuuacuua

SEQ ID NO: 23401 - RNA, 21 nt, Artificial Sequence
  Marburg virus siRNA sense strand
cugccuuugaugcuuacuuaa

SEQ ID NO: 23402 - RNA, 21 nt, Artificial Sequence
  Marburg virus siRNA sense strand
ugccuuugaugcuuacuuaaa

SEQ ID NO: 23403 - RNA, 21 nt, Artificial Sequence
  Marburg virus siRNA sense strand
gccuuugaugcuuacuuaaau

SEQ ID NO: 23404 - RNA, 21 nt, Artificial Sequence
  Marburg virus siRNA sense strand
ccuuugaugcuuacuuaaaug

SEQ ID NO: 23405 - RNA, 21 nt, Artificial Sequence
  Marburg virus siRNA sense strand
cuuugaugcuuacuuaaauga

SEQ ID NO: 23406 - RNA, 21 nt, Artificial Sequence
  Marburg virus siRNA sense strand
uuugaugcuuacuuaaaugag

SEQ ID NO: 23407 - RNA, 21 nt, Artificial Sequence
  Marburg virus siRNA sense strand
uugaugcuuacuuaaaugagc

SEQ ID NO: 23408 - RNA, 21 nt, Artificial Sequence
  Marburg virus siRNA sense strand
ugaugcuuacuuaaaugagca

SEQ ID NO: 23409 - RNA, 21 nt, Artificial Sequence
  Marburg virus siRNA sense strand
gaugcuuacuuaaaugagcau

SEQ ID NO: 23410 - RNA, 21 nt, Artificial Sequence
  Marburg virus siRNA sense strand
augcuuacuuaaaugagcaug

SEQ ID NO: 23411 - RNA, 21 nt, Artificial Sequence
  Marburg virus siRNA sense strand
ugcuuacuuaaaugagcaugg

SEQ ID NO: 23412 - RNA, 21 nt, Artificial Sequence
  Marburg virus siRNA sense strand
gcuuacuuaaaugagcauggu

SEQ ID NO: 23413 - RNA, 21 nt, Artificial Sequence
  Marburg virus siRNA sense strand
cuuacuuaaaugagcauggug

SEQ ID NO: 23414 - RNA, 21 nt, Artificial Sequence
  Marburg virus siRNA sense strand
uuacuuaaaugagcauggugu

SEQ ID NO: 23415 - RNA, 21 nt, Artificial Sequence
  Marburg virus siRNA sense strand
uacuuaaaugagcaugguguc

SEQ ID NO: 23416 - RNA, 21 nt, Artificial Sequence
  Marburg virus siRNA sense strand
acuuaaaugagcauggugucc

SEQ ID NO: 23417 - RNA, 21 nt, Artificial Sequence
  Marburg virus siRNA sense strand
cuuaaaugagcaugguguccc

SEQ ID NO: 23418 - RNA, 21 nt, Artificial Sequence
  Marburg virus siRNA sense strand
uuaaaugagcauggugucccu

SEQ ID NO: 23419 - RNA, 21 nt, Artificial Sequence
  Marburg virus siRNA sense strand
uaaaugagcauggugucccuc

SEQ ID NO: 23420 - RNA, 21 nt, Artificial Sequence
  Marburg virus siRNA sense strand
aaaugagcauggugucccucc

SEQ ID NO: 23421 - RNA, 21 nt, Artificial Sequence
  Marburg virus siRNA sense strand
aaugagcauggugucccuccc

SEQ ID NO: 23422 - RNA, 21 nt, Artificial Sequence
  Marburg virus siRNA sense strand
augagcauggugucccucccc

SEQ ID NO: 23423 - RNA, 21 nt, Artificial Sequence
  Marburg virus siRNA sense strand
ugagcauggugucccuccccc

SEQ ID NO: 23424 - RNA, 21 nt, Artificial Sequence
  Marburg virus siRNA sense strand
gagcauggugucccucccccc

SEQ ID NO: 23425 - RNA, 21 nt, Artificial Sequence
  Marburg virus siRNA sense strand
agcauggugucccuccccccc

SEQ ID NO: 23426 - RNA, 21 nt, Artificial Sequence
  Marburg virus siRNA sense strand
gcauggugucccuccccccca

SEQ ID NO: 23427 - RNA, 21 nt, Artificial Sequence
  Marburg virus siRNA sense strand
cauggugucccucccccccaa

SEQ ID NO: 23428 - RNA, 21 nt, Artificial Sequence
  Marburg virus siRNA sense strand
auggugucccucccccccaac

SEQ ID NO: 23429 - RNA, 21 nt, Artificial Sequence
  Marburg virus siRNA sense strand
uggugucccucccccccaacc

SEQ ID NO: 23430 - RNA, 21 nt, Artificial Sequence
  Marburg virus siRNA sense strand
ggugucccucccccccaaccu

SEQ ID NO: 23431 - RNA, 21 nt, Artificial Sequence
  Marburg virus siRNA sense strand
gugucccucccccccaaccug

SEQ ID NO: 23432 - RNA, 21 nt, Artificial Sequence
  Marburg virus siRNA sense strand
ugucccucccccccaaccugc

SEQ ID NO: 23433 - RNA, 21 nt, Artificial Sequence
  Marburg virus siRNA sense strand
gucccucccccccaaccugcg

SEQ ID NO: 23434 - RNA, 21 nt, Artificial Sequence
  Marburg virus siRNA sense strand
ucccucccccccaaccugcga

SEQ ID NO: 23435 - RNA, 21 nt, Artificial Sequence
  Marburg virus siRNA sense strand
cccucccccccaaccugcgau

SEQ ID NO: 23436 - RNA, 21 nt, Artificial Sequence
  Marburg virus siRNA sense strand
ccucccccccaaccugcgauu

SEQ ID NO: 23437 - RNA, 21 nt, Artificial Sequence
  Marburg virus siRNA sense strand
cucccccccaaccugcgauuu

SEQ ID NO: 23438 - RNA, 21 nt, Artificial Sequence
  Marburg virus siRNA sense strand
ucccccccaaccugcgauuuu

SEQ ID NO: 23439 - RNA, 21 nt, Artificial Sequence
  Marburg virus siRNA sense strand
cccccccaaccugcgauuuuc

SEQ ID NO: 23440 - RNA, 21 nt, Artificial Sequence
  Marburg virus siRNA sense strand
ccccccaaccugcgauuuuca

SEQ ID NO: 23441 - RNA, 21 nt, Artificial Sequence
  Marburg virus siRNA sense strand
cccccaaccugcgauuuucaa

SEQ ID NO: 23442 - RNA, 21 nt, Artificial Sequence
  Marburg virus siRNA sense strand
ccccaaccugcgauuuucaaa

SEQ ID NO: 23443 - RNA, 21 nt, Artificial Sequence
  Marburg virus siRNA sense strand
cccaaccugcgauuuucaaag

SEQ ID NO: 23444 - RNA, 21 nt, Artificial Sequence
  Marburg virus siRNA sense strand
ccaaccugcgauuuucaaaga

SEQ ID NO: 23445 - RNA, 21 nt, Artificial Sequence
  Marburg virus siRNA sense strand
caaccugcgauuuucaaagau

SEQ ID NO: 23446 - RNA, 21 nt, Artificial Sequence
  Marburg virus siRNA sense strand
aaccugcgauuuucaaagauc

SEQ ID NO: 23447 - RNA, 21 nt, Artificial Sequence
  Marburg virus siRNA sense strand
accugcgauuuucaaagaucu

SEQ ID NO: 23448 - RNA, 21 nt, Artificial Sequence
  Marburg virus siRNA sense strand
ccugcgauuuucaaagaucuu

SEQ ID NO: 23449 - RNA, 21 nt, Artificial Sequence
  Marburg virus siRNA sense strand
cugcgauuuucaaagaucuug

SEQ ID NO: 23450 - RNA, 21 nt, Artificial Sequence
  Marburg virus siRNA sense strand
ugcgauuuucaaagaucuugg

SEQ ID NO: 23451 - RNA, 21 nt, Artificial Sequence
  Marburg virus siRNA sense strand
gcgauuuucaaagaucuuggg

SEQ ID NO: 23452 - RNA, 21 nt, Artificial Sequence
  Marburg virus siRNA sense strand
cgauuuucaaagaucuugggg

SEQ ID NO: 23453 - RNA, 21 nt, Artificial Sequence
  Marburg virus siRNA sense strand
gauuuucaaagaucuuggggu

SEQ ID NO: 23454 - RNA, 21 nt, Artificial Sequence
  Marburg virus siRNA sense strand
auuuucaaagaucuugggguu

SEQ ID NO: 23455 - RNA, 21 nt, Artificial Sequence
  Marburg virus siRNA sense strand
uuuucaaagaucuugggguug

SEQ ID NO: 23456 - RNA, 21 nt, Artificial Sequence
  Marburg virus siRNA sense strand
uuucaaagaucuugggguugc

SEQ ID NO: 23457 - RNA, 21 nt, Artificial Sequence
  Marburg virus siRNA sense strand
uucaaagaucuugggguugcu

SEQ ID NO: 23458 - RNA, 21 nt, Artificial Sequence
  Marburg virus siRNA sense strand
ucaaagaucuugggguugcuc

SEQ ID NO: 23459 - RNA, 21 nt, Artificial Sequence
  Marburg virus siRNA sense strand
caaagaucuugggguugcuca

SEQ ID NO: 23460 - RNA, 21 nt, Artificial Sequence
  Marburg virus siRNA sense strand
aaagaucuugggguugcucaa

SEQ ID NO: 23461 - RNA, 21 nt, Artificial Sequence
  Marburg virus siRNA sense strand
aagaucuugggguugcucaac

SEQ ID NO: 23462 - RNA, 21 nt, Artificial Sequence
  Marburg virus siRNA sense strand
agaucuugggguugcucaaca

SEQ ID NO: 23463 - RNA, 21 nt, Artificial Sequence
  Marburg virus siRNA sense strand
gaucuugggguugcucaacaa

SEQ ID NO: 23464 - RNA, 21 nt, Artificial Sequence
  Marburg virus siRNA sense strand
aucuugggguugcucaacaag

SEQ ID NO: 23465 - RNA, 21 nt, Artificial Sequence
  Marburg virus siRNA sense strand
ucuugggguugcucaacaagc

SEQ ID NO: 23466 - RNA, 21 nt, Artificial Sequence
  Marburg virus siRNA sense strand
cuugggguugcucaacaagcu

SEQ ID NO: 23467 - RNA, 21 nt, Artificial Sequence
  Marburg virus siRNA sense strand
uugggguugcucaacaagcuu

SEQ ID NO: 23468 - RNA, 21 nt, Artificial Sequence
  Marburg virus siRNA sense strand
ugggguugcucaacaagcuug

SEQ ID NO: 23469 - RNA, 21 nt, Artificial Sequence
  Marburg virus siRNA sense strand
gggguugcucaacaagcuugu

SEQ ID NO: 23470 - RNA, 21 nt, Artificial Sequence
  Marburg virus siRNA sense strand
ggguugcucaacaagcuugua

SEQ ID NO: 23471 - RNA, 21 nt, Artificial Sequence
  Marburg virus siRNA sense strand
gguugcucaacaagcuuguag

SEQ ID NO: 23472 - RNA, 21 nt, Artificial Sequence
  Marburg virus siRNA sense strand
guugcucaacaagcuuguagu

SEQ ID NO: 23473 - RNA, 21 nt, Artificial Sequence
  Marburg virus siRNA sense strand
uugcucaacaagcuuguagua

SEQ ID NO: 23474 - RNA, 21 nt, Artificial Sequence
  Marburg virus siRNA sense strand
ugcucaacaagcuuguaguaa

SEQ ID NO: 23475 - RNA, 21 nt, Artificial Sequence
  Marburg virus siRNA sense strand
gcucaacaagcuuguaguaag

SEQ ID NO: 23476 - RNA, 21 nt, Artificial Sequence
  Marburg virus siRNA sense strand
cucaacaagcuuguaguaagg

SEQ ID NO: 23477 - RNA, 21 nt, Artificial Sequence
  Marburg virus siRNA sense strand
ucaacaagcuuguaguaaggg

SEQ ID NO: 23478 - RNA, 21 nt, Artificial Sequence
  Marburg virus siRNA sense strand
caacaagcuuguaguaagggg

SEQ ID NO: 23479 - RNA, 21 nt, Artificial Sequence
  Marburg virus siRNA sense strand
aacaagcuuguaguaagggga

SEQ ID NO: 23480 - RNA, 21 nt, Artificial Sequence
  Marburg virus siRNA sense strand
acaagcuuguaguaaggggac

SEQ ID NO: 23481 - RNA, 21 nt, Artificial Sequence
  Marburg virus siRNA sense strand
caagcuuguaguaaggggacc

SEQ ID NO: 23482 - RNA, 21 nt, Artificial Sequence
  Marburg virus siRNA sense strand
aagcuuguaguaaggggacca

SEQ ID NO: 23483 - RNA, 21 nt, Artificial Sequence
  Marburg virus siRNA sense strand
agcuuguaguaaggggaccau

SEQ ID NO: 23484 - RNA, 21 nt, Artificial Sequence
  Marburg virus siRNA sense strand
gcuuguaguaaggggaccaug

SEQ ID NO: 23485 - RNA, 21 nt, Artificial Sequence
  Marburg virus siRNA sense strand
cuuguaguaaggggaccaugg

SEQ ID NO: 23486 - RNA, 21 nt, Artificial Sequence
  Marburg virus siRNA sense strand
uuguaguaaggggaccauggu

SEQ ID NO: 23487 - RNA, 21 nt, Artificial Sequence
  Marburg virus siRNA sense strand
uguaguaaggggaccaugguu

SEQ ID NO: 23488 - RNA, 21 nt, Artificial Sequence
  Marburg virus siRNA sense strand
guaguaaggggaccaugguua

SEQ ID NO: 23489 - RNA, 21 nt, Artificial Sequence
  Marburg virus siRNA sense strand
uaguaaggggaccaugguuaa

SEQ ID NO: 23490 - RNA, 21 nt, Artificial Sequence
  Marburg virus siRNA sense strand
aguaaggggaccaugguuaaa

SEQ ID NO: 23491 - RNA, 21 nt, Artificial Sequence
  Marburg virus siRNA sense strand
guaaggggaccaugguuaaaa

SEQ ID NO: 23492 - RNA, 21 nt, Artificial Sequence
  Marburg virus siRNA sense strand
uaaggggaccaugguuaaaaa

SEQ ID NO: 23493 - RNA, 21 nt, Artificial Sequence
  Marburg virus siRNA sense strand
aaggggaccaugguuaaaaau

SEQ ID NO: 23494 - RNA, 21 nt, Artificial Sequence
  Marburg virus siRNA sense strand
aggggaccaugguuaaaaaug

SEQ ID NO: 23495 - RNA, 21 nt, Artificial Sequence
  Marburg virus siRNA sense strand
ggggaccaugguuaaaaauga

SEQ ID NO: 23496 - RNA, 21 nt, Artificial Sequence
  Marburg virus siRNA sense strand
gggaccaugguuaaaaaugaa

SEQ ID NO: 23497 - RNA, 21 nt, Artificial Sequence
  Marburg virus siRNA sense strand
ggaccaugguuaaaaaugaaa

SEQ ID NO: 23498 - RNA, 21 nt, Artificial Sequence
  Marburg virus siRNA sense strand
gaccaugguuaaaaaugaaac

SEQ ID NO: 23499 - RNA, 21 nt, Artificial Sequence
  Marburg virus siRNA sense strand
accaugguuaaaaaugaaaca

SEQ ID NO: 23500 - RNA, 21 nt, Artificial Sequence
  Marburg virus siRNA sense strand
ccaugguuaaaaaugaaacaa

SEQ ID NO: 23501 - RNA, 21 nt, Artificial Sequence
  Marburg virus siRNA sense strand
caugguuaaaaaugaaacaac

SEQ ID NO: 23502 - RNA, 21 nt, Artificial Sequence
  Marburg virus siRNA sense strand
augguuaaaaaugaaacaaca

SEQ ID NO: 23503 - RNA, 21 nt, Artificial Sequence
  Marburg virus siRNA sense strand
ugguuaaaaaugaaacaacag

SEQ ID NO: 23504 - RNA, 21 nt, Artificial Sequence
  Marburg virus siRNA sense strand
gguuaaaaaugaaacaacaga

SEQ ID NO: 23505 - RNA, 21 nt, Artificial Sequence
  Marburg virus siRNA sense strand
guuaaaaaugaaacaacagau

SEQ ID NO: 23506 - RNA, 21 nt, Artificial Sequence
  Marburg virus siRNA sense strand
uuaaaaaugaaacaacagaug

SEQ ID NO: 23507 - RNA, 21 nt, Artificial Sequence
  Marburg virus siRNA sense strand
uaaaaaugaaacaacagaugc

SEQ ID NO: 23508 - RNA, 21 nt, Artificial Sequence
  Marburg virus siRNA sense strand
aaaaaugaaacaacagaugca

SEQ ID NO: 23509 - RNA, 21 nt, Artificial Sequence
  Marburg virus siRNA sense strand
aaaaugaaacaacagaugcag

SEQ ID NO: 23510 - RNA, 21 nt, Artificial Sequence
  Marburg virus siRNA sense strand
aaaugaaacaacagaugcagc

SEQ ID NO: 23511 - RNA, 21 nt, Artificial Sequence
  Marburg virus siRNA sense strand
aaugaaacaacagaugcagcc

SEQ ID NO: 23512 - RNA, 21 nt, Artificial Sequence
  Marburg virus siRNA sense strand
augaaacaacagaugcagccg

SEQ ID NO: 23513 - RNA, 21 nt, Artificial Sequence
  Marburg virus siRNA sense strand
ugaaacaacagaugcagccga

SEQ ID NO: 23514 - RNA, 21 nt, Artificial Sequence
  Marburg virus siRNA sense strand
gaaacaacagaugcagccgac

SEQ ID NO: 23515 - RNA, 21 nt, Artificial Sequence
  Marburg virus siRNA sense strand
aaacaacagaugcagccgaca

SEQ ID NO: 23516 - RNA, 21 nt, Artificial Sequence
  Marburg virus siRNA sense strand
aacaacagaugcagccgacaa

SEQ ID NO: 23517 - RNA, 21 nt, Artificial Sequence
  Marburg virus siRNA sense strand
acaacagaugcagccgacaag

SEQ ID NO: 23518 - RNA, 21 nt, Artificial Sequence
  Marburg virus siRNA sense strand
caacagaugcagccgacaaga

SEQ ID NO: 23519 - RNA, 21 nt, Artificial Sequence
  Marburg virus siRNA sense strand
aacagaugcagccgacaagau

SEQ ID NO: 23520 - RNA, 21 nt, Artificial Sequence
  Marburg virus siRNA sense strand
acagaugcagccgacaagaug

SEQ ID NO: 23521 - RNA, 21 nt, Artificial Sequence
  Marburg virus siRNA sense strand
cagaugcagccgacaagaugu

SEQ ID NO: 23522 - RNA, 21 nt, Artificial Sequence
  Marburg virus siRNA sense strand
agaugcagccgacaagauguc

SEQ ID NO: 23523 - RNA, 21 nt, Artificial Sequence
  Marburg virus siRNA sense strand
gaugcagccgacaagaugucg

SEQ ID NO: 23524 - RNA, 21 nt, Artificial Sequence
  Marburg virus siRNA sense strand
augcagccgacaagaugucga

SEQ ID NO: 23525 - RNA, 21 nt, Artificial Sequence
  Marburg virus siRNA sense strand
ugcagccgacaagaugucgaa

SEQ ID NO: 23526 - RNA, 21 nt, Artificial Sequence
  Marburg virus siRNA sense strand
gcagccgacaagaugucgaaa

SEQ ID NO: 23527 - RNA, 21 nt, Artificial Sequence
  Marburg virus siRNA sense strand
cagccgacaagaugucgaaag

SEQ ID NO: 23528 - RNA, 21 nt, Artificial Sequence
  Marburg virus siRNA sense strand
agccgacaagaugucgaaagu

SEQ ID NO: 23529 - RNA, 21 nt, Artificial Sequence
  Marburg virus siRNA sense strand
gccgacaagaugucgaaaguu

SEQ ID NO: 23530 - RNA, 21 nt, Artificial Sequence
  Marburg virus siRNA sense strand
ccgacaagaugucgaaaguuc

SEQ ID NO: 23531 - RNA, 21 nt, Artificial Sequence
  Marburg virus siRNA sense strand
cgacaagaugucgaaaguucu

SEQ ID NO: 23532 - RNA, 21 nt, Artificial Sequence
  Marburg virus siRNA sense strand
gacaagaugucgaaaguucuu

SEQ ID NO: 23533 - RNA, 21 nt, Artificial Sequence
  Marburg virus siRNA sense strand
acaagaugucgaaaguucuug

SEQ ID NO: 23534 - RNA, 21 nt, Artificial Sequence
  Marburg virus siRNA sense strand
caagaugucgaaaguucuuga

SEQ ID NO: 23535 - RNA, 21 nt, Artificial Sequence
  Marburg virus siRNA sense strand
aagaugucgaaaguucuugaa

SEQ ID NO: 23536 - RNA, 21 nt, Artificial Sequence
  Marburg virus siRNA sense strand
agaugucgaaaguucuugaac

SEQ ID NO: 23537 - RNA, 21 nt, Artificial Sequence
  Marburg virus siRNA sense strand
gaugucgaaaguucuugaacu

SEQ ID NO: 23538 - RNA, 21 nt, Artificial Sequence
  Marburg virus siRNA sense strand
augucgaaaguucuugaacuc

SEQ ID NO: 23539 - RNA, 21 nt, Artificial Sequence
  Marburg virus siRNA sense strand
ugucgaaaguucuugaacuca

SEQ ID NO: 23540 - RNA, 21 nt, Artificial Sequence
  Marburg virus siRNA sense strand
gucgaaaguucuugaacucag

SEQ ID NO: 23541 - RNA, 21 nt, Artificial Sequence
  Marburg virus siRNA sense strand
ucgaaaguucuugaacucagu

SEQ ID NO: 23542 - RNA, 21 nt, Artificial Sequence
  Marburg virus siRNA sense strand
cgaaaguucuugaacucagug

SEQ ID NO: 23543 - RNA, 21 nt, Artificial Sequence
  Marburg virus siRNA sense strand
gaaaguucuugaacucaguga

SEQ ID NO: 23544 - RNA, 21 nt, Artificial Sequence
  Marburg virus siRNA sense strand
aaaguucuugaacucagugag

SEQ ID NO: 23545 - RNA, 21 nt, Artificial Sequence
  Marburg virus siRNA sense strand
aaguucuugaacucagugagg

SEQ ID NO: 23546 - RNA, 21 nt, Artificial Sequence
  Marburg virus siRNA sense strand
aguucuugaacucagugagga

SEQ ID NO: 23547 - RNA, 21 nt, Artificial Sequence
  Marburg virus siRNA sense strand
guucuugaacucagugaggag

SEQ ID NO: 23548 - RNA, 21 nt, Artificial Sequence
  Marburg virus siRNA sense strand
uucuugaacucagugaggaga

SEQ ID NO: 23549 - RNA, 21 nt, Artificial Sequence
  Marburg virus siRNA sense strand
ucuugaacucagugaggagac

SEQ ID NO: 23550 - RNA, 21 nt, Artificial Sequence
  Marburg virus siRNA sense strand
cuugaacucagugaggagacg

SEQ ID NO: 23551 - RNA, 21 nt, Artificial Sequence
  Marburg virus siRNA sense strand
uugaacucagugaggagacgu

SEQ ID NO: 23552 - RNA, 21 nt, Artificial Sequence
  Marburg virus siRNA sense strand
ugaacucagugaggagacguu

SEQ ID NO: 23553 - RNA, 21 nt, Artificial Sequence
  Marburg virus siRNA sense strand
gaacucagugaggagacguuc

SEQ ID NO: 23554 - RNA, 21 nt, Artificial Sequence
  Marburg virus siRNA sense strand
aacucagugaggagacguucu

SEQ ID NO: 23555 - RNA, 21 nt, Artificial Sequence
  Marburg virus siRNA sense strand
acucagugaggagacguucuc

SEQ ID NO: 23556 - RNA, 21 nt, Artificial Sequence
  Marburg virus siRNA sense strand
cucagugaggagacguucucc

SEQ ID NO: 23557 - RNA, 21 nt, Artificial Sequence
  Marburg virus siRNA sense strand
ucagugaggagacguucucca

SEQ ID NO: 23558 - RNA, 21 nt, Artificial Sequence
  Marburg virus siRNA sense strand
cagugaggagacguucuccaa

SEQ ID NO: 23559 - RNA, 21 nt, Artificial Sequence
  Marburg virus siRNA sense strand
agugaggagacguucuccaag

SEQ ID NO: 23560 - RNA, 21 nt, Artificial Sequence
  Marburg virus siRNA sense strand
gugaggagacguucuccaagc

SEQ ID NO: 23561 - RNA, 21 nt, Artificial Sequence
  Marburg virus siRNA sense strand
ugaggagacguucuccaagcc

SEQ ID NO: 23562 - RNA, 21 nt, Artificial Sequence
  Marburg virus siRNA sense strand
gaggagacguucuccaagcca

SEQ ID NO: 23563 - RNA, 21 nt, Artificial Sequence
  Marburg virus siRNA sense strand
aggagacguucuccaagccaa

SEQ ID NO: 23564 - RNA, 21 nt, Artificial Sequence
  Marburg virus siRNA sense strand
ggagacguucuccaagccaaa

SEQ ID NO: 23565 - RNA, 21 nt, Artificial Sequence
  Marburg virus siRNA sense strand
gagacguucuccaagccaaau

SEQ ID NO: 23566 - RNA, 21 nt, Artificial Sequence
  Marburg virus siRNA sense strand
agacguucuccaagccaaauc

SEQ ID NO: 23567 - RNA, 21 nt, Artificial Sequence
  Marburg virus siRNA sense strand
gacguucuccaagccaaaucu

SEQ ID NO: 23568 - RNA, 21 nt, Artificial Sequence
  Marburg virus siRNA sense strand
acguucuccaagccaaaucuu

SEQ ID NO: 23569 - RNA, 21 nt, Artificial Sequence
  Marburg virus siRNA sense strand
cguucuccaagccaaaucuuu

SEQ ID NO: 23570 - RNA, 21 nt, Artificial Sequence
  Marburg virus siRNA sense strand
guucuccaagccaaaucuuuc

SEQ ID NO: 23571 - RNA, 21 nt, Artificial Sequence
  Marburg virus siRNA sense strand
uucuccaagccaaaucuuuca

SEQ ID NO: 23572 - RNA, 21 nt, Artificial Sequence
  Marburg virus siRNA sense strand
ucuccaagccaaaucuuucag

SEQ ID NO: 23573 - RNA, 21 nt, Artificial Sequence
  Marburg virus siRNA sense strand
cuccaagccaaaucuuucagc

SEQ ID NO: 23574 - RNA, 21 nt, Artificial Sequence
  Marburg virus siRNA sense strand
uccaagccaaaucuuucagcu

SEQ ID NO: 23575 - RNA, 21 nt, Artificial Sequence
  Marburg virus siRNA sense strand
ccaagccaaaucuuucagcua

SEQ ID NO: 23576 - RNA, 21 nt, Artificial Sequence
  Marburg virus siRNA sense strand
caagccaaaucuuucagcuaa

SEQ ID NO: 23577 - RNA, 21 nt, Artificial Sequence
  Marburg virus siRNA sense strand
aagccaaaucuuucagcuaag

SEQ ID NO: 23578 - RNA, 21 nt, Artificial Sequence
  Marburg virus siRNA sense strand
agccaaaucuuucagcuaagg

SEQ ID NO: 23579 - RNA, 21 nt, Artificial Sequence
  Marburg virus siRNA sense strand
gccaaaucuuucagcuaagga

SEQ ID NO: 23580 - RNA, 21 nt, Artificial Sequence
  Marburg virus siRNA sense strand
ccaaaucuuucagcuaaggau

SEQ ID NO: 23581 - RNA, 21 nt, Artificial Sequence
  Marburg virus siRNA sense strand
caaaucuuucagcuaaggauu

SEQ ID NO: 23582 - RNA, 21 nt, Artificial Sequence
  Marburg virus siRNA sense strand
aaaucuuucagcuaaggauuu

SEQ ID NO: 23583 - RNA, 21 nt, Artificial Sequence
  Marburg virus siRNA sense strand
aaucuuucagcuaaggauuua

SEQ ID NO: 23584 - RNA, 21 nt, Artificial Sequence
  Marburg virus siRNA sense strand
aucuuucagcuaaggauuuag

SEQ ID NO: 23585 - RNA, 21 nt, Artificial Sequence
  Marburg virus siRNA sense strand
ucuuucagcuaaggauuuagc

SEQ ID NO: 23586 - RNA, 21 nt, Artificial Sequence
  Marburg virus siRNA sense strand
cuuucagcuaaggauuuagcc

SEQ ID NO: 23587 - RNA, 21 nt, Artificial Sequence
  Marburg virus siRNA sense strand
uuucagcuaaggauuuagccc

SEQ ID NO: 23588 - RNA, 21 nt, Artificial Sequence
  Marburg virus siRNA sense strand
uucagcuaaggauuuagcccu

SEQ ID NO: 23589 - RNA, 21 nt, Artificial Sequence
  Marburg virus siRNA sense strand
ucagcuaaggauuuagcccuu

SEQ ID NO: 23590 - RNA, 21 nt, Artificial Sequence
  Marburg virus siRNA sense strand
cagcuaaggauuuagcccuuu

SEQ ID NO: 23591 - RNA, 21 nt, Artificial Sequence
  Marburg virus siRNA sense strand
agcuaaggauuuagcccuuuu

SEQ ID NO: 23592 - RNA, 21 nt, Artificial Sequence
  Marburg virus siRNA sense strand
gcuaaggauuuagcccuuuug

SEQ ID NO: 23593 - RNA, 21 nt, Artificial Sequence
  Marburg virus siRNA sense strand
cuaaggauuuagcccuuuugu

SEQ ID NO: 23594 - RNA, 21 nt, Artificial Sequence
  Marburg virus siRNA sense strand
uaaggauuuagcccuuuuguu

SEQ ID NO: 23595 - RNA, 21 nt, Artificial Sequence
  Marburg virus siRNA sense strand
aaggauuuagcccuuuuguug

SEQ ID NO: 23596 - RNA, 21 nt, Artificial Sequence
  Marburg virus siRNA sense strand
aggauuuagcccuuuuguugu

SEQ ID NO: 23597 - RNA, 21 nt, Artificial Sequence
  Marburg virus siRNA sense strand
ggauuuagcccuuuuguuguu

SEQ ID NO: 23598 - RNA, 21 nt, Artificial Sequence
  Marburg virus siRNA sense strand
gauuuagcccuuuuguuguuu

SEQ ID NO: 23599 - RNA, 21 nt, Artificial Sequence
  Marburg virus siRNA sense strand
auuuagcccuuuuguuguuua

SEQ ID NO: 23600 - RNA, 21 nt, Artificial Sequence
  Marburg virus siRNA sense strand
uuuagcccuuuuguuguuuac

SEQ ID NO: 23601 - RNA, 21 nt, Artificial Sequence
  Marburg virus siRNA sense strand
uuagcccuuuuguuguuuacc

SEQ ID NO: 23602 - RNA, 21 nt, Artificial Sequence
  Marburg virus siRNA sense strand
uagcccuuuuguuguuuaccc

SEQ ID NO: 23603 - RNA, 21 nt, Artificial Sequence
  Marburg virus siRNA sense strand
agcccuuuuguuguuuaccca

SEQ ID NO: 23604 - RNA, 21 nt, Artificial Sequence
  Marburg virus siRNA sense strand
gcccuuuuguuguuuacccau

SEQ ID NO: 23605 - RNA, 21 nt, Artificial Sequence
  Marburg virus siRNA sense strand
cccuuuuguuguuuacccauc

SEQ ID NO: 23606 - RNA, 21 nt, Artificial Sequence
  Marburg virus siRNA sense strand
ccuuuuguuguuuacccaucu

SEQ ID NO: 23607 - RNA, 21 nt, Artificial Sequence
  Marburg virus siRNA sense strand
cuuuuguuguuuacccaucua

SEQ ID NO: 23608 - RNA, 21 nt, Artificial Sequence
  Marburg virus siRNA sense strand
uuuuguuguuuacccaucuac

SEQ ID NO: 23609 - RNA, 21 nt, Artificial Sequence
  Marburg virus siRNA sense strand
uuuguuguuuacccaucuacc

SEQ ID NO: 23610 - RNA, 21 nt, Artificial Sequence
  Marburg virus siRNA sense strand
uuguuguuuacccaucuaccc

SEQ ID NO: 23611 - RNA, 21 nt, Artificial Sequence
  Marburg virus siRNA sense strand
uguuguuuacccaucuacccg

SEQ ID NO: 23612 - RNA, 21 nt, Artificial Sequence
  Marburg virus siRNA sense strand
guuguuuacccaucuacccgg

SEQ ID NO: 23613 - RNA, 21 nt, Artificial Sequence
  Marburg virus siRNA sense strand
uuguuuacccaucuacccggc

SEQ ID NO: 23614 - RNA, 21 nt, Artificial Sequence
  Marburg virus siRNA sense strand
uguuuacccaucuacccggca

SEQ ID NO: 23615 - RNA, 21 nt, Artificial Sequence
  Marburg virus siRNA sense strand
guuuacccaucuacccggcaa

SEQ ID NO: 23616 - RNA, 21 nt, Artificial Sequence
  Marburg virus siRNA sense strand
uuuacccaucuacccggcaac

SEQ ID NO: 23617 - RNA, 21 nt, Artificial Sequence
  Marburg virus siRNA sense strand
uuacccaucuacccggcaaca

SEQ ID NO: 23618 - RNA, 21 nt, Artificial Sequence
  Marburg virus siRNA sense strand
uacccaucuacccggcaacaa

SEQ ID NO: 23619 - RNA, 21 nt, Artificial Sequence
  Marburg virus siRNA sense strand
acccaucuacccggcaacaac

SEQ ID NO: 23620 - RNA, 21 nt, Artificial Sequence
  Marburg virus siRNA sense strand
cccaucuacccggcaacaaca

SEQ ID NO: 23621 - RNA, 21 nt, Artificial Sequence
  Marburg virus siRNA sense strand
ccaucuacccggcaacaacac

SEQ ID NO: 23622 - RNA, 21 nt, Artificial Sequence
  Marburg virus siRNA sense strand
caucuacccggcaacaacacu

SEQ ID NO: 23623 - RNA, 21 nt, Artificial Sequence
  Marburg virus siRNA sense strand
aucuacccggcaacaacacuc

SEQ ID NO: 23624 - RNA, 21 nt, Artificial Sequence
  Marburg virus siRNA sense strand
ucuacccggcaacaacacucc

SEQ ID NO: 23625 - RNA, 21 nt, Artificial Sequence
  Marburg virus siRNA sense strand
cuacccggcaacaacacucca

SEQ ID NO: 23626 - RNA, 21 nt, Artificial Sequence
  Marburg virus siRNA sense strand
uacccggcaacaacacuccau

SEQ ID NO: 23627 - RNA, 21 nt, Artificial Sequence
  Marburg virus siRNA sense strand
acccggcaacaacacuccauu

SEQ ID NO: 23628 - RNA, 21 nt, Artificial Sequence
  Marburg virus siRNA sense strand
cccggcaacaacacuccauuc

SEQ ID NO: 23629 - RNA, 21 nt, Artificial Sequence
  Marburg virus siRNA sense strand
ccggcaacaacacuccauucc

SEQ ID NO: 23630 - RNA, 21 nt, Artificial Sequence
  Marburg virus siRNA sense strand
cggcaacaacacuccauucca

SEQ ID NO: 23631 - RNA, 21 nt, Artificial Sequence
  Marburg virus siRNA sense strand
ggcaacaacacuccauuccau

SEQ ID NO: 23632 - RNA, 21 nt, Artificial Sequence
  Marburg virus siRNA sense strand
gcaacaacacuccauuccaua

SEQ ID NO: 23633 - RNA, 21 nt, Artificial Sequence
  Marburg virus siRNA sense strand
caacaacacuccauuccauau

SEQ ID NO: 23634 - RNA, 21 nt, Artificial Sequence
  Marburg virus siRNA sense strand
aacaacacuccauuccauauc

SEQ ID NO: 23635 - RNA, 21 nt, Artificial Sequence
  Marburg virus siRNA sense strand
acaacacuccauuccauaucc

SEQ ID NO: 23636 - RNA, 21 nt, Artificial Sequence
  Marburg virus siRNA sense strand
caacacuccauuccauauccu

SEQ ID NO: 23637 - RNA, 21 nt, Artificial Sequence
  Marburg virus siRNA sense strand
aacacuccauuccauauccua

SEQ ID NO: 23638 - RNA, 21 nt, Artificial Sequence
  Marburg virus siRNA sense strand
acacuccauuccauauccuag

SEQ ID NO: 23639 - RNA, 21 nt, Artificial Sequence
  Marburg virus siRNA sense strand
cacuccauuccauauccuagc

SEQ ID NO: 23640 - RNA, 21 nt, Artificial Sequence
  Marburg virus siRNA sense strand
acuccauuccauauccuagcu

SEQ ID NO: 23641 - RNA, 21 nt, Artificial Sequence
  Marburg virus siRNA sense strand
cuccauuccauauccuagcuc

SEQ ID NO: 23642 - RNA, 21 nt, Artificial Sequence
  Marburg virus siRNA sense strand
uccauuccauauccuagcuca

SEQ ID NO: 23643 - RNA, 21 nt, Artificial Sequence
  Marburg virus siRNA sense strand
ccauuccauauccuagcucaa

SEQ ID NO: 23644 - RNA, 21 nt, Artificial Sequence
  Marburg virus siRNA sense strand
cauuccauauccuagcucaag

SEQ ID NO: 23645 - RNA, 21 nt, Artificial Sequence
  Marburg virus siRNA sense strand
auuccauauccuagcucaagu

SEQ ID NO: 23646 - RNA, 21 nt, Artificial Sequence
  Marburg virus siRNA sense strand
uuccauauccuagcucaaguc

SEQ ID NO: 23647 - RNA, 21 nt, Artificial Sequence
  Marburg virus siRNA sense strand
uccauauccuagcucaagucc

SEQ ID NO: 23648 - RNA, 21 nt, Artificial Sequence
  Marburg virus siRNA sense strand
ccauauccuagcucaaguccu

SEQ ID NO: 23649 - RNA, 21 nt, Artificial Sequence
  Marburg virus siRNA sense strand
cauauccuagcucaaguccuu

SEQ ID NO: 23650 - RNA, 21 nt, Artificial Sequence
  Marburg virus siRNA sense strand
auauccuagcucaaguccuuu

SEQ ID NO: 23651 - RNA, 21 nt, Artificial Sequence
  Marburg virus siRNA sense strand
uauccuagcucaaguccuuuc

SEQ ID NO: 23652 - RNA, 21 nt, Artificial Sequence
  Marburg virus siRNA sense strand
auccuagcucaaguccuuuca

SEQ ID NO: 23653 - RNA, 21 nt, Artificial Sequence
  Marburg virus siRNA sense strand
uccuagcucaaguccuuucaa

SEQ ID NO: 23654 - RNA, 21 nt, Artificial Sequence
  Marburg virus siRNA sense strand
ccuagcucaaguccuuucaaa

SEQ ID NO: 23655 - RNA, 21 nt, Artificial Sequence
  Marburg virus siRNA sense strand
cuagcucaaguccuuucaaaa

SEQ ID NO: 23656 - RNA, 21 nt, Artificial Sequence
  Marburg virus siRNA sense strand
uagcucaaguccuuucaaaaa

SEQ ID NO: 23657 - RNA, 21 nt, Artificial Sequence
  Marburg virus siRNA sense strand
agcucaaguccuuucaaaaau

SEQ ID NO: 23658 - RNA, 21 nt, Artificial Sequence
  Marburg virus siRNA sense strand
gcucaaguccuuucaaaaauu

SEQ ID NO: 23659 - RNA, 21 nt, Artificial Sequence
  Marburg virus siRNA sense strand
cucaaguccuuucaaaaauug

SEQ ID NO: 23660 - RNA, 21 nt, Artificial Sequence
  Marburg virus siRNA sense strand
ucaaguccuuucaaaaauugc

SEQ ID NO: 23661 - RNA, 21 nt, Artificial Sequence
  Marburg virus siRNA sense strand
caaguccuuucaaaaauugcu

SEQ ID NO: 23662 - RNA, 21 nt, Artificial Sequence
  Marburg virus siRNA sense strand
aaguccuuucaaaaauugcuu

SEQ ID NO: 23663 - RNA, 21 nt, Artificial Sequence
  Marburg virus siRNA sense strand
aguccuuucaaaaauugcuua

SEQ ID NO: 23664 - RNA, 21 nt, Artificial Sequence
  Marburg virus siRNA sense strand
guccuuucaaaaauugcuuac

SEQ ID NO: 23665 - RNA, 21 nt, Artificial Sequence
  Marburg virus siRNA sense strand
uccuuucaaaaauugcuuaca

SEQ ID NO: 23666 - RNA, 21 nt, Artificial Sequence
  Marburg virus siRNA sense strand
ccuuucaaaaauugcuuacaa

SEQ ID NO: 23667 - RNA, 21 nt, Artificial Sequence
  Marburg virus siRNA sense strand
cuuucaaaaauugcuuacaag

SEQ ID NO: 23668 - RNA, 21 nt, Artificial Sequence
  Marburg virus siRNA sense strand
uuucaaaaauugcuuacaagu

SEQ ID NO: 23669 - RNA, 21 nt, Artificial Sequence
  Marburg virus siRNA sense strand
uucaaaaauugcuuacaaguc

SEQ ID NO: 23670 - RNA, 21 nt, Artificial Sequence
  Marburg virus siRNA sense strand
ucaaaaauugcuuacaaguca

SEQ ID NO: 23671 - RNA, 21 nt, Artificial Sequence
  Marburg virus siRNA sense strand
caaaaauugcuuacaagucag

SEQ ID NO: 23672 - RNA, 21 nt, Artificial Sequence
  Marburg virus siRNA sense strand
aaaaauugcuuacaagucagg

SEQ ID NO: 23673 - RNA, 21 nt, Artificial Sequence
  Marburg virus siRNA sense strand
aaaauugcuuacaagucagga

SEQ ID NO: 23674 - RNA, 21 nt, Artificial Sequence
  Marburg virus siRNA sense strand
aaauugcuuacaagucaggaa

SEQ ID NO: 23675 - RNA, 21 nt, Artificial Sequence
  Marburg virus siRNA sense strand
aauugcuuacaagucaggaaa

SEQ ID NO: 23676 - RNA, 21 nt, Artificial Sequence
  Marburg virus siRNA sense strand
auugcuuacaagucaggaaag

SEQ ID NO: 23677 - RNA, 21 nt, Artificial Sequence
  Marburg virus siRNA sense strand
uugcuuacaagucaggaaagu

SEQ ID NO: 23678 - RNA, 21 nt, Artificial Sequence
  Marburg virus siRNA sense strand
ugcuuacaagucaggaaaguc

SEQ ID NO: 23679 - RNA, 21 nt, Artificial Sequence
  Marburg virus siRNA sense strand
gcuuacaagucaggaaagucc

SEQ ID NO: 23680 - RNA, 21 nt, Artificial Sequence
  Marburg virus siRNA sense strand
cuuacaagucaggaaaguccg

SEQ ID NO: 23681 - RNA, 21 nt, Artificial Sequence
  Marburg virus siRNA sense strand
uuacaagucaggaaaguccgg

SEQ ID NO: 23682 - RNA, 21 nt, Artificial Sequence
  Marburg virus siRNA sense strand
uacaagucaggaaaguccgga

SEQ ID NO: 23683 - RNA, 21 nt, Artificial Sequence
  Marburg virus siRNA sense strand
acaagucaggaaaguccggag

SEQ ID NO: 23684 - RNA, 21 nt, Artificial Sequence
  Marburg virus siRNA sense strand
caagucaggaaaguccggagc

SEQ ID NO: 23685 - RNA, 21 nt, Artificial Sequence
  Marburg virus siRNA sense strand
aagucaggaaaguccggagca

SEQ ID NO: 23686 - RNA, 21 nt, Artificial Sequence
  Marburg virus siRNA sense strand
agucaggaaaguccggagcau

SEQ ID NO: 23687 - RNA, 21 nt, Artificial Sequence
  Marburg virus siRNA sense strand
gucaggaaaguccggagcauu

SEQ ID NO: 23688 - RNA, 21 nt, Artificial Sequence
  Marburg virus siRNA sense strand
ucaggaaaguccggagcauuu

SEQ ID NO: 23689 - RNA, 21 nt, Artificial Sequence
  Marburg virus siRNA sense strand
caggaaaguccggagcauuuu

SEQ ID NO: 23690 - RNA, 21 nt, Artificial Sequence
  Marburg virus siRNA sense strand
aggaaaguccggagcauuuuu

SEQ ID NO: 23691 - RNA, 21 nt, Artificial Sequence
  Marburg virus siRNA sense strand
ggaaaguccggagcauuuuug

SEQ ID NO: 23692 - RNA, 21 nt, Artificial Sequence
  Marburg virus siRNA sense strand
gaaaguccggagcauuuuugg

SEQ ID NO: 23693 - RNA, 21 nt, Artificial Sequence
  Marburg virus siRNA sense strand
aaaguccggagcauuuuugga

SEQ ID NO: 23694 - RNA, 21 nt, Artificial Sequence
  Marburg virus siRNA sense strand
aaguccggagcauuuuuggau

SEQ ID NO: 23695 - RNA, 21 nt, Artificial Sequence
  Marburg virus siRNA sense strand
aguccggagcauuuuuggaug

SEQ ID NO: 23696 - RNA, 21 nt, Artificial Sequence
  Marburg virus siRNA sense strand
guccggagcauuuuuggaugc

SEQ ID NO: 23697 - RNA, 21 nt, Artificial Sequence
  Marburg virus siRNA sense strand
uccggagcauuuuuggaugca

SEQ ID NO: 23698 - RNA, 21 nt, Artificial Sequence
  Marburg virus siRNA sense strand
ccggagcauuuuuggaugcau

SEQ ID NO: 23699 - RNA, 21 nt, Artificial Sequence
  Marburg virus siRNA sense strand
cggagcauuuuuggaugcauu

SEQ ID NO: 23700 - RNA, 21 nt, Artificial Sequence
  Marburg virus siRNA sense strand
ggagcauuuuuggaugcauuu

SEQ ID NO: 23701 - RNA, 21 nt, Artificial Sequence
  Marburg virus siRNA sense strand
gagcauuuuuggaugcauuuc

SEQ ID NO: 23702 - RNA, 21 nt, Artificial Sequence
  Marburg virus siRNA sense strand
agcauuuuuggaugcauuuca

SEQ ID NO: 23703 - RNA, 21 nt, Artificial Sequence
  Marburg virus siRNA sense strand
gcauuuuuggaugcauuucac

SEQ ID NO: 23704 - RNA, 21 nt, Artificial Sequence
  Marburg virus siRNA sense strand
cauuuuuggaugcauuucacc

SEQ ID NO: 23705 - RNA, 21 nt, Artificial Sequence
  Marburg virus siRNA sense strand
auuuuuggaugcauuucacca

SEQ ID NO: 23706 - RNA, 21 nt, Artificial Sequence
  Marburg virus siRNA sense strand
uuuuuggaugcauuucaccag

SEQ ID NO: 23707 - RNA, 21 nt, Artificial Sequence
  Marburg virus siRNA sense strand
uuuuggaugcauuucaccaga

SEQ ID NO: 23708 - RNA, 21 nt, Artificial Sequence
  Marburg virus siRNA sense strand
uuuggaugcauuucaccagau

SEQ ID NO: 23709 - RNA, 21 nt, Artificial Sequence
  Marburg virus siRNA sense strand
uuggaugcauuucaccagauu

SEQ ID NO: 23710 - RNA, 21 nt, Artificial Sequence
  Marburg virus siRNA sense strand
uggaugcauuucaccagauuc

SEQ ID NO: 23711 - RNA, 21 nt, Artificial Sequence
  Marburg virus siRNA sense strand
ggaugcauuucaccagauucu

SEQ ID NO: 23712 - RNA, 21 nt, Artificial Sequence
  Marburg virus siRNA sense strand
gaugcauuucaccagauucua

SEQ ID NO: 23713 - RNA, 21 nt, Artificial Sequence
  Marburg virus siRNA sense strand
augcauuucaccagauucuaa

SEQ ID NO: 23714 - RNA, 21 nt, Artificial Sequence
  Marburg virus siRNA sense strand
ugcauuucaccagauucuaag

SEQ ID NO: 23715 - RNA, 21 nt, Artificial Sequence
  Marburg virus siRNA sense strand
gcauuucaccagauucuaagu

SEQ ID NO: 23716 - RNA, 21 nt, Artificial Sequence
  Marburg virus siRNA sense strand
cauuucaccagauucuaagug

SEQ ID NO: 23717 - RNA, 21 nt, Artificial Sequence
  Marburg virus siRNA sense strand
auuucaccagauucuaaguga

SEQ ID NO: 23718 - RNA, 21 nt, Artificial Sequence
  Marburg virus siRNA sense strand
uuucaccagauucuaagugaa

SEQ ID NO: 23719 - RNA, 21 nt, Artificial Sequence
  Marburg virus siRNA sense strand
uucaccagauucuaagugaag

SEQ ID NO: 23720 - RNA, 21 nt, Artificial Sequence
  Marburg virus siRNA sense strand
ucaccagauucuaagugaagg

SEQ ID NO: 23721 - RNA, 21 nt, Artificial Sequence
  Marburg virus siRNA sense strand
caccagauucuaagugaagga

SEQ ID NO: 23722 - RNA, 21 nt, Artificial Sequence
  Marburg virus siRNA sense strand
accagauucuaagugaaggag

SEQ ID NO: 23723 - RNA, 21 nt, Artificial Sequence
  Marburg virus siRNA sense strand
ccagauucuaagugaaggaga

SEQ ID NO: 23724 - RNA, 21 nt, Artificial Sequence
  Marburg virus siRNA sense strand
cagauucuaagugaaggagag

SEQ ID NO: 23725 - RNA, 21 nt, Artificial Sequence
  Marburg virus siRNA sense strand
agauucuaagugaaggagaga

SEQ ID NO: 23726 - RNA, 21 nt, Artificial Sequence
  Marburg virus siRNA sense strand
gauucuaagugaaggagagaa

SEQ ID NO: 23727 - RNA, 21 nt, Artificial Sequence
  Marburg virus siRNA sense strand
auucuaagugaaggagagaau

SEQ ID NO: 23728 - RNA, 21 nt, Artificial Sequence
  Marburg virus siRNA sense strand
uucuaagugaaggagagaaug

SEQ ID NO: 23729 - RNA, 21 nt, Artificial Sequence
  Marburg virus siRNA sense strand
ucuaagugaaggagagaaugc

SEQ ID NO: 23730 - RNA, 21 nt, Artificial Sequence
  Marburg virus siRNA sense strand
cuaagugaaggagagaaugcu

SEQ ID NO: 23731 - RNA, 21 nt, Artificial Sequence
  Marburg virus siRNA sense strand
uaagugaaggagagaaugcuc

SEQ ID NO: 23732 - RNA, 21 nt, Artificial Sequence
  Marburg virus siRNA sense strand
aagugaaggagagaaugcuca

SEQ ID NO: 23733 - RNA, 21 nt, Artificial Sequence
  Marburg virus siRNA sense strand
agugaaggagagaaugcucag

SEQ ID NO: 23734 - RNA, 21 nt, Artificial Sequence
  Marburg virus siRNA sense strand
gugaaggagagaaugcucagg

SEQ ID NO: 23735 - RNA, 21 nt, Artificial Sequence
  Marburg virus siRNA sense strand
ugaaggagagaaugcucaggc

SEQ ID NO: 23736 - RNA, 21 nt, Artificial Sequence
  Marburg virus siRNA sense strand
gaaggagagaaugcucaggca

SEQ ID NO: 23737 - RNA, 21 nt, Artificial Sequence
  Marburg virus siRNA sense strand
aaggagagaaugcucaggcag

SEQ ID NO: 23738 - RNA, 21 nt, Artificial Sequence
  Marburg virus siRNA sense strand
aggagagaaugcucaggcagc

SEQ ID NO: 23739 - RNA, 21 nt, Artificial Sequence
  Marburg virus siRNA sense strand
ggagagaaugcucaggcagca

SEQ ID NO: 23740 - RNA, 21 nt, Artificial Sequence
  Marburg virus siRNA sense strand
gagagaaugcucaggcagcau

SEQ ID NO: 23741 - RNA, 21 nt, Artificial Sequence
  Marburg virus siRNA sense strand
agagaaugcucaggcagcauu

SEQ ID NO: 23742 - RNA, 21 nt, Artificial Sequence
  Marburg virus siRNA sense strand
gagaaugcucaggcagcauug

SEQ ID NO: 23743 - RNA, 21 nt, Artificial Sequence
  Marburg virus siRNA sense strand
agaaugcucaggcagcauuga

SEQ ID NO: 23744 - RNA, 21 nt, Artificial Sequence
  Marburg virus siRNA sense strand
gaaugcucaggcagcauugac

SEQ ID NO: 23745 - RNA, 21 nt, Artificial Sequence
  Marburg virus siRNA sense strand
aaugcucaggcagcauugacu

SEQ ID NO: 23746 - RNA, 21 nt, Artificial Sequence
  Marburg virus siRNA sense strand
augcucaggcagcauugacuc

SEQ ID NO: 23747 - RNA, 21 nt, Artificial Sequence
  Marburg virus siRNA sense strand
ugcucaggcagcauugacucg

SEQ ID NO: 23748 - RNA, 21 nt, Artificial Sequence
  Marburg virus siRNA sense strand
gcucaggcagcauugacucga

SEQ ID NO: 23749 - RNA, 21 nt, Artificial Sequence
  Marburg virus siRNA sense strand
cucaggcagcauugacucgac

SEQ ID NO: 23750 - RNA, 21 nt, Artificial Sequence
  Marburg virus siRNA sense strand
ucaggcagcauugacucgacu

SEQ ID NO: 23751 - RNA, 21 nt, Artificial Sequence
  Marburg virus siRNA sense strand
caggcagcauugacucgacua

SEQ ID NO: 23752 - RNA, 21 nt, Artificial Sequence
  Marburg virus siRNA sense strand
aggcagcauugacucgacuaa

SEQ ID NO: 23753 - RNA, 21 nt, Artificial Sequence
  Marburg virus siRNA sense strand
ggcagcauugacucgacuaag

SEQ ID NO: 23754 - RNA, 21 nt, Artificial Sequence
  Marburg virus siRNA sense strand
gcagcauugacucgacuaagc

SEQ ID NO: 23755 - RNA, 21 nt, Artificial Sequence
  Marburg virus siRNA sense strand
cagcauugacucgacuaagca

SEQ ID NO: 23756 - RNA, 21 nt, Artificial Sequence
  Marburg virus siRNA sense strand
agcauugacucgacuaagcag

SEQ ID NO: 23757 - RNA, 21 nt, Artificial Sequence
  Marburg virus siRNA sense strand
gcauugacucgacuaagcaga

SEQ ID NO: 23758 - RNA, 21 nt, Artificial Sequence
  Marburg virus siRNA sense strand
cauugacucgacuaagcagaa

SEQ ID NO: 23759 - RNA, 21 nt, Artificial Sequence
  Marburg virus siRNA sense strand
auugacucgacuaagcagaac

SEQ ID NO: 23760 - RNA, 21 nt, Artificial Sequence
  Marburg virus siRNA sense strand
uugacucgacuaagcagaaca

SEQ ID NO: 23761 - RNA, 21 nt, Artificial Sequence
  Marburg virus siRNA sense strand
ugacucgacuaagcagaacau

SEQ ID NO: 23762 - RNA, 21 nt, Artificial Sequence
  Marburg virus siRNA sense strand
gacucgacuaagcagaacauu

SEQ ID NO: 23763 - RNA, 21 nt, Artificial Sequence
  Marburg virus siRNA sense strand
acucgacuaagcagaacauuu

SEQ ID NO: 23764 - RNA, 21 nt, Artificial Sequence
  Marburg virus siRNA sense strand
cucgacuaagcagaacauuug

SEQ ID NO: 23765 - RNA, 21 nt, Artificial Sequence
  Marburg virus siRNA sense strand
ucgacuaagcagaacauuuga

SEQ ID NO: 23766 - RNA, 21 nt, Artificial Sequence
  Marburg virus siRNA sense strand
cgacuaagcagaacauuugau

SEQ ID NO: 23767 - RNA, 21 nt, Artificial Sequence
  Marburg virus siRNA sense strand
gacuaagcagaacauuugaug

SEQ ID NO: 23768 - RNA, 21 nt, Artificial Sequence
  Marburg virus siRNA sense strand
acuaagcagaacauuugaugc

SEQ ID NO: 23769 - RNA, 21 nt, Artificial Sequence
  Marburg virus siRNA sense strand
cuaagcagaacauuugaugcu

SEQ ID NO: 23770 - RNA, 21 nt, Artificial Sequence
  Marburg virus siRNA sense strand
uaagcagaacauuugaugcuu

SEQ ID NO: 23771 - RNA, 21 nt, Artificial Sequence
  Marburg virus siRNA sense strand
aagcagaacauuugaugcuuu

SEQ ID NO: 23772 - RNA, 21 nt, Artificial Sequence
  Marburg virus siRNA sense strand
agcagaacauuugaugcuuuc

SEQ ID NO: 23773 - RNA, 21 nt, Artificial Sequence
  Marburg virus siRNA sense strand
gcagaacauuugaugcuuucc

SEQ ID NO: 23774 - RNA, 21 nt, Artificial Sequence
  Marburg virus siRNA sense strand
cagaacauuugaugcuuuccu

SEQ ID NO: 23775 - RNA, 21 nt, Artificial Sequence
  Marburg virus siRNA sense strand
agaacauuugaugcuuuccuc

SEQ ID NO: 23776 - RNA, 21 nt, Artificial Sequence
  Marburg virus siRNA sense strand
gaacauuugaugcuuuccucg

SEQ ID NO: 23777 - RNA, 21 nt, Artificial Sequence
  Marburg virus siRNA sense strand
aacauuugaugcuuuccucgg

SEQ ID NO: 23778 - RNA, 21 nt, Artificial Sequence
  Marburg virus siRNA sense strand
acauuugaugcuuuccucgga

SEQ ID NO: 23779 - RNA, 21 nt, Artificial Sequence
  Marburg virus siRNA sense strand
cauuugaugcuuuccucggag

SEQ ID NO: 23780 - RNA, 21 nt, Artificial Sequence
  Marburg virus siRNA sense strand
auuugaugcuuuccucggagu

SEQ ID NO: 23781 - RNA, 21 nt, Artificial Sequence
  Marburg virus siRNA sense strand
uuugaugcuuuccucggagua

SEQ ID NO: 23782 - RNA, 21 nt, Artificial Sequence
  Marburg virus siRNA sense strand
uugaugcuuuccucggaguag

SEQ ID NO: 23783 - RNA, 21 nt, Artificial Sequence
  Marburg virus siRNA sense strand
ugaugcuuuccucggaguagu

SEQ ID NO: 23784 - RNA, 21 nt, Artificial Sequence
  Marburg virus siRNA sense strand
gaugcuuuccucggaguaguu

SEQ ID NO: 23785 - RNA, 21 nt, Artificial Sequence
  Marburg virus siRNA sense strand
augcuuuccucggaguaguuc

SEQ ID NO: 23786 - RNA, 21 nt, Artificial Sequence
  Marburg virus siRNA sense strand
ugcuuuccucggaguaguucc

SEQ ID NO: 23787 - RNA, 21 nt, Artificial Sequence
  Marburg virus siRNA sense strand
gcuuuccucggaguaguuccu

SEQ ID NO: 23788 - RNA, 21 nt, Artificial Sequence
  Marburg virus siRNA sense strand
cuuuccucggaguaguuccuc

SEQ ID NO: 23789 - RNA, 21 nt, Artificial Sequence
  Marburg virus siRNA sense strand
uuuccucggaguaguuccucc

SEQ ID NO: 23790 - RNA, 21 nt, Artificial Sequence
  Marburg virus siRNA sense strand
uuccucggaguaguuccucca

SEQ ID NO: 23791 - RNA, 21 nt, Artificial Sequence
  Marburg virus siRNA sense strand
uccucggaguaguuccuccag

SEQ ID NO: 23792 - RNA, 21 nt, Artificial Sequence
  Marburg virus siRNA sense strand
ccucggaguaguuccuccagu

SEQ ID NO: 23793 - RNA, 21 nt, Artificial Sequence
  Marburg virus siRNA sense strand
cucggaguaguuccuccagug

SEQ ID NO: 23794 - RNA, 21 nt, Artificial Sequence
  Marburg virus siRNA sense strand
ucggaguaguuccuccaguga

SEQ ID NO: 23795 - RNA, 21 nt, Artificial Sequence
  Marburg virus siRNA sense strand
cggaguaguuccuccagugau

SEQ ID NO: 23796 - RNA, 21 nt, Artificial Sequence
  Marburg virus siRNA sense strand
ggaguaguuccuccagugaua

SEQ ID NO: 23797 - RNA, 21 nt, Artificial Sequence
  Marburg virus siRNA sense strand
gaguaguuccuccagugauaa

SEQ ID NO: 23798 - RNA, 21 nt, Artificial Sequence
  Marburg virus siRNA sense strand
aguaguuccuccagugauaag

SEQ ID NO: 23799 - RNA, 21 nt, Artificial Sequence
  Marburg virus siRNA sense strand
guaguuccuccagugauaaga

SEQ ID NO: 23800 - RNA, 21 nt, Artificial Sequence
  Marburg virus siRNA sense strand
uaguuccuccagugauaagag

SEQ ID NO: 23801 - RNA, 21 nt, Artificial Sequence
  Marburg virus siRNA sense strand
aguuccuccagugauaagagu

SEQ ID NO: 23802 - RNA, 21 nt, Artificial Sequence
  Marburg virus siRNA sense strand
guuccuccagugauaagaguc

SEQ ID NO: 23803 - RNA, 21 nt, Artificial Sequence
  Marburg virus siRNA sense strand
uuccuccagugauaagaguca

SEQ ID NO: 23804 - RNA, 21 nt, Artificial Sequence
  Marburg virus siRNA sense strand
uccuccagugauaagagucaa

SEQ ID NO: 23805 - RNA, 21 nt, Artificial Sequence
  Marburg virus siRNA sense strand
ccuccagugauaagagucaaa

SEQ ID NO: 23806 - RNA, 21 nt, Artificial Sequence
  Marburg virus siRNA sense strand
cuccagugauaagagucaaaa

SEQ ID NO: 23807 - RNA, 21 nt, Artificial Sequence
  Marburg virus siRNA sense strand
uccagugauaagagucaaaaa

SEQ ID NO: 23808 - RNA, 21 nt, Artificial Sequence
  Marburg virus siRNA sense strand
ccagugauaagagucaaaaac

SEQ ID NO: 23809 - RNA, 21 nt, Artificial Sequence
  Marburg virus siRNA sense strand
cagugauaagagucaaaaacu

SEQ ID NO: 23810 - RNA, 21 nt, Artificial Sequence
  Marburg virus siRNA sense strand
agugauaagagucaaaaacuu

SEQ ID NO: 23811 - RNA, 21 nt, Artificial Sequence
  Marburg virus siRNA sense strand
gugauaagagucaaaaacuuc

SEQ ID NO: 23812 - RNA, 21 nt, Artificial Sequence
  Marburg virus siRNA sense strand
ugauaagagucaaaaacuucc

SEQ ID NO: 23813 - RNA, 21 nt, Artificial Sequence
  Marburg virus siRNA sense strand
gauaagagucaaaaacuucca

SEQ ID NO: 23814 - RNA, 21 nt, Artificial Sequence
  Marburg virus siRNA sense strand
auaagagucaaaaacuuccaa

SEQ ID NO: 23815 - RNA, 21 nt, Artificial Sequence
  Marburg virus siRNA sense strand
uaagagucaaaaacuuccaaa

SEQ ID NO: 23816 - RNA, 21 nt, Artificial Sequence
  Marburg virus siRNA sense strand
aagagucaaaaacuuccaaac

SEQ ID NO: 23817 - RNA, 21 nt, Artificial Sequence
  Marburg virus siRNA sense strand
agagucaaaaacuuccaaaca

SEQ ID NO: 23818 - RNA, 21 nt, Artificial Sequence
  Marburg virus siRNA sense strand
gagucaaaaacuuccaaacag

SEQ ID NO: 23819 - RNA, 21 nt, Artificial Sequence
  Marburg virus siRNA sense strand
agucaaaaacuuccaaacagu

SEQ ID NO: 23820 - RNA, 21 nt, Artificial Sequence
  Marburg virus siRNA sense strand
gucaaaaacuuccaaacaguc

SEQ ID NO: 23821 - RNA, 21 nt, Artificial Sequence
  Marburg virus siRNA sense strand
ucaaaaacuuccaaacagucc

SEQ ID NO: 23822 - RNA, 21 nt, Artificial Sequence
  Marburg virus siRNA sense strand
caaaaacuuccaaacaguccc

SEQ ID NO: 23823 - RNA, 21 nt, Artificial Sequence
  Marburg virus siRNA sense strand
aaaaacuuccaaacagucccu

SEQ ID NO: 23824 - RNA, 21 nt, Artificial Sequence
  Marburg virus siRNA sense strand
aaaacuuccaaacagucccuc

SEQ ID NO: 23825 - RNA, 21 nt, Artificial Sequence
  Marburg virus siRNA sense strand
aaacuuccaaacagucccucg

SEQ ID NO: 23826 - RNA, 21 nt, Artificial Sequence
  Marburg virus siRNA sense strand
aacuuccaaacagucccucgc

SEQ ID NO: 23827 - RNA, 21 nt, Artificial Sequence
  Marburg virus siRNA sense strand
acuuccaaacagucccucgcc

SEQ ID NO: 23828 - RNA, 21 nt, Artificial Sequence
  Marburg virus siRNA sense strand
cuuccaaacagucccucgccc

SEQ ID NO: 23829 - RNA, 21 nt, Artificial Sequence
  Marburg virus siRNA sense strand
uuccaaacagucccucgccca

SEQ ID NO: 23830 - RNA, 21 nt, Artificial Sequence
  Marburg virus siRNA sense strand
uccaaacagucccucgcccau

SEQ ID NO: 23831 - RNA, 21 nt, Artificial Sequence
  Marburg virus siRNA sense strand
ccaaacagucccucgcccaug

SEQ ID NO: 23832 - RNA, 21 nt, Artificial Sequence
  Marburg virus siRNA sense strand
caaacagucccucgcccaugu

SEQ ID NO: 23833 - RNA, 21 nt, Artificial Sequence
  Marburg virus siRNA sense strand
aaacagucccucgcccauguc

SEQ ID NO: 23834 - RNA, 21 nt, Artificial Sequence
  Marburg virus siRNA sense strand
aacagucccucgcccauguca

SEQ ID NO: 23835 - RNA, 21 nt, Artificial Sequence
  Marburg virus siRNA sense strand
acagucccucgcccaugucaa

SEQ ID NO: 23836 - RNA, 21 nt, Artificial Sequence
  Marburg virus siRNA sense strand
cagucccucgcccaugucaaa

SEQ ID NO: 23837 - RNA, 21 nt, Artificial Sequence
  Marburg virus siRNA sense strand
agucccucgcccaugucaaaa

SEQ ID NO: 23838 - RNA, 21 nt, Artificial Sequence
  Marburg virus siRNA sense strand
gucccucgcccaugucaaaaa

SEQ ID NO: 23839 - RNA, 21 nt, Artificial Sequence
  Marburg virus siRNA sense strand
ucccucgcccaugucaaaaaa

SEQ ID NO: 23840 - RNA, 21 nt, Artificial Sequence
  Marburg virus siRNA sense strand
cccucgcccaugucaaaaaag

SEQ ID NO: 23841 - RNA, 21 nt, Artificial Sequence
  Marburg virus siRNA sense strand
ccucgcccaugucaaaaaagu

SEQ ID NO: 23842 - RNA, 21 nt, Artificial Sequence
  Marburg virus siRNA sense strand
cucgcccaugucaaaaaaguc

SEQ ID NO: 23843 - RNA, 21 nt, Artificial Sequence
  Marburg virus siRNA sense strand
ucgcccaugucaaaaaagucu

SEQ ID NO: 23844 - RNA, 21 nt, Artificial Sequence
  Marburg virus siRNA sense strand
cgcccaugucaaaaaagucuu

SEQ ID NO: 23845 - RNA, 21 nt, Artificial Sequence
  Marburg virus siRNA sense strand
gcccaugucaaaaaagucuuc

SEQ ID NO: 23846 - RNA, 21 nt, Artificial Sequence
  Marburg virus siRNA sense strand
cccaugucaaaaaagucuucg

SEQ ID NO: 23847 - RNA, 21 nt, Artificial Sequence
  Marburg virus siRNA sense strand
ccaugucaaaaaagucuucgg

SEQ ID NO: 23848 - RNA, 21 nt, Artificial Sequence
  Marburg virus siRNA sense strand
caugucaaaaaagucuucggg

SEQ ID NO: 23849 - RNA, 21 nt, Artificial Sequence
  Marburg virus siRNA sense strand
augucaaaaaagucuucgggc

SEQ ID NO: 23850 - RNA, 21 nt, Artificial Sequence
  Marburg virus siRNA sense strand
ugucaaaaaagucuucgggcu

SEQ ID NO: 23851 - RNA, 21 nt, Artificial Sequence
  Marburg virus siRNA sense strand
gucaaaaaagucuucgggcug

SEQ ID NO: 23852 - RNA, 21 nt, Artificial Sequence
  Marburg virus siRNA sense strand
ucaaaaaagucuucgggcugu

SEQ ID NO: 23853 - RNA, 21 nt, Artificial Sequence
  Marburg virus siRNA sense strand
caaaaaagucuucgggcuguu

SEQ ID NO: 23854 - RNA, 21 nt, Artificial Sequence
  Marburg virus siRNA sense strand
aaaaaagucuucgggcuguuc

SEQ ID NO: 23855 - RNA, 21 nt, Artificial Sequence
  Marburg virus siRNA sense strand
aaaaagucuucgggcuguucc

SEQ ID NO: 23856 - RNA, 21 nt, Artificial Sequence
  Marburg virus siRNA sense strand
aaaagucuucgggcuguuccu

SEQ ID NO: 23857 - RNA, 21 nt, Artificial Sequence
  Marburg virus siRNA sense strand
aaagucuucgggcuguuccuc

SEQ ID NO: 23858 - RNA, 21 nt, Artificial Sequence
  Marburg virus siRNA sense strand
aagucuucgggcuguuccucc

SEQ ID NO: 23859 - RNA, 21 nt, Artificial Sequence
  Marburg virus siRNA sense strand
agucuucgggcuguuccuccc

SEQ ID NO: 23860 - RNA, 21 nt, Artificial Sequence
  Marburg virus siRNA sense strand
gucuucgggcuguuccuccca

SEQ ID NO: 23861 - RNA, 21 nt, Artificial Sequence
  Marburg virus siRNA sense strand
ucuucgggcuguuccucccaa

SEQ ID NO: 23862 - RNA, 21 nt, Artificial Sequence
  Marburg virus siRNA sense strand
cuucgggcuguuccucccaac

SEQ ID NO: 23863 - RNA, 21 nt, Artificial Sequence
  Marburg virus siRNA sense strand
uucgggcuguuccucccaacc

SEQ ID NO: 23864 - RNA, 21 nt, Artificial Sequence
  Marburg virus siRNA sense strand
ucgggcuguuccucccaaccc

SEQ ID NO: 23865 - RNA, 21 nt, Artificial Sequence
  Marburg virus siRNA sense strand
cgggcuguuccucccaaccca

SEQ ID NO: 23866 - RNA, 21 nt, Artificial Sequence
  Marburg virus siRNA sense strand
gggcuguuccucccaacccaa

SEQ ID NO: 23867 - RNA, 21 nt, Artificial Sequence
  Marburg virus siRNA sense strand
ggcuguuccucccaacccaac

SEQ ID NO: 23868 - RNA, 21 nt, Artificial Sequence
  Marburg virus siRNA sense strand
gcuguuccucccaacccaaca

SEQ ID NO: 23869 - RNA, 21 nt, Artificial Sequence
  Marburg virus siRNA sense strand
cuguuccucccaacccaacaa

SEQ ID NO: 23870 - RNA, 21 nt, Artificial Sequence
  Marburg virus siRNA sense strand
uguuccucccaacccaacaau

SEQ ID NO: 23871 - RNA, 21 nt, Artificial Sequence
  Marburg virus siRNA sense strand
guuccucccaacccaacaauu

SEQ ID NO: 23872 - RNA, 21 nt, Artificial Sequence
  Marburg virus siRNA sense strand
uuccucccaacccaacaauug

SEQ ID NO: 23873 - RNA, 21 nt, Artificial Sequence
  Marburg virus siRNA sense strand
uccucccaacccaacaauuga

SEQ ID NO: 23874 - RNA, 21 nt, Artificial Sequence
  Marburg virus siRNA sense strand
ccucccaacccaacaauugac

SEQ ID NO: 23875 - RNA, 21 nt, Artificial Sequence
  Marburg virus siRNA sense strand
cucccaacccaacaauugaca

SEQ ID NO: 23876 - RNA, 21 nt, Artificial Sequence
  Marburg virus siRNA sense strand
ucccaacccaacaauugacaa

SEQ ID NO: 23877 - RNA, 21 nt, Artificial Sequence
  Marburg virus siRNA sense strand
cccaacccaacaauugacaaa

SEQ ID NO: 23878 - RNA, 21 nt, Artificial Sequence
  Marburg virus siRNA sense strand
ccaacccaacaauugacaaag

SEQ ID NO: 23879 - RNA, 21 nt, Artificial Sequence
  Marburg virus siRNA sense strand
caacccaacaauugacaaagg

SEQ ID NO: 23880 - RNA, 21 nt, Artificial Sequence
  Marburg virus siRNA sense strand
aacccaacaauugacaaagga

SEQ ID NO: 23881 - RNA, 21 nt, Artificial Sequence
  Marburg virus siRNA sense strand
acccaacaauugacaaaggau

SEQ ID NO: 23882 - RNA, 21 nt, Artificial Sequence
  Marburg virus siRNA sense strand
cccaacaauugacaaaggaug

SEQ ID NO: 23883 - RNA, 21 nt, Artificial Sequence
  Marburg virus siRNA sense strand
ccaacaauugacaaaggaugg

SEQ ID NO: 23884 - RNA, 21 nt, Artificial Sequence
  Marburg virus siRNA sense strand
caacaauugacaaaggauggg

SEQ ID NO: 23885 - RNA, 21 nt, Artificial Sequence
  Marburg virus siRNA sense strand
aacaauugacaaaggaugggu

SEQ ID NO: 23886 - RNA, 21 nt, Artificial Sequence
  Marburg virus siRNA sense strand
acaauugacaaaggauggguc

SEQ ID NO: 23887 - RNA, 21 nt, Artificial Sequence
  Marburg virus siRNA sense strand
caauugacaaaggaugggucu

SEQ ID NO: 23888 - RNA, 21 nt, Artificial Sequence
  Marburg virus siRNA sense strand
aauugacaaaggaugggucug

SEQ ID NO: 23889 - RNA, 21 nt, Artificial Sequence
  Marburg virus siRNA sense strand
auugacaaaggaugggucugu

SEQ ID NO: 23890 - RNA, 21 nt, Artificial Sequence
  Marburg virus siRNA sense strand
uugacaaaggaugggucugug

SEQ ID NO: 23891 - RNA, 21 nt, Artificial Sequence
  Marburg virus siRNA sense strand
ugacaaaggaugggucugugu

SEQ ID NO: 23892 - RNA, 21 nt, Artificial Sequence
  Marburg virus siRNA sense strand
gacaaaggaugggucuguguu

SEQ ID NO: 23893 - RNA, 21 nt, Artificial Sequence
  Marburg virus siRNA sense strand
acaaaggaugggucuguguuu

SEQ ID NO: 23894 - RNA, 21 nt, Artificial Sequence
  Marburg virus siRNA sense strand
caaaggaugggucuguguuua

SEQ ID NO: 23895 - RNA, 21 nt, Artificial Sequence
  Marburg virus siRNA sense strand
aaaggaugggucuguguuuau

SEQ ID NO: 23896 - RNA, 21 nt, Artificial Sequence
  Marburg virus siRNA sense strand
aaggaugggucuguguuuauu

SEQ ID NO: 23897 - RNA, 21 nt, Artificial Sequence
  Marburg virus siRNA sense strand
aggaugggucuguguuuauuc

SEQ ID NO: 23898 - RNA, 21 nt, Artificial Sequence
  Marburg virus siRNA sense strand
ggaugggucuguguuuauuca

SEQ ID NO: 23899 - RNA, 21 nt, Artificial Sequence
  Marburg virus siRNA sense strand
gaugggucuguguuuauucau

SEQ ID NO: 23900 - RNA, 21 nt, Artificial Sequence
  Marburg virus siRNA sense strand
augggucuguguuuauucauc

SEQ ID NO: 23901 - RNA, 21 nt, Artificial Sequence
  Marburg virus siRNA sense strand
ugggucuguguuuauucaucu

SEQ ID NO: 23902 - RNA, 21 nt, Artificial Sequence
  Marburg virus siRNA sense strand
gggucuguguuuauucaucug

SEQ ID NO: 23903 - RNA, 21 nt, Artificial Sequence
  Marburg virus siRNA sense strand
ggucuguguuuauucaucuga

SEQ ID NO: 23904 - RNA, 21 nt, Artificial Sequence
  Marburg virus siRNA sense strand
gucuguguuuauucaucugag

SEQ ID NO: 23905 - RNA, 21 nt, Artificial Sequence
  Marburg virus siRNA sense strand
ucuguguuuauucaucugagc

SEQ ID NO: 23906 - RNA, 21 nt, Artificial Sequence
  Marburg virus siRNA sense strand
cuguguuuauucaucugagca

SEQ ID NO: 23907 - RNA, 21 nt, Artificial Sequence
  Marburg virus siRNA sense strand
uguguuuauucaucugagcaa

SEQ ID NO: 23908 - RNA, 21 nt, Artificial Sequence
  Marburg virus siRNA sense strand
guguuuauucaucugagcaag

SEQ ID NO: 23909 - RNA, 21 nt, Artificial Sequence
  Marburg virus siRNA sense strand
uguuuauucaucugagcaagg

SEQ ID NO: 23910 - RNA, 21 nt, Artificial Sequence
  Marburg virus siRNA sense strand
guuuauucaucugagcaaggu

SEQ ID NO: 23911 - RNA, 21 nt, Artificial Sequence
  Marburg virus siRNA sense strand
uuuauucaucugagcaaggug

SEQ ID NO: 23912 - RNA, 21 nt, Artificial Sequence
  Marburg virus siRNA sense strand
uuauucaucugagcaagguga

SEQ ID NO: 23913 - RNA, 21 nt, Artificial Sequence
  Marburg virus siRNA sense strand
uauucaucugagcaaggugag

SEQ ID NO: 23914 - RNA, 21 nt, Artificial Sequence
  Marburg virus siRNA sense strand
auucaucugagcaaggugaga

SEQ ID NO: 23915 - RNA, 21 nt, Artificial Sequence
  Marburg virus siRNA sense strand
uucaucugagcaaggugagac

SEQ ID NO: 23916 - RNA, 21 nt, Artificial Sequence
  Marburg virus siRNA sense strand
ucaucugagcaaggugagaca

SEQ ID NO: 23917 - RNA, 21 nt, Artificial Sequence
  Marburg virus siRNA sense strand
caucugagcaaggugagacac

SEQ ID NO: 23918 - RNA, 21 nt, Artificial Sequence
  Marburg virus siRNA sense strand
aucugagcaaggugagacacg

SEQ ID NO: 23919 - RNA, 21 nt, Artificial Sequence
  Marburg virus siRNA sense strand
ucugagcaaggugagacacgg

SEQ ID NO: 23920 - RNA, 21 nt, Artificial Sequence
  Marburg virus siRNA sense strand
cugagcaaggugagacacggg

SEQ ID NO: 23921 - RNA, 21 nt, Artificial Sequence
  Marburg virus siRNA sense strand
ugagcaaggugagacacgggc

SEQ ID NO: 23922 - RNA, 21 nt, Artificial Sequence
  Marburg virus siRNA sense strand
gagcaaggugagacacgggcc

SEQ ID NO: 23923 - RNA, 21 nt, Artificial Sequence
  Marburg virus siRNA sense strand
agcaaggugagacacgggccc

SEQ ID NO: 23924 - RNA, 21 nt, Artificial Sequence
  Marburg virus siRNA sense strand
gcaaggugagacacgggcccu

SEQ ID NO: 23925 - RNA, 21 nt, Artificial Sequence
  Marburg virus siRNA sense strand
caaggugagacacgggcccug

SEQ ID NO: 23926 - RNA, 21 nt, Artificial Sequence
  Marburg virus siRNA sense strand
aaggugagacacgggcccuga

SEQ ID NO: 23927 - RNA, 21 nt, Artificial Sequence
  Marburg virus siRNA sense strand
aggugagacacgggcccugaa

SEQ ID NO: 23928 - RNA, 21 nt, Artificial Sequence
  Marburg virus siRNA sense strand
ggugagacacgggcccugaaa

SEQ ID NO: 23929 - RNA, 21 nt, Artificial Sequence
  Marburg virus siRNA sense strand
gugagacacgggcccugaaaa

SEQ ID NO: 23930 - RNA, 21 nt, Artificial Sequence
  Marburg virus siRNA sense strand
ugagacacgggcccugaaaau

SEQ ID NO: 23931 - RNA, 21 nt, Artificial Sequence
  Marburg virus siRNA sense strand
gagacacgggcccugaaaauc

SEQ ID NO: 23932 - RNA, 21 nt, Artificial Sequence
  Marburg virus siRNA sense strand
agacacgggcccugaaaaucu

SEQ ID NO: 23933 - RNA, 21 nt, Artificial Sequence
  Marburg virus siRNA sense strand
gacacgggcccugaaaaucua

SEQ ID NO: 23934 - RNA, 21 nt, Artificial Sequence
  Marburg virus siRNA sense strand
acacgggcccugaaaaucuaa

SEQ ID NO: 23935 - RNA, 21 nt, Artificial Sequence
  Marburg virus siRNA sense strand
cacgggcccugaaaaucuaau

SEQ ID NO: 23936 - RNA, 21 nt, Artificial Sequence
  Marburg virus siRNA sense strand
acgggcccugaaaaucuaauu

SEQ ID NO: 23937 - RNA, 21 nt, Artificial Sequence
  Marburg virus siRNA sense strand
cgggcccugaaaaucuaauuc

SEQ ID NO: 23938 - RNA, 21 nt, Artificial Sequence
  Marburg virus siRNA sense strand
gggcccugaaaaucuaauucu

SEQ ID NO: 23939 - RNA, 21 nt, Artificial Sequence
  Marburg virus siRNA sense strand
ggcccugaaaaucuaauucuc

SEQ ID NO: 23940 - RNA, 21 nt, Artificial Sequence
  Marburg virus siRNA sense strand
gcccugaaaaucuaauucuca

SEQ ID NO: 23941 - RNA, 21 nt, Artificial Sequence
  Marburg virus siRNA sense strand
cccugaaaaucuaauucucau

SEQ ID NO: 23942 - RNA, 21 nt, Artificial Sequence
  Marburg virus siRNA sense strand
ccugaaaaucuaauucucauu

SEQ ID NO: 23943 - RNA, 21 nt, Artificial Sequence
  Marburg virus siRNA sense strand
cugaaaaucuaauucucauug

SEQ ID NO: 23944 - RNA, 21 nt, Artificial Sequence
  Marburg virus siRNA sense strand
ugaaaaucuaauucucauugu

SEQ ID NO: 23945 - RNA, 21 nt, Artificial Sequence
  Marburg virus siRNA sense strand
gaaaaucuaauucucauuguu

SEQ ID NO: 23946 - RNA, 21 nt, Artificial Sequence
  Marburg virus siRNA sense strand
aaaaucuaauucucauuguua

SEQ ID NO: 23947 - RNA, 21 nt, Artificial Sequence
  Marburg virus siRNA sense strand
aaaucuaauucucauuguuaa

SEQ ID NO: 23948 - RNA, 21 nt, Artificial Sequence
  Marburg virus siRNA sense strand
aaucuaauucucauuguuaac

SEQ ID NO: 23949 - RNA, 21 nt, Artificial Sequence
  Marburg virus siRNA sense strand
aucuaauucucauuguuaaca

SEQ ID NO: 23950 - RNA, 21 nt, Artificial Sequence
  Marburg virus siRNA sense strand
ucuaauucucauuguuaacag

SEQ ID NO: 23951 - RNA, 21 nt, Artificial Sequence
  Marburg virus siRNA sense strand
cuaauucucauuguuaacagu

SEQ ID NO: 23952 - RNA, 21 nt, Artificial Sequence
  Marburg virus siRNA sense strand
uaauucucauuguuaacaguu

SEQ ID NO: 23953 - RNA, 21 nt, Artificial Sequence
  Marburg virus siRNA sense strand
aauucucauuguuaacaguug

SEQ ID NO: 23954 - RNA, 21 nt, Artificial Sequence
  Marburg virus siRNA sense strand
auucucauuguuaacaguugc

SEQ ID NO: 23955 - RNA, 21 nt, Artificial Sequence
  Marburg virus siRNA sense strand
uucucauuguuaacaguugca

SEQ ID NO: 23956 - RNA, 21 nt, Artificial Sequence
  Marburg virus siRNA sense strand
ucucauuguuaacaguugcag

SEQ ID NO: 23957 - RNA, 21 nt, Artificial Sequence
  Marburg virus siRNA sense strand
cucauuguuaacaguugcagg

SEQ ID NO: 23958 - RNA, 21 nt, Artificial Sequence
  Marburg virus siRNA sense strand
ucauuguuaacaguugcaggg

SEQ ID NO: 23959 - RNA, 21 nt, Artificial Sequence
  Marburg virus siRNA sense strand
cauuguuaacaguugcagggg

SEQ ID NO: 23960 - RNA, 21 nt, Artificial Sequence
  Marburg virus siRNA sense strand
auuguuaacaguugcaggggg

SEQ ID NO: 23961 - RNA, 21 nt, Artificial Sequence
  Marburg virus siRNA sense strand
uuguuaacaguugcaggggga

SEQ ID NO: 23962 - RNA, 21 nt, Artificial Sequence
  Marburg virus siRNA sense strand
uguuaacaguugcagggggag

SEQ ID NO: 23963 - RNA, 21 nt, Artificial Sequence
  Marburg virus siRNA sense strand
guuaacaguugcagggggagu

SEQ ID NO: 23964 - RNA, 21 nt, Artificial Sequence
  Marburg virus siRNA sense strand
uuaacaguugcagggggagug

SEQ ID NO: 23965 - RNA, 21 nt, Artificial Sequence
  Marburg virus siRNA sense strand
uaacaguugcagggggaguga

SEQ ID NO: 23966 - RNA, 21 nt, Artificial Sequence
  Marburg virus siRNA sense strand
aacaguugcagggggagugau

SEQ ID NO: 23967 - RNA, 21 nt, Artificial Sequence
  Marburg virus siRNA sense strand
acaguugcagggggagugauc

SEQ ID NO: 23968 - RNA, 21 nt, Artificial Sequence
  Marburg virus siRNA sense strand
caguugcagggggagugaucu

SEQ ID NO: 23969 - RNA, 21 nt, Artificial Sequence
  Marburg virus siRNA sense strand
aguugcagggggagugaucuu

SEQ ID NO: 23970 - RNA, 21 nt, Artificial Sequence
  Marburg virus siRNA sense strand
guugcagggggagugaucuuu

SEQ ID NO: 23971 - RNA, 21 nt, Artificial Sequence
  Marburg virus siRNA sense strand
uugcagggggagugaucuuuc

SEQ ID NO: 23972 - RNA, 21 nt, Artificial Sequence
  Marburg virus siRNA sense strand
ugcagggggagugaucuuucc

SEQ ID NO: 23973 - RNA, 21 nt, Artificial Sequence
  Marburg virus siRNA sense strand
gcagggggagugaucuuuccg

SEQ ID NO: 23974 - RNA, 21 nt, Artificial Sequence
  Marburg virus siRNA sense strand
cagggggagugaucuuuccga

SEQ ID NO: 23975 - RNA, 21 nt, Artificial Sequence
  Marburg virus siRNA sense strand
agggggagugaucuuuccgag

SEQ ID NO: 23976 - RNA, 21 nt, Artificial Sequence
  Marburg virus siRNA sense strand
gggggagugaucuuuccgagu

SEQ ID NO: 23977 - RNA, 21 nt, Artificial Sequence
  Marburg virus siRNA sense strand
ggggagugaucuuuccgaguu

SEQ ID NO: 23978 - RNA, 21 nt, Artificial Sequence
  Marburg virus siRNA sense strand
gggagugaucuuuccgaguug

SEQ ID NO: 23979 - RNA, 21 nt, Artificial Sequence
  Marburg virus siRNA sense strand
ggagugaucuuuccgaguuga

SEQ ID NO: 23980 - RNA, 21 nt, Artificial Sequence
  Marburg virus siRNA sense strand
gagugaucuuuccgaguugau

SEQ ID NO: 23981 - RNA, 21 nt, Artificial Sequence
  Marburg virus siRNA sense strand
agugaucuuuccgaguugaua

SEQ ID NO: 23982 - RNA, 21 nt, Artificial Sequence
  Marburg virus siRNA sense strand
gugaucuuuccgaguugauac

SEQ ID NO: 23983 - RNA, 21 nt, Artificial Sequence
  Marburg virus siRNA sense strand
ugaucuuuccgaguugauaca

SEQ ID NO: 23984 - RNA, 21 nt, Artificial Sequence
  Marburg virus siRNA sense strand
gaucuuuccgaguugauacaa

SEQ ID NO: 23985 - RNA, 21 nt, Artificial Sequence
  Marburg virus siRNA sense strand
aucuuuccgaguugauacaaa

SEQ ID NO: 23986 - RNA, 21 nt, Artificial Sequence
  Marburg virus siRNA sense strand
ucuuuccgaguugauacaaag

SEQ ID NO: 23987 - RNA, 21 nt, Artificial Sequence
  Marburg virus siRNA sense strand
cuuuccgaguugauacaaaga

SEQ ID NO: 23988 - RNA, 21 nt, Artificial Sequence
  Marburg virus siRNA sense strand
uuuccgaguugauacaaagac

SEQ ID NO: 23989 - RNA, 21 nt, Artificial Sequence
  Marburg virus siRNA sense strand
uuccgaguugauacaaagaca

SEQ ID NO: 23990 - RNA, 21 nt, Artificial Sequence
  Marburg virus siRNA sense strand
uccgaguugauacaaagacac

SEQ ID NO: 23991 - RNA, 21 nt, Artificial Sequence
  Marburg virus siRNA sense strand
ccgaguugauacaaagacacu

SEQ ID NO: 23992 - RNA, 21 nt, Artificial Sequence
  Marburg virus siRNA sense strand
cgaguugauacaaagacacua

SEQ ID NO: 23993 - RNA, 21 nt, Artificial Sequence
  Marburg virus siRNA sense strand
gaguugauacaaagacacuaa

SEQ ID NO: 23994 - RNA, 21 nt, Artificial Sequence
  Marburg virus siRNA sense strand
aguugauacaaagacacuaaa

SEQ ID NO: 23995 - RNA, 21 nt, Artificial Sequence
  Marburg virus siRNA sense strand
guugauacaaagacacuaaac

SEQ ID NO: 23996 - RNA, 21 nt, Artificial Sequence
  Marburg virus siRNA sense strand
uugauacaaagacacuaaaca

SEQ ID NO: 23997 - RNA, 21 nt, Artificial Sequence
  Marburg virus siRNA sense strand
ugauacaaagacacuaaacau

SEQ ID NO: 23998 - RNA, 21 nt, Artificial Sequence
  Marburg virus siRNA sense strand
gauacaaagacacuaaacauu

SEQ ID NO: 23999 - RNA, 21 nt, Artificial Sequence
  Marburg virus siRNA sense strand
auacaaagacacuaaacauuu

SEQ ID NO: 24000 - RNA, 21 nt, Artificial Sequence
  Marburg virus siRNA sense strand
uacaaagacacuaaacauuuc

SEQ ID NO: 24001 - RNA, 21 nt, Artificial Sequence
  Marburg virus siRNA sense strand
acaaagacacuaaacauuuca

SEQ ID NO: 24002 - RNA, 21 nt, Artificial Sequence
  Marburg virus siRNA sense strand
caaagacacuaaacauuucaa

SEQ ID NO: 24003 - RNA, 21 nt, Artificial Sequence
  Marburg virus siRNA sense strand
aaagacacuaaacauuucaaa

SEQ ID NO: 24004 - RNA, 21 nt, Artificial Sequence
  Marburg virus siRNA sense strand
aagacacuaaacauuucaaaa

SEQ ID NO: 24005 - RNA, 21 nt, Artificial Sequence
  Marburg virus siRNA sense strand
agacacuaaacauuucaaaag

SEQ ID NO: 24006 - RNA, 21 nt, Artificial Sequence
  Marburg virus siRNA sense strand
gacacuaaacauuucaaaagc

SEQ ID NO: 24007 - RNA, 21 nt, Artificial Sequence
  Marburg virus siRNA sense strand
acacuaaacauuucaaaagca

SEQ ID NO: 24008 - RNA, 21 nt, Artificial Sequence
  Marburg virus siRNA sense strand
cacuaaacauuucaaaagcau

SEQ ID NO: 24009 - RNA, 21 nt, Artificial Sequence
  Marburg virus siRNA sense strand
acuaaacauuucaaaagcaua

SEQ ID NO: 24010 - RNA, 21 nt, Artificial Sequence
  Marburg virus siRNA sense strand
cuaaacauuucaaaagcauau

SEQ ID NO: 24011 - RNA, 21 nt, Artificial Sequence
  Marburg virus siRNA sense strand
uaaacauuucaaaagcauaua

SEQ ID NO: 24012 - RNA, 21 nt, Artificial Sequence
  Marburg virus siRNA sense strand
aaacauuucaaaagcauauau

SEQ ID NO: 24013 - RNA, 21 nt, Artificial Sequence
  Marburg virus siRNA sense strand
aacauuucaaaagcauauaug

SEQ ID NO: 24014 - RNA, 21 nt, Artificial Sequence
  Marburg virus siRNA sense strand
acauuucaaaagcauauaugu

SEQ ID NO: 24015 - RNA, 21 nt, Artificial Sequence
  Marburg virus siRNA sense strand
cauuucaaaagcauauaugug

SEQ ID NO: 24016 - RNA, 21 nt, Artificial Sequence
  Marburg virus siRNA sense strand
auuucaaaagcauauaugugg

SEQ ID NO: 24017 - RNA, 21 nt, Artificial Sequence
  Marburg virus siRNA sense strand
uuucaaaagcauauauguggg

SEQ ID NO: 24018 - RNA, 21 nt, Artificial Sequence
  Marburg virus siRNA sense strand
uucaaaagcauauaugugggc

SEQ ID NO: 24019 - RNA, 21 nt, Artificial Sequence
  Marburg virus siRNA sense strand
ucaaaagcauauaugugggca

SEQ ID NO: 24020 - RNA, 21 nt, Artificial Sequence
  Marburg virus siRNA sense strand
caaaagcauauaugugggcaa

SEQ ID NO: 24021 - RNA, 21 nt, Artificial Sequence
  Marburg virus siRNA sense strand
aaaagcauauaugugggcaaa

SEQ ID NO: 24022 - RNA, 21 nt, Artificial Sequence
  Marburg virus siRNA sense strand
aaagcauauaugugggcaaaa

SEQ ID NO: 24023 - RNA, 21 nt, Artificial Sequence
  Marburg virus siRNA sense strand
aagcauauaugugggcaaaac

SEQ ID NO: 24024 - RNA, 21 nt, Artificial Sequence
  Marburg virus siRNA sense strand
agcauauaugugggcaaaacg

SEQ ID NO: 24025 - RNA, 21 nt, Artificial Sequence
  Marburg virus siRNA sense strand
gcauauaugugggcaaaacgu

SEQ ID NO: 24026 - RNA, 21 nt, Artificial Sequence
  Marburg virus siRNA sense strand
cauauaugugggcaaaacgug

SEQ ID NO: 24027 - RNA, 21 nt, Artificial Sequence
  Marburg virus siRNA sense strand
auauaugugggcaaaacguga

SEQ ID NO: 24028 - RNA, 21 nt, Artificial Sequence
  Marburg virus siRNA sense strand
uauaugugggcaaaacgugac

SEQ ID NO: 24029 - RNA, 21 nt, Artificial Sequence
  Marburg virus siRNA sense strand
auaugugggcaaaacgugacu

SEQ ID NO: 24030 - RNA, 21 nt, Artificial Sequence
  Marburg virus siRNA sense strand
uaugugggcaaaacgugacua

SEQ ID NO: 24031 - RNA, 21 nt, Artificial Sequence
  Marburg virus siRNA sense strand
augugggcaaaacgugacuag

SEQ ID NO: 24032 - RNA, 21 nt, Artificial Sequence
  Marburg virus siRNA sense strand
ugugggcaaaacgugacuaga

SEQ ID NO: 24033 - RNA, 21 nt, Artificial Sequence
  Marburg virus siRNA sense strand
gugggcaaaacgugacuagac

SEQ ID NO: 24034 - RNA, 21 nt, Artificial Sequence
  Marburg virus siRNA sense strand
ugggcaaaacgugacuagacc

SEQ ID NO: 24035 - RNA, 21 nt, Artificial Sequence
  Marburg virus siRNA sense strand
gggcaaaacgugacuagacca

SEQ ID NO: 24036 - RNA, 21 nt, Artificial Sequence
  Marburg virus siRNA sense strand
ggcaaaacgugacuagaccau

SEQ ID NO: 24037 - RNA, 21 nt, Artificial Sequence
  Marburg virus siRNA sense strand
gcaaaacgugacuagaccauc

SEQ ID NO: 24038 - RNA, 21 nt, Artificial Sequence
  Marburg virus siRNA sense strand
caaaacgugacuagaccaucu

SEQ ID NO: 24039 - RNA, 21 nt, Artificial Sequence
  Marburg virus siRNA sense strand
aaaacgugacuagaccaucuu

SEQ ID NO: 24040 - RNA, 21 nt, Artificial Sequence
  Marburg virus siRNA sense strand
aaacgugacuagaccaucuua

SEQ ID NO: 24041 - RNA, 21 nt, Artificial Sequence
  Marburg virus siRNA sense strand
aacgugacuagaccaucuuaa

SEQ ID NO: 24042 - RNA, 21 nt, Artificial Sequence
  Marburg virus siRNA sense strand
acgugacuagaccaucuuaau

SEQ ID NO: 24043 - RNA, 21 nt, Artificial Sequence
  Marburg virus siRNA sense strand
cgugacuagaccaucuuaaua

SEQ ID NO: 24044 - RNA, 21 nt, Artificial Sequence
  Marburg virus siRNA sense strand
gugacuagaccaucuuaauag

SEQ ID NO: 24045 - RNA, 21 nt, Artificial Sequence
  Marburg virus siRNA sense strand
ugacuagaccaucuuaauaga

SEQ ID NO: 24046 - RNA, 21 nt, Artificial Sequence
  Marburg virus siRNA sense strand
gacuagaccaucuuaauagaa

SEQ ID NO: 24047 - RNA, 21 nt, Artificial Sequence
  Marburg virus siRNA sense strand
acuagaccaucuuaauagaag

SEQ ID NO: 24048 - RNA, 21 nt, Artificial Sequence
  Marburg virus siRNA sense strand
cuagaccaucuuaauagaagu

SEQ ID NO: 24049 - RNA, 21 nt, Artificial Sequence
  Marburg virus siRNA sense strand
uagaccaucuuaauagaagua

SEQ ID NO: 24050 - RNA, 21 nt, Artificial Sequence
  Marburg virus siRNA sense strand
agaccaucuuaauagaaguag

SEQ ID NO: 24051 - RNA, 21 nt, Artificial Sequence
  Marburg virus siRNA sense strand
gaccaucuuaauagaaguagu

SEQ ID NO: 24052 - RNA, 21 nt, Artificial Sequence
  Marburg virus siRNA sense strand
accaucuuaauagaaguagua

SEQ ID NO: 24053 - RNA, 21 nt, Artificial Sequence
  Marburg virus siRNA sense strand
ccaucuuaauagaaguaguaa

SEQ ID NO: 24054 - RNA, 21 nt, Artificial Sequence
  Marburg virus siRNA sense strand
caucuuaauagaaguaguaau

SEQ ID NO: 24055 - RNA, 21 nt, Artificial Sequence
  Marburg virus siRNA sense strand
aucuuaauagaaguaguaauu

SEQ ID NO: 24056 - RNA, 21 nt, Artificial Sequence
  Marburg virus siRNA sense strand
ucuuaauagaaguaguaauuu

SEQ ID NO: 24057 - RNA, 21 nt, Artificial Sequence
  Marburg virus siRNA sense strand
cuuaauagaaguaguaauuua

SEQ ID NO: 24058 - RNA, 21 nt, Artificial Sequence
  Marburg virus siRNA sense strand
uuaauagaaguaguaauuuau

SEQ ID NO: 24059 - RNA, 21 nt, Artificial Sequence
  Marburg virus siRNA sense strand
uaauagaaguaguaauuuauu

SEQ ID NO: 24060 - RNA, 21 nt, Artificial Sequence
  Marburg virus siRNA sense strand
aauagaaguaguaauuuauuu

SEQ ID NO: 24061 - RNA, 21 nt, Artificial Sequence
  Marburg virus siRNA sense strand
auagaaguaguaauuuauuuc

SEQ ID NO: 24062 - RNA, 21 nt, Artificial Sequence
  Marburg virus siRNA sense strand
uagaaguaguaauuuauuucu

SEQ ID NO: 24063 - RNA, 21 nt, Artificial Sequence
  Marburg virus siRNA sense strand
agaaguaguaauuuauuucug

SEQ ID NO: 24064 - RNA, 21 nt, Artificial Sequence
  Marburg virus siRNA sense strand
gaaguaguaauuuauuucugu

SEQ ID NO: 24065 - RNA, 21 nt, Artificial Sequence
  Marburg virus siRNA sense strand
aaguaguaauuuauuucuguc

SEQ ID NO: 24066 - RNA, 21 nt, Artificial Sequence
  Marburg virus siRNA sense strand
aguaguaauuuauuucugucu

SEQ ID NO: 24067 - RNA, 21 nt, Artificial Sequence
  Marburg virus siRNA sense strand
guaguaauuuauuucugucuu

SEQ ID NO: 24068 - RNA, 21 nt, Artificial Sequence
  Marburg virus siRNA sense strand
uaguaauuuauuucugucuua

SEQ ID NO: 24069 - RNA, 21 nt, Artificial Sequence
  Marburg virus siRNA sense strand
aguaauuuauuucugucuuaa

SEQ ID NO: 24070 - RNA, 21 nt, Artificial Sequence
  Marburg virus siRNA sense strand
guaauuuauuucugucuuaag

SEQ ID NO: 24071 - RNA, 21 nt, Artificial Sequence
  Marburg virus siRNA sense strand
uaauuuauuucugucuuaagu

SEQ ID NO: 24072 - RNA, 21 nt, Artificial Sequence
  Marburg virus siRNA sense strand
aauuuauuucugucuuaagug

SEQ ID NO: 24073 - RNA, 21 nt, Artificial Sequence
  Marburg virus siRNA sense strand
auuuauuucugucuuaagugu

SEQ ID NO: 24074 - RNA, 21 nt, Artificial Sequence
  Marburg virus siRNA sense strand
uuuauuucugucuuaagugug

SEQ ID NO: 24075 - RNA, 21 nt, Artificial Sequence
  Marburg virus siRNA sense strand
uuauuucugucuuaaguguga

SEQ ID NO: 24076 - RNA, 21 nt, Artificial Sequence
  Marburg virus siRNA sense strand
uauuucugucuuaagugugau

SEQ ID NO: 24077 - RNA, 21 nt, Artificial Sequence
  Marburg virus siRNA sense strand
auuucugucuuaagugugauu

SEQ ID NO: 24078 - RNA, 21 nt, Artificial Sequence
  Marburg virus siRNA sense strand
uuucugucuuaagugugauuu

SEQ ID NO: 24079 - RNA, 21 nt, Artificial Sequence
  Marburg virus siRNA sense strand
uucugucuuaagugugauuuu

SEQ ID NO: 24080 - RNA, 21 nt, Artificial Sequence
  Marburg virus siRNA sense strand
ucugucuuaagugugauuuuc

SEQ ID NO: 24081 - RNA, 21 nt, Artificial Sequence
  Marburg virus siRNA sense strand
cugucuuaagugugauuuuca

SEQ ID NO: 24082 - RNA, 21 nt, Artificial Sequence
  Marburg virus siRNA sense strand
ugucuuaagugugauuuucac

SEQ ID NO: 24083 - RNA, 21 nt, Artificial Sequence
  Marburg virus siRNA sense strand
gucuuaagugugauuuucacc

SEQ ID NO: 24084 - RNA, 21 nt, Artificial Sequence
  Marburg virus siRNA sense strand
ucuuaagugugauuuucaccu

SEQ ID NO: 24085 - RNA, 21 nt, Artificial Sequence
  Marburg virus siRNA sense strand
cuuaagugugauuuucaccuu

SEQ ID NO: 24086 - RNA, 21 nt, Artificial Sequence
  Marburg virus siRNA sense strand
uuaagugugauuuucaccuug

SEQ ID NO: 24087 - RNA, 21 nt, Artificial Sequence
  Marburg virus siRNA sense strand
uaagugugauuuucaccuuga

SEQ ID NO: 24088 - RNA, 21 nt, Artificial Sequence
  Marburg virus siRNA sense strand
aagugugauuuucaccuugaa

SEQ ID NO: 24089 - RNA, 21 nt, Artificial Sequence
  Marburg virus siRNA sense strand
agugugauuuucaccuugaaa

SEQ ID NO: 24090 - RNA, 21 nt, Artificial Sequence
  Marburg virus siRNA sense strand
gugugauuuucaccuugaaag

SEQ ID NO: 24091 - RNA, 21 nt, Artificial Sequence
  Marburg virus siRNA sense strand
ugugauuuucaccuugaaaga

SEQ ID NO: 24092 - RNA, 21 nt, Artificial Sequence
  Marburg virus siRNA sense strand
gugauuuucaccuugaaagag

SEQ ID NO: 24093 - RNA, 21 nt, Artificial Sequence
  Marburg virus siRNA sense strand
ugauuuucaccuugaaagagu

SEQ ID NO: 24094 - RNA, 21 nt, Artificial Sequence
  Marburg virus siRNA sense strand
gauuuucaccuugaaagaguu

SEQ ID NO: 24095 - RNA, 21 nt, Artificial Sequence
  Marburg virus siRNA sense strand
auuuucaccuugaaagaguua

SEQ ID NO: 24096 - RNA, 21 nt, Artificial Sequence
  Marburg virus siRNA sense strand
uuuucaccuugaaagaguuaa

SEQ ID NO: 24097 - RNA, 21 nt, Artificial Sequence
  Marburg virus siRNA sense strand
uuucaccuugaaagaguuaaa

SEQ ID NO: 24098 - RNA, 21 nt, Artificial Sequence
  Marburg virus siRNA sense strand
uucaccuugaaagaguuaaau

SEQ ID NO: 24099 - RNA, 21 nt, Artificial Sequence
  Marburg virus siRNA sense strand
ucaccuugaaagaguuaaaug

SEQ ID NO: 24100 - RNA, 21 nt, Artificial Sequence
  Marburg virus siRNA sense strand
caccuugaaagaguuaaaugg

SEQ ID NO: 24101 - RNA, 21 nt, Artificial Sequence
  Marburg virus siRNA sense strand
accuugaaagaguuaaauggu

SEQ ID NO: 24102 - RNA, 21 nt, Artificial Sequence
  Marburg virus siRNA sense strand
ccuugaaagaguuaaauggug

SEQ ID NO: 24103 - RNA, 21 nt, Artificial Sequence
  Marburg virus siRNA sense strand
cuugaaagaguuaaaugguga

SEQ ID NO: 24104 - RNA, 21 nt, Artificial Sequence
  Marburg virus siRNA sense strand
uugaaagaguuaaauggugau

SEQ ID NO: 24105 - RNA, 21 nt, Artificial Sequence
  Marburg virus siRNA sense strand
ugaaagaguuaaauggugaua

SEQ ID NO: 24106 - RNA, 21 nt, Artificial Sequence
  Marburg virus siRNA sense strand
gaaagaguuaaauggugauag

SEQ ID NO: 24107 - RNA, 21 nt, Artificial Sequence
  Marburg virus siRNA sense strand
aaagaguuaaauggugauaga

SEQ ID NO: 24108 - RNA, 21 nt, Artificial Sequence
  Marburg virus siRNA sense strand
aagaguuaaauggugauagau

SEQ ID NO: 24109 - RNA, 21 nt, Artificial Sequence
  Marburg virus siRNA sense strand
agaguuaaauggugauagauu

SEQ ID NO: 24110 - RNA, 21 nt, Artificial Sequence
  Marburg virus siRNA sense strand
gaguuaaauggugauagauua

SEQ ID NO: 24111 - RNA, 21 nt, Artificial Sequence
  Marburg virus siRNA sense strand
aguuaaauggugauagauuaa

SEQ ID NO: 24112 - RNA, 21 nt, Artificial Sequence
  Marburg virus siRNA sense strand
guuaaauggugauagauuaau

SEQ ID NO: 24113 - RNA, 21 nt, Artificial Sequence
  Marburg virus siRNA sense strand
uuaaauggugauagauuaauc

SEQ ID NO: 24114 - RNA, 21 nt, Artificial Sequence
  Marburg virus siRNA sense strand
uaaauggugauagauuaaucc

SEQ ID NO: 24115 - RNA, 21 nt, Artificial Sequence
  Marburg virus siRNA sense strand
aaauggugauagauuaauccu

SEQ ID NO: 24116 - RNA, 21 nt, Artificial Sequence
  Marburg virus siRNA sense strand
aauggugauagauuaauccuu

SEQ ID NO: 24117 - RNA, 21 nt, Artificial Sequence
  Marburg virus siRNA sense strand
auggugauagauuaauccuug

SEQ ID NO: 24118 - RNA, 21 nt, Artificial Sequence
  Marburg virus siRNA sense strand
uggugauagauuaauccuuga

SEQ ID NO: 24119 - RNA, 21 nt, Artificial Sequence
  Marburg virus siRNA sense strand
ggugauagauuaauccuugaa

SEQ ID NO: 24120 - RNA, 21 nt, Artificial Sequence
  Marburg virus siRNA sense strand
gugauagauuaauccuugaag

SEQ ID NO: 24121 - RNA, 21 nt, Artificial Sequence
  Marburg virus siRNA sense strand
ugauagauuaauccuugaagu

SEQ ID NO: 24122 - RNA, 21 nt, Artificial Sequence
  Marburg virus siRNA sense strand
gauagauuaauccuugaagua

SEQ ID NO: 24123 - RNA, 21 nt, Artificial Sequence
  Marburg virus siRNA sense strand
auagauuaauccuugaaguaa

SEQ ID NO: 24124 - RNA, 21 nt, Artificial Sequence
  Marburg virus siRNA sense strand
uagauuaauccuugaaguaac

SEQ ID NO: 24125 - RNA, 21 nt, Artificial Sequence
  Marburg virus siRNA sense strand
agauuaauccuugaaguaacu

SEQ ID NO: 24126 - RNA, 21 nt, Artificial Sequence
  Marburg virus siRNA sense strand
gauuaauccuugaaguaacuu

SEQ ID NO: 24127 - RNA, 21 nt, Artificial Sequence
  Marburg virus siRNA sense strand
auuaauccuugaaguaacuuu

SEQ ID NO: 24128 - RNA, 21 nt, Artificial Sequence
  Marburg virus siRNA sense strand
uuaauccuugaaguaacuuuu

SEQ ID NO: 24129 - RNA, 21 nt, Artificial Sequence
  Marburg virus siRNA sense strand
uaauccuugaaguaacuuuuu

SEQ ID NO: 24130 - RNA, 21 nt, Artificial Sequence
  Marburg virus siRNA sense strand
aauccuugaaguaacuuuuuu

SEQ ID NO: 24131 - RNA, 21 nt, Artificial Sequence
  Marburg virus siRNA sense strand
auccuugaaguaacuuuuuua

SEQ ID NO: 24132 - RNA, 21 nt, Artificial Sequence
  Marburg virus siRNA sense strand
uccuugaaguaacuuuuuuau

SEQ ID NO: 24133 - RNA, 21 nt, Artificial Sequence
  Marburg virus siRNA sense strand
ccuugaaguaacuuuuuuaua

SEQ ID NO: 24134 - RNA, 21 nt, Artificial Sequence
  Marburg virus siRNA sense strand
cuugaaguaacuuuuuuauau

SEQ ID NO: 24135 - RNA, 21 nt, Artificial Sequence
  Marburg virus siRNA sense strand
uugaaguaacuuuuuuauaua

SEQ ID NO: 24136 - RNA, 21 nt, Artificial Sequence
  Marburg virus siRNA sense strand
ugaaguaacuuuuuuauauau

SEQ ID NO: 24137 - RNA, 21 nt, Artificial Sequence
  Marburg virus siRNA sense strand
gaaguaacuuuuuuauauauu

SEQ ID NO: 24138 - RNA, 21 nt, Artificial Sequence
  Marburg virus siRNA sense strand
aaguaacuuuuuuauauauua

SEQ ID NO: 24139 - RNA, 21 nt, Artificial Sequence
  Marburg virus siRNA sense strand
aguaacuuuuuuauauauuau

SEQ ID NO: 24140 - RNA, 21 nt, Artificial Sequence
  Marburg virus siRNA sense strand
guaacuuuuuuauauauuaua

SEQ ID NO: 24141 - RNA, 21 nt, Artificial Sequence
  Marburg virus siRNA sense strand
uaacuuuuuuauauauuauag

SEQ ID NO: 24142 - RNA, 21 nt, Artificial Sequence
  Marburg virus siRNA sense strand
aacuuuuuuauauauuauaga

SEQ ID NO: 24143 - RNA, 21 nt, Artificial Sequence
  Marburg virus siRNA sense strand
acuuuuuuauauauuauagag

SEQ ID NO: 24144 - RNA, 21 nt, Artificial Sequence
  Marburg virus siRNA sense strand
cuuuuuuauauauuauagagg

SEQ ID NO: 24145 - RNA, 21 nt, Artificial Sequence
  Marburg virus siRNA sense strand
uuuuuuauauauuauagagga

SEQ ID NO: 24146 - RNA, 21 nt, Artificial Sequence
  Marburg virus siRNA sense strand
uuuuuauauauuauagaggaa

SEQ ID NO: 24147 - RNA, 21 nt, Artificial Sequence
  Marburg virus siRNA sense strand
uuuuauauauuauagaggaac

SEQ ID NO: 24148 - RNA, 21 nt, Artificial Sequence
  Marburg virus siRNA sense strand
uuuauauauuauagaggaacu

SEQ ID NO: 24149 - RNA, 21 nt, Artificial Sequence
  Marburg virus siRNA sense strand
uuauauauuauagaggaacua

SEQ ID NO: 24150 - RNA, 21 nt, Artificial Sequence
  Marburg virus siRNA sense strand
uauauauuauagaggaacuaa

SEQ ID NO: 24151 - RNA, 21 nt, Artificial Sequence
  Marburg virus siRNA sense strand
auauauuauagaggaacuaau

SEQ ID NO: 24152 - RNA, 21 nt, Artificial Sequence
  Marburg virus siRNA sense strand
uauauuauagaggaacuaaua

SEQ ID NO: 24153 - RNA, 21 nt, Artificial Sequence
  Marburg virus siRNA sense strand
auauuauagaggaacuaauau

SEQ ID NO: 24154 - RNA, 21 nt, Artificial Sequence
  Marburg virus siRNA sense strand
uauuauagaggaacuaauauu

SEQ ID NO: 24155 - RNA, 21 nt, Artificial Sequence
  Marburg virus siRNA sense strand
auuauagaggaacuaauauua

SEQ ID NO: 24156 - RNA, 21 nt, Artificial Sequence
  Marburg virus siRNA sense strand
uuauagaggaacuaauauuac

SEQ ID NO: 24157 - RNA, 21 nt, Artificial Sequence
  Marburg virus siRNA sense strand
uauagaggaacuaauauuacu

SEQ ID NO: 24158 - RNA, 21 nt, Artificial Sequence
  Marburg virus siRNA sense strand
auagaggaacuaauauuacua

SEQ ID NO: 24159 - RNA, 21 nt, Artificial Sequence
  Marburg virus siRNA sense strand
uagaggaacuaauauuacuaa

SEQ ID NO: 24160 - RNA, 21 nt, Artificial Sequence
  Marburg virus siRNA sense strand
agaggaacuaauauuacuaac

SEQ ID NO: 24161 - RNA, 21 nt, Artificial Sequence
  Marburg virus siRNA sense strand
gaggaacuaauauuacuaaca

SEQ ID NO: 24162 - RNA, 21 nt, Artificial Sequence
  Marburg virus siRNA sense strand
aggaacuaauauuacuaacaa

SEQ ID NO: 24163 - RNA, 21 nt, Artificial Sequence
  Marburg virus siRNA sense strand
ggaacuaauauuacuaacaaa

SEQ ID NO: 24164 - RNA, 21 nt, Artificial Sequence
  Marburg virus siRNA sense strand
gaacuaauauuacuaacaaaa

SEQ ID NO: 24165 - RNA, 21 nt, Artificial Sequence
  Marburg virus siRNA sense strand
aacuaauauuacuaacaaaag

SEQ ID NO: 24166 - RNA, 21 nt, Artificial Sequence
  Marburg virus siRNA sense strand
acuaauauuacuaacaaaagg

SEQ ID NO: 24167 - RNA, 21 nt, Artificial Sequence
  Marburg virus siRNA sense strand
cuaauauuacuaacaaaaggg

SEQ ID NO: 24168 - RNA, 21 nt, Artificial Sequence
  Marburg virus siRNA sense strand
uaauauuacuaacaaaagggg

SEQ ID NO: 24169 - RNA, 21 nt, Artificial Sequence
  Marburg virus siRNA sense strand
aauauuacuaacaaaaggggu

SEQ ID NO: 24170 - RNA, 21 nt, Artificial Sequence
  Marburg virus siRNA sense strand
auauuacuaacaaaagggguc

SEQ ID NO: 24171 - RNA, 21 nt, Artificial Sequence
  Marburg virus siRNA sense strand
uauuacuaacaaaaggggucu

SEQ ID NO: 24172 - RNA, 21 nt, Artificial Sequence
  Marburg virus siRNA sense strand
auuacuaacaaaaggggucua

SEQ ID NO: 24173 - RNA, 21 nt, Artificial Sequence
  Marburg virus siRNA sense strand
uuacuaacaaaaggggucuac

SEQ ID NO: 24174 - RNA, 21 nt, Artificial Sequence
  Marburg virus siRNA sense strand
uacuaacaaaaggggucuacc

SEQ ID NO: 24175 - RNA, 21 nt, Artificial Sequence
  Marburg virus siRNA sense strand
acuaacaaaaggggucuaccu

SEQ ID NO: 24176 - RNA, 21 nt, Artificial Sequence
  Marburg virus siRNA sense strand
cuaacaaaaggggucuaccua

SEQ ID NO: 24177 - RNA, 21 nt, Artificial Sequence
  Marburg virus siRNA sense strand
uaacaaaaggggucuaccuaa

SEQ ID NO: 24178 - RNA, 21 nt, Artificial Sequence
  Marburg virus siRNA sense strand
aacaaaaggggucuaccuaac

SEQ ID NO: 24179 - RNA, 21 nt, Artificial Sequence
  Marburg virus siRNA sense strand
acaaaaggggucuaccuaaca

SEQ ID NO: 24180 - RNA, 21 nt, Artificial Sequence
  Marburg virus siRNA sense strand
caaaaggggucuaccuaacag

SEQ ID NO: 24181 - RNA, 21 nt, Artificial Sequence
  Marburg virus siRNA sense strand
aaaaggggucuaccuaacagg

SEQ ID NO: 24182 - RNA, 21 nt, Artificial Sequence
  Marburg virus siRNA sense strand
aaaggggucuaccuaacaggu

SEQ ID NO: 24183 - RNA, 21 nt, Artificial Sequence
  Marburg virus siRNA sense strand
aaggggucuaccuaacaggua

SEQ ID NO: 24184 - RNA, 21 nt, Artificial Sequence
  Marburg virus siRNA sense strand
aggggucuaccuaacagguau

SEQ ID NO: 24185 - RNA, 21 nt, Artificial Sequence
  Marburg virus siRNA sense strand
ggggucuaccuaacagguaug

SEQ ID NO: 24186 - RNA, 21 nt, Artificial Sequence
  Marburg virus siRNA sense strand
gggucuaccuaacagguauga

SEQ ID NO: 24187 - RNA, 21 nt, Artificial Sequence
  Marburg virus siRNA sense strand
ggucuaccuaacagguaugac

SEQ ID NO: 24188 - RNA, 21 nt, Artificial Sequence
  Marburg virus siRNA sense strand
gucuaccuaacagguaugacu

SEQ ID NO: 24189 - RNA, 21 nt, Artificial Sequence
  Marburg virus siRNA sense strand
ucuaccuaacagguaugacug

SEQ ID NO: 24190 - RNA, 21 nt, Artificial Sequence
  Marburg virus siRNA sense strand
cuaccuaacagguaugacuga

SEQ ID NO: 24191 - RNA, 21 nt, Artificial Sequence
  Marburg virus siRNA sense strand
uaccuaacagguaugacugag

SEQ ID NO: 24192 - RNA, 21 nt, Artificial Sequence
  Marburg virus siRNA sense strand
accuaacagguaugacugagu

SEQ ID NO: 24193 - RNA, 21 nt, Artificial Sequence
  Marburg virus siRNA sense strand
ccuaacagguaugacugagug

SEQ ID NO: 24194 - RNA, 21 nt, Artificial Sequence
  Marburg virus siRNA sense strand
cuaacagguaugacugaguga

SEQ ID NO: 24195 - RNA, 21 nt, Artificial Sequence
  Marburg virus siRNA sense strand
uaacagguaugacugagugau

SEQ ID NO: 24196 - RNA, 21 nt, Artificial Sequence
  Marburg virus siRNA sense strand
aacagguaugacugagugauc

SEQ ID NO: 24197 - RNA, 21 nt, Artificial Sequence
  Marburg virus siRNA sense strand
acagguaugacugagugauca

SEQ ID NO: 24198 - RNA, 21 nt, Artificial Sequence
  Marburg virus siRNA sense strand
cagguaugacugagugaucag

SEQ ID NO: 24199 - RNA, 21 nt, Artificial Sequence
  Marburg virus siRNA sense strand
agguaugacugagugaucagu

SEQ ID NO: 24200 - RNA, 21 nt, Artificial Sequence
  Marburg virus siRNA sense strand
gguaugacugagugaucagua

SEQ ID NO: 24201 - RNA, 21 nt, Artificial Sequence
  Marburg virus siRNA sense strand
guaugacugagugaucaguau

SEQ ID NO: 24202 - RNA, 21 nt, Artificial Sequence
  Marburg virus siRNA sense strand
uaugacugagugaucaguaua

SEQ ID NO: 24203 - RNA, 21 nt, Artificial Sequence
  Marburg virus siRNA sense strand
augacugagugaucaguauau

SEQ ID NO: 24204 - RNA, 21 nt, Artificial Sequence
  Marburg virus siRNA sense strand
ugacugagugaucaguauauu

SEQ ID NO: 24205 - RNA, 21 nt, Artificial Sequence
  Marburg virus siRNA sense strand
gacugagugaucaguauauuu

SEQ ID NO: 24206 - RNA, 21 nt, Artificial Sequence
  Marburg virus siRNA sense strand
acugagugaucaguauauuuu

SEQ ID NO: 24207 - RNA, 21 nt, Artificial Sequence
  Marburg virus siRNA sense strand
cugagugaucaguauauuuua

SEQ ID NO: 24208 - RNA, 21 nt, Artificial Sequence
  Marburg virus siRNA sense strand
ugagugaucaguauauuuuau

SEQ ID NO: 24209 - RNA, 21 nt, Artificial Sequence
  Marburg virus siRNA sense strand
gagugaucaguauauuuuaua

SEQ ID NO: 24210 - RNA, 21 nt, Artificial Sequence
  Marburg virus siRNA sense strand
agugaucaguauauuuuauaa

SEQ ID NO: 24211 - RNA, 21 nt, Artificial Sequence
  Marburg virus siRNA sense strand
gugaucaguauauuuuauaaa

SEQ ID NO: 24212 - RNA, 21 nt, Artificial Sequence
  Marburg virus siRNA sense strand
ugaucaguauauuuuauaaac

SEQ ID NO: 24213 - RNA, 21 nt, Artificial Sequence
  Marburg virus siRNA sense strand
gaucaguauauuuuauaaacc

SEQ ID NO: 24214 - RNA, 21 nt, Artificial Sequence
  Marburg virus siRNA sense strand
aucaguauauuuuauaaacca

SEQ ID NO: 24215 - RNA, 21 nt, Artificial Sequence
  Marburg virus siRNA sense strand
ucaguauauuuuauaaaccaa

SEQ ID NO: 24216 - RNA, 21 nt, Artificial Sequence
  Marburg virus siRNA sense strand
caguauauuuuauaaaccaag

SEQ ID NO: 24217 - RNA, 21 nt, Artificial Sequence
  Marburg virus siRNA sense strand
aguauauuuuauaaaccaagc

SEQ ID NO: 24218 - RNA, 21 nt, Artificial Sequence
  Marburg virus siRNA sense strand
guauauuuuauaaaccaagca

SEQ ID NO: 24219 - RNA, 21 nt, Artificial Sequence
  Marburg virus siRNA sense strand
uauauuuuauaaaccaagcaa

SEQ ID NO: 24220 - RNA, 21 nt, Artificial Sequence
  Marburg virus siRNA sense strand
auauuuuauaaaccaagcaau

SEQ ID NO: 24221 - RNA, 21 nt, Artificial Sequence
  Marburg virus siRNA sense strand
uauuuuauaaaccaagcaauu

SEQ ID NO: 24222 - RNA, 21 nt, Artificial Sequence
  Marburg virus siRNA sense strand
auuuuauaaaccaagcaauug

SEQ ID NO: 24223 - RNA, 21 nt, Artificial Sequence
  Marburg virus siRNA sense strand
uuuuauaaaccaagcaauuga

SEQ ID NO: 24224 - RNA, 21 nt, Artificial Sequence
  Marburg virus siRNA sense strand
uuuauaaaccaagcaauugac

SEQ ID NO: 24225 - RNA, 21 nt, Artificial Sequence
  Marburg virus siRNA sense strand
uuauaaaccaagcaauugacu

SEQ ID NO: 24226 - RNA, 21 nt, Artificial Sequence
  Marburg virus siRNA sense strand
uauaaaccaagcaauugacuu

SEQ ID NO: 24227 - RNA, 21 nt, Artificial Sequence
  Marburg virus siRNA sense strand
auaaaccaagcaauugacuuc

SEQ ID NO: 24228 - RNA, 21 nt, Artificial Sequence
  Marburg virus siRNA sense strand
uaaaccaagcaauugacuucu

SEQ ID NO: 24229 - RNA, 21 nt, Artificial Sequence
  Marburg virus siRNA sense strand
aaaccaagcaauugacuucuc

SEQ ID NO: 24230 - RNA, 21 nt, Artificial Sequence
  Marburg virus siRNA sense strand
aaccaagcaauugacuucuca

SEQ ID NO: 24231 - RNA, 21 nt, Artificial Sequence
  Marburg virus siRNA sense strand
accaagcaauugacuucucac

SEQ ID NO: 24232 - RNA, 21 nt, Artificial Sequence
  Marburg virus siRNA sense strand
ccaagcaauugacuucucacu

SEQ ID NO: 24233 - RNA, 21 nt, Artificial Sequence
  Marburg virus siRNA sense strand
caagcaauugacuucucacuu

SEQ ID NO: 24234 - RNA, 21 nt, Artificial Sequence
  Marburg virus siRNA sense strand
aagcaauugacuucucacuuu

SEQ ID NO: 24235 - RNA, 21 nt, Artificial Sequence
  Marburg virus siRNA sense strand
agcaauugacuucucacuuuu

SEQ ID NO: 24236 - RNA, 21 nt, Artificial Sequence
  Marburg virus siRNA sense strand
gcaauugacuucucacuuuuu

SEQ ID NO: 24237 - RNA, 21 nt, Artificial Sequence
  Marburg virus siRNA sense strand
caauugacuucucacuuuuua

SEQ ID NO: 24238 - RNA, 21 nt, Artificial Sequence
  Marburg virus siRNA sense strand
aauugacuucucacuuuuuaa

SEQ ID NO: 24239 - RNA, 21 nt, Artificial Sequence
  Marburg virus siRNA sense strand
auugacuucucacuuuuuaag

SEQ ID NO: 24240 - RNA, 21 nt, Artificial Sequence
  Marburg virus siRNA sense strand
uugacuucucacuuuuuaaga

SEQ ID NO: 24241 - RNA, 21 nt, Artificial Sequence
  Marburg virus siRNA sense strand
ugacuucucacuuuuuaagaa

SEQ ID NO: 24242 - RNA, 21 nt, Artificial Sequence
  Marburg virus siRNA sense strand
gacuucucacuuuuuaagaau

SEQ ID NO: 24243 - RNA, 21 nt, Artificial Sequence
  Marburg virus siRNA sense strand
acuucucacuuuuuaagaauc

SEQ ID NO: 24244 - RNA, 21 nt, Artificial Sequence
  Marburg virus siRNA sense strand
cuucucacuuuuuaagaauca

SEQ ID NO: 24245 - RNA, 21 nt, Artificial Sequence
  Marburg virus siRNA sense strand
uucucacuuuuuaagaaucaa

SEQ ID NO: 24246 - RNA, 21 nt, Artificial Sequence
  Marburg virus siRNA sense strand
ucucacuuuuuaagaaucaac

SEQ ID NO: 24247 - RNA, 21 nt, Artificial Sequence
  Marburg virus siRNA sense strand
cucacuuuuuaagaaucaacu

SEQ ID NO: 24248 - RNA, 21 nt, Artificial Sequence
  Marburg virus siRNA sense strand
ucacuuuuuaagaaucaacua

SEQ ID NO: 24249 - RNA, 21 nt, Artificial Sequence
  Marburg virus siRNA sense strand
cacuuuuuaagaaucaacuaa

SEQ ID NO: 24250 - RNA, 21 nt, Artificial Sequence
  Marburg virus siRNA sense strand
acuuuuuaagaaucaacuaac

SEQ ID NO: 24251 - RNA, 21 nt, Artificial Sequence
  Marburg virus siRNA sense strand
cuuuuuaagaaucaacuaaca

SEQ ID NO: 24252 - RNA, 21 nt, Artificial Sequence
  Marburg virus siRNA sense strand
uuuuuaagaaucaacuaacaa

SEQ ID NO: 24253 - RNA, 21 nt, Artificial Sequence
  Marburg virus siRNA sense strand
uuuuaagaaucaacuaacaac

SEQ ID NO: 24254 - RNA, 21 nt, Artificial Sequence
  Marburg virus siRNA sense strand
uuuaagaaucaacuaacaaca

SEQ ID NO: 24255 - RNA, 21 nt, Artificial Sequence
  Marburg virus siRNA sense strand
uuaagaaucaacuaacaacau

SEQ ID NO: 24256 - RNA, 21 nt, Artificial Sequence
  Marburg virus siRNA sense strand
uaagaaucaacuaacaacaua

SEQ ID NO: 24257 - RNA, 21 nt, Artificial Sequence
  Marburg virus siRNA sense strand
aagaaucaacuaacaacauag

SEQ ID NO: 24258 - RNA, 21 nt, Artificial Sequence
  Marburg virus siRNA sense strand
agaaucaacuaacaacauaga

SEQ ID NO: 24259 - RNA, 21 nt, Artificial Sequence
  Marburg virus siRNA sense strand
gaaucaacuaacaacauagaa

SEQ ID NO: 24260 - RNA, 21 nt, Artificial Sequence
  Marburg virus siRNA sense strand
aaucaacuaacaacauagaaa

SEQ ID NO: 24261 - RNA, 21 nt, Artificial Sequence
  Marburg virus siRNA sense strand
aucaacuaacaacauagaaaa

SEQ ID NO: 24262 - RNA, 21 nt, Artificial Sequence
  Marburg virus siRNA sense strand
ucaacuaacaacauagaaaac

SEQ ID NO: 24263 - RNA, 21 nt, Artificial Sequence
  Marburg virus siRNA sense strand
caacuaacaacauagaaaaca

SEQ ID NO: 24264 - RNA, 21 nt, Artificial Sequence
  Marburg virus siRNA sense strand
aacuaacaacauagaaaacau

SEQ ID NO: 24265 - RNA, 21 nt, Artificial Sequence
  Marburg virus siRNA sense strand
acuaacaacauagaaaacaua

SEQ ID NO: 24266 - RNA, 21 nt, Artificial Sequence
  Marburg virus siRNA sense strand
cuaacaacauagaaaacauau

SEQ ID NO: 24267 - RNA, 21 nt, Artificial Sequence
  Marburg virus siRNA sense strand
uaacaacauagaaaacauauu

SEQ ID NO: 24268 - RNA, 21 nt, Artificial Sequence
  Marburg virus siRNA sense strand
aacaacauagaaaacauauuu

SEQ ID NO: 24269 - RNA, 21 nt, Artificial Sequence
  Marburg virus siRNA sense strand
acaacauagaaaacauauuua

SEQ ID NO: 24270 - RNA, 21 nt, Artificial Sequence
  Marburg virus siRNA sense strand
caacauagaaaacauauuuau

SEQ ID NO: 24271 - RNA, 21 nt, Artificial Sequence
  Marburg virus siRNA sense strand
aacauagaaaacauauuuauc

SEQ ID NO: 24272 - RNA, 21 nt, Artificial Sequence
  Marburg virus siRNA sense strand
acauagaaaacauauuuaucc

SEQ ID NO: 24273 - RNA, 21 nt, Artificial Sequence
  Marburg virus siRNA sense strand
cauagaaaacauauuuauccu

SEQ ID NO: 24274 - RNA, 21 nt, Artificial Sequence
  Marburg virus siRNA sense strand
auagaaaacauauuuauccuu

SEQ ID NO: 24275 - RNA, 21 nt, Artificial Sequence
  Marburg virus siRNA sense strand
uagaaaacauauuuauccuug

SEQ ID NO: 24276 - RNA, 21 nt, Artificial Sequence
  Marburg virus siRNA sense strand
agaaaacauauuuauccuugu

SEQ ID NO: 24277 - RNA, 21 nt, Artificial Sequence
  Marburg virus siRNA sense strand
gaaaacauauuuauccuugug

SEQ ID NO: 24278 - RNA, 21 nt, Artificial Sequence
  Marburg virus siRNA sense strand
aaaacauauuuauccuugugu

SEQ ID NO: 24279 - RNA, 21 nt, Artificial Sequence
  Marburg virus siRNA sense strand
aaacauauuuauccuugugua

SEQ ID NO: 24280 - RNA, 21 nt, Artificial Sequence
  Marburg virus siRNA sense strand
aacauauuuauccuuguguaa

SEQ ID NO: 24281 - RNA, 21 nt, Artificial Sequence
  Marburg virus siRNA sense strand
acauauuuauccuuguguaau

SEQ ID NO: 24282 - RNA, 21 nt, Artificial Sequence
  Marburg virus siRNA sense strand
cauauuuauccuuguguaauu

SEQ ID NO: 24283 - RNA, 21 nt, Artificial Sequence
  Marburg virus siRNA sense strand
auauuuauccuuguguaauuc

SEQ ID NO: 24284 - RNA, 21 nt, Artificial Sequence
  Marburg virus siRNA sense strand
uauuuauccuuguguaauucu

SEQ ID NO: 24285 - RNA, 21 nt, Artificial Sequence
  Marburg virus siRNA sense strand
auuuauccuuguguaauucuc

SEQ ID NO: 24286 - RNA, 21 nt, Artificial Sequence
  Marburg virus siRNA sense strand
uuuauccuuguguaauucucg

SEQ ID NO: 24287 - RNA, 21 nt, Artificial Sequence
  Marburg virus siRNA sense strand
uuauccuuguguaauucucgg

SEQ ID NO: 24288 - RNA, 21 nt, Artificial Sequence
  Marburg virus siRNA sense strand
uauccuuguguaauucucggc

SEQ ID NO: 24289 - RNA, 21 nt, Artificial Sequence
  Marburg virus siRNA sense strand
auccuuguguaauucucggcu

SEQ ID NO: 24290 - RNA, 21 nt, Artificial Sequence
  Marburg virus siRNA sense strand
uccuuguguaauucucggcuu

SEQ ID NO: 24291 - RNA, 21 nt, Artificial Sequence
  Marburg virus siRNA sense strand
ccuuguguaauucucggcuua

SEQ ID NO: 24292 - RNA, 21 nt, Artificial Sequence
  Marburg virus siRNA sense strand
cuuguguaauucucggcuuag

SEQ ID NO: 24293 - RNA, 21 nt, Artificial Sequence
  Marburg virus siRNA sense strand
uuguguaauucucggcuuagu

SEQ ID NO: 24294 - RNA, 21 nt, Artificial Sequence
  Marburg virus siRNA sense strand
uguguaauucucggcuuaguu

SEQ ID NO: 24295 - RNA, 21 nt, Artificial Sequence
  Marburg virus siRNA sense strand
guguaauucucggcuuaguug

SEQ ID NO: 24296 - RNA, 21 nt, Artificial Sequence
  Marburg virus siRNA sense strand
uguaauucucggcuuaguugg

SEQ ID NO: 24297 - RNA, 21 nt, Artificial Sequence
  Marburg virus siRNA sense strand
guaauucucggcuuaguugga

SEQ ID NO: 24298 - RNA, 21 nt, Artificial Sequence
  Marburg virus siRNA sense strand
uaauucucggcuuaguuggaa

SEQ ID NO: 24299 - RNA, 21 nt, Artificial Sequence
  Marburg virus siRNA sense strand
aauucucggcuuaguuggaau

SEQ ID NO: 24300 - RNA, 21 nt, Artificial Sequence
  Marburg virus siRNA sense strand
auucucggcuuaguuggaauu

SEQ ID NO: 24301 - RNA, 21 nt, Artificial Sequence
  Marburg virus siRNA sense strand
uucucggcuuaguuggaauua

SEQ ID NO: 24302 - RNA, 21 nt, Artificial Sequence
  Marburg virus siRNA sense strand
ucucggcuuaguuggaauuaa

SEQ ID NO: 24303 - RNA, 21 nt, Artificial Sequence
  Marburg virus siRNA sense strand
cucggcuuaguuggaauuaac

SEQ ID NO: 24304 - RNA, 21 nt, Artificial Sequence
  Marburg virus siRNA sense strand
ucggcuuaguuggaauuaacu

SEQ ID NO: 24305 - RNA, 21 nt, Artificial Sequence
  Marburg virus siRNA sense strand
cggcuuaguuggaauuaacuu

SEQ ID NO: 24306 - RNA, 21 nt, Artificial Sequence
  Marburg virus siRNA sense strand
ggcuuaguuggaauuaacuuu

SEQ ID NO: 24307 - RNA, 21 nt, Artificial Sequence
  Marburg virus siRNA sense strand
gcuuaguuggaauuaacuuuu

SEQ ID NO: 24308 - RNA, 21 nt, Artificial Sequence
  Marburg virus siRNA sense strand
cuuaguuggaauuaacuuuug

SEQ ID NO: 24309 - RNA, 21 nt, Artificial Sequence
  Marburg virus siRNA sense strand
uuaguuggaauuaacuuuugu

SEQ ID NO: 24310 - RNA, 21 nt, Artificial Sequence
  Marburg virus siRNA sense strand
uaguuggaauuaacuuuuguu

SEQ ID NO: 24311 - RNA, 21 nt, Artificial Sequence
  Marburg virus siRNA sense strand
aguuggaauuaacuuuuguug

SEQ ID NO: 24312 - RNA, 21 nt, Artificial Sequence
  Marburg virus siRNA sense strand
guuggaauuaacuuuuguugc

SEQ ID NO: 24313 - RNA, 21 nt, Artificial Sequence
  Marburg virus siRNA sense strand
uuggaauuaacuuuuguugca

SEQ ID NO: 24314 - RNA, 21 nt, Artificial Sequence
  Marburg virus siRNA sense strand
uggaauuaacuuuuguugcaa

SEQ ID NO: 24315 - RNA, 21 nt, Artificial Sequence
  Marburg virus siRNA sense strand
ggaauuaacuuuuguugcaau

SEQ ID NO: 24316 - RNA, 21 nt, Artificial Sequence
  Marburg virus siRNA sense strand
gaauuaacuuuuguugcaauu

SEQ ID NO: 24317 - RNA, 21 nt, Artificial Sequence
  Marburg virus siRNA sense strand
aauuaacuuuuguugcaauuc

SEQ ID NO: 24318 - RNA, 21 nt, Artificial Sequence
  Marburg virus siRNA sense strand
auuaacuuuuguugcaauuca

SEQ ID NO: 24319 - RNA, 21 nt, Artificial Sequence
  Marburg virus siRNA sense strand
uuaacuuuuguugcaauucaa

SEQ ID NO: 24320 - RNA, 21 nt, Artificial Sequence
  Marburg virus siRNA sense strand
uaacuuuuguugcaauucaag

SEQ ID NO: 24321 - RNA, 21 nt, Artificial Sequence
  Marburg virus siRNA sense strand
aacuuuuguugcaauucaaga

SEQ ID NO: 24322 - RNA, 21 nt, Artificial Sequence
  Marburg virus siRNA sense strand
acuuuuguugcaauucaagac

SEQ ID NO: 24323 - RNA, 21 nt, Artificial Sequence
  Marburg virus siRNA sense strand
cuuuuguugcaauucaagacg

SEQ ID NO: 24324 - RNA, 21 nt, Artificial Sequence
  Marburg virus siRNA sense strand
uuuuguugcaauucaagacgc

SEQ ID NO: 24325 - RNA, 21 nt, Artificial Sequence
  Marburg virus siRNA sense strand
uuuguugcaauucaagacgcu

SEQ ID NO: 24326 - RNA, 21 nt, Artificial Sequence
  Marburg virus siRNA sense strand
uuguugcaauucaagacgcuu

SEQ ID NO: 24327 - RNA, 21 nt, Artificial Sequence
  Marburg virus siRNA sense strand
uguugcaauucaagacgcuua

SEQ ID NO: 24328 - RNA, 21 nt, Artificial Sequence
  Marburg virus siRNA sense strand
guugcaauucaagacgcuuau

SEQ ID NO: 24329 - RNA, 21 nt, Artificial Sequence
  Marburg virus siRNA sense strand
uugcaauucaagacgcuuauu

SEQ ID NO: 24330 - RNA, 21 nt, Artificial Sequence
  Marburg virus siRNA sense strand
ugcaauucaagacgcuuauuc

SEQ ID NO: 24331 - RNA, 21 nt, Artificial Sequence
  Marburg virus siRNA sense strand
gcaauucaagacgcuuauuca

SEQ ID NO: 24332 - RNA, 21 nt, Artificial Sequence
  Marburg virus siRNA sense strand
caauucaagacgcuuauucau

SEQ ID NO: 24333 - RNA, 21 nt, Artificial Sequence
  Marburg virus siRNA sense strand
aauucaagacgcuuauucaua

SEQ ID NO: 24334 - RNA, 21 nt, Artificial Sequence
  Marburg virus siRNA sense strand
auucaagacgcuuauucauag

SEQ ID NO: 24335 - RNA, 21 nt, Artificial Sequence
  Marburg virus siRNA sense strand
uucaagacgcuuauucauagu

SEQ ID NO: 24336 - RNA, 21 nt, Artificial Sequence
  Marburg virus siRNA sense strand
ucaagacgcuuauucauagua

SEQ ID NO: 24337 - RNA, 21 nt, Artificial Sequence
  Marburg virus siRNA sense strand
caagacgcuuauucauaguag

SEQ ID NO: 24338 - RNA, 21 nt, Artificial Sequence
  Marburg virus siRNA sense strand
aagacgcuuauucauaguaga

SEQ ID NO: 24339 - RNA, 21 nt, Artificial Sequence
  Marburg virus siRNA sense strand
agacgcuuauucauaguagau

SEQ ID NO: 24340 - RNA, 21 nt, Artificial Sequence
  Marburg virus siRNA sense strand
gacgcuuauucauaguagauu

SEQ ID NO: 24341 - RNA, 21 nt, Artificial Sequence
  Marburg virus siRNA sense strand
acgcuuauucauaguagauua

SEQ ID NO: 24342 - RNA, 21 nt, Artificial Sequence
  Marburg virus siRNA sense strand
cgcuuauucauaguagauuau

SEQ ID NO: 24343 - RNA, 21 nt, Artificial Sequence
  Marburg virus siRNA sense strand
gcuuauucauaguagauuaua

SEQ ID NO: 24344 - RNA, 21 nt, Artificial Sequence
  Marburg virus siRNA sense strand
cuuauucauaguagauuauau

SEQ ID NO: 24345 - RNA, 21 nt, Artificial Sequence
  Marburg virus siRNA sense strand
uuauucauaguagauuauaug

SEQ ID NO: 24346 - RNA, 21 nt, Artificial Sequence
  Marburg virus siRNA sense strand
uauucauaguagauuauauga

SEQ ID NO: 24347 - RNA, 21 nt, Artificial Sequence
  Marburg virus siRNA sense strand
auucauaguagauuauaugau

SEQ ID NO: 24348 - RNA, 21 nt, Artificial Sequence
  Marburg virus siRNA sense strand
uucauaguagauuauaugauu

SEQ ID NO: 24349 - RNA, 21 nt, Artificial Sequence
  Marburg virus siRNA sense strand
ucauaguagauuauaugauuu

SEQ ID NO: 24350 - RNA, 21 nt, Artificial Sequence
  Marburg virus siRNA sense strand
cauaguagauuauaugauuuu

SEQ ID NO: 24351 - RNA, 21 nt, Artificial Sequence
  Marburg virus siRNA sense strand
auaguagauuauaugauuuuu

SEQ ID NO: 24352 - RNA, 21 nt, Artificial Sequence
  Marburg virus siRNA sense strand
uaguagauuauaugauuuuuu

SEQ ID NO: 24353 - RNA, 21 nt, Artificial Sequence
  Marburg virus siRNA sense strand
aguagauuauaugauuuuuua

SEQ ID NO: 24354 - RNA, 21 nt, Artificial Sequence
  Marburg virus siRNA sense strand
guagauuauaugauuuuuuau

SEQ ID NO: 24355 - RNA, 21 nt, Artificial Sequence
  Marburg virus siRNA sense strand
uagauuauaugauuuuuuaua

SEQ ID NO: 24356 - RNA, 21 nt, Artificial Sequence
  Marburg virus siRNA sense strand
agauuauaugauuuuuuauaa

SEQ ID NO: 24357 - RNA, 21 nt, Artificial Sequence
  Marburg virus siRNA sense strand
gauuauaugauuuuuuauaag

SEQ ID NO: 24358 - RNA, 21 nt, Artificial Sequence
  Marburg virus siRNA sense strand
auuauaugauuuuuuauaagu

SEQ ID NO: 24359 - RNA, 21 nt, Artificial Sequence
  Marburg virus siRNA sense strand
uuauaugauuuuuuauaaguu

SEQ ID NO: 24360 - RNA, 21 nt, Artificial Sequence
  Marburg virus siRNA sense strand
uauaugauuuuuuauaaguuu

SEQ ID NO: 24361 - RNA, 21 nt, Artificial Sequence
  Marburg virus siRNA sense strand
auaugauuuuuuauaaguuua

SEQ ID NO: 24362 - RNA, 21 nt, Artificial Sequence
  Marburg virus siRNA sense strand
uaugauuuuuuauaaguuuaa

SEQ ID NO: 24363 - RNA, 21 nt, Artificial Sequence
  Marburg virus siRNA sense strand
augauuuuuuauaaguuuaag

SEQ ID NO: 24364 - RNA, 21 nt, Artificial Sequence
  Marburg virus siRNA sense strand
ugauuuuuuauaaguuuaaga

SEQ ID NO: 24365 - RNA, 21 nt, Artificial Sequence
  Marburg virus siRNA sense strand
gauuuuuuauaaguuuaagau

SEQ ID NO: 24366 - RNA, 21 nt, Artificial Sequence
  Marburg virus siRNA sense strand
auuuuuuauaaguuuaagaua

SEQ ID NO: 24367 - RNA, 21 nt, Artificial Sequence
  Marburg virus siRNA sense strand
uuuuuuauaaguuuaagauau

SEQ ID NO: 24368 - RNA, 21 nt, Artificial Sequence
  Marburg virus siRNA sense strand
uuuuuauaaguuuaagauauc

SEQ ID NO: 24369 - RNA, 21 nt, Artificial Sequence
  Marburg virus siRNA sense strand
uuuuauaaguuuaagauaucu

SEQ ID NO: 24370 - RNA, 21 nt, Artificial Sequence
  Marburg virus siRNA sense strand
uuuauaaguuuaagauaucuu

SEQ ID NO: 24371 - RNA, 21 nt, Artificial Sequence
  Marburg virus siRNA sense strand
uuauaaguuuaagauaucuua

SEQ ID NO: 24372 - RNA, 21 nt, Artificial Sequence
  Marburg virus siRNA sense strand
uauaaguuuaagauaucuuaa

SEQ ID NO: 24373 - RNA, 21 nt, Artificial Sequence
  Marburg virus siRNA sense strand
auaaguuuaagauaucuuaaa

SEQ ID NO: 24374 - RNA, 21 nt, Artificial Sequence
  Marburg virus siRNA sense strand
uaaguuuaagauaucuuaaau

SEQ ID NO: 24375 - RNA, 21 nt, Artificial Sequence
  Marburg virus siRNA sense strand
aaguuuaagauaucuuaaauu

SEQ ID NO: 24376 - RNA, 21 nt, Artificial Sequence
  Marburg virus siRNA sense strand
aguuuaagauaucuuaaauua

SEQ ID NO: 24377 - RNA, 21 nt, Artificial Sequence
  Marburg virus siRNA sense strand
guuuaagauaucuuaaauuau

SEQ ID NO: 24378 - RNA, 21 nt, Artificial Sequence
  Marburg virus siRNA sense strand
uuuaagauaucuuaaauuaua

SEQ ID NO: 24379 - RNA, 21 nt, Artificial Sequence
  Marburg virus siRNA sense strand
uuaagauaucuuaaauuauac

SEQ ID NO: 24380 - RNA, 21 nt, Artificial Sequence
  Marburg virus siRNA sense strand
uaagauaucuuaaauuauacc

SEQ ID NO: 24381 - RNA, 21 nt, Artificial Sequence
  Marburg virus siRNA sense strand
aagauaucuuaaauuauaccc

SEQ ID NO: 24382 - RNA, 21 nt, Artificial Sequence
  Marburg virus siRNA sense strand
agauaucuuaaauuauaccca

SEQ ID NO: 24383 - RNA, 21 nt, Artificial Sequence
  Marburg virus siRNA sense strand
gauaucuuaaauuauacccac

SEQ ID NO: 24384 - RNA, 21 nt, Artificial Sequence
  Marburg virus siRNA sense strand
auaucuuaaauuauacccaca

SEQ ID NO: 24385 - RNA, 21 nt, Artificial Sequence
  Marburg virus siRNA sense strand
uaucuuaaauuauacccacaa

SEQ ID NO: 24386 - RNA, 21 nt, Artificial Sequence
  Marburg virus siRNA sense strand
aucuuaaauuauacccacaag

SEQ ID NO: 24387 - RNA, 21 nt, Artificial Sequence
  Marburg virus siRNA sense strand
ucuuaaauuauacccacaaga

SEQ ID NO: 24388 - RNA, 21 nt, Artificial Sequence
  Marburg virus siRNA sense strand
cuuaaauuauacccacaagag

SEQ ID NO: 24389 - RNA, 21 nt, Artificial Sequence
  Marburg virus siRNA sense strand
uuaaauuauacccacaagaga

SEQ ID NO: 24390 - RNA, 21 nt, Artificial Sequence
  Marburg virus siRNA sense strand
uaaauuauacccacaagagau

SEQ ID NO: 24391 - RNA, 21 nt, Artificial Sequence
  Marburg virus siRNA sense strand
aaauuauacccacaagagaua

SEQ ID NO: 24392 - RNA, 21 nt, Artificial Sequence
  Marburg virus siRNA sense strand
aauuauacccacaagagauac

SEQ ID NO: 24393 - RNA, 21 nt, Artificial Sequence
  Marburg virus siRNA sense strand
auuauacccacaagagauacu

SEQ ID NO: 24394 - RNA, 21 nt, Artificial Sequence
  Marburg virus siRNA sense strand
uuauacccacaagagauacug

SEQ ID NO: 24395 - RNA, 21 nt, Artificial Sequence
  Marburg virus siRNA sense strand
uauacccacaagagauacugu

SEQ ID NO: 24396 - RNA, 21 nt, Artificial Sequence
  Marburg virus siRNA sense strand
auacccacaagagauacuguu

SEQ ID NO: 24397 - RNA, 21 nt, Artificial Sequence
  Marburg virus siRNA sense strand
uacccacaagagauacuguuu

SEQ ID NO: 24398 - RNA, 21 nt, Artificial Sequence
  Marburg virus siRNA sense strand
acccacaagagauacuguuuu

SEQ ID NO: 24399 - RNA, 21 nt, Artificial Sequence
  Marburg virus siRNA sense strand
cccacaagagauacuguuuua

SEQ ID NO: 24400 - RNA, 21 nt, Artificial Sequence
  Marburg virus siRNA sense strand
ccacaagagauacuguuuuaa

SEQ ID NO: 24401 - RNA, 21 nt, Artificial Sequence
  Marburg virus siRNA sense strand
cacaagagauacuguuuuaau

SEQ ID NO: 24402 - RNA, 21 nt, Artificial Sequence
  Marburg virus siRNA sense strand
acaagagauacuguuuuaauu

SEQ ID NO: 24403 - RNA, 21 nt, Artificial Sequence
  Marburg virus siRNA sense strand
caagagauacuguuuuaauua

SEQ ID NO: 24404 - RNA, 21 nt, Artificial Sequence
  Marburg virus siRNA sense strand
aagagauacuguuuuaauuaa

SEQ ID NO: 24405 - RNA, 21 nt, Artificial Sequence
  Marburg virus siRNA sense strand
agagauacuguuuuaauuaag

SEQ ID NO: 24406 - RNA, 21 nt, Artificial Sequence
  Marburg virus siRNA sense strand
gagauacuguuuuaauuaaga

SEQ ID NO: 24407 - RNA, 21 nt, Artificial Sequence
  Marburg virus siRNA sense strand
agauacuguuuuaauuaagaa

SEQ ID NO: 24408 - RNA, 21 nt, Artificial Sequence
  Marburg virus siRNA sense strand
gauacuguuuuaauuaagaaa

SEQ ID NO: 24409 - RNA, 21 nt, Artificial Sequence
  Marburg virus siRNA sense strand
auacuguuuuaauuaagaaaa

SEQ ID NO: 24410 - RNA, 21 nt, Artificial Sequence
  Marburg virus siRNA sense strand
uacuguuuuaauuaagaaaaa

SEQ ID NO: 24411 - RNA, 21 nt, Artificial Sequence
  Marburg virus siRNA sense strand
acuguuuuaauuaagaaaaac

SEQ ID NO: 24412 - RNA, 21 nt, Artificial Sequence
  Marburg virus siRNA sense strand
cuguuuuaauuaagaaaaacu

SEQ ID NO: 24413 - RNA, 21 nt, Artificial Sequence
  Marburg virus siRNA sense strand
uguuuuaauuaagaaaaacua

SEQ ID NO: 24414 - RNA, 21 nt, Artificial Sequence
  Marburg virus siRNA sense strand
guuuuaauuaagaaaaacuau

SEQ ID NO: 24415 - RNA, 21 nt, Artificial Sequence
  Marburg virus siRNA sense strand
uuuuaauuaagaaaaacuaug

SEQ ID NO: 24416 - RNA, 21 nt, Artificial Sequence
  Marburg virus siRNA sense strand
uuuaauuaagaaaaacuauga

SEQ ID NO: 24417 - RNA, 21 nt, Artificial Sequence
  Marburg virus siRNA sense strand
uuaauuaagaaaaacuaugaa

SEQ ID NO: 24418 - RNA, 21 nt, Artificial Sequence
  Marburg virus siRNA sense strand
uaauuaagaaaaacuaugaag

SEQ ID NO: 24419 - RNA, 21 nt, Artificial Sequence
  Marburg virus siRNA sense strand
aauuaagaaaaacuaugaaga

SEQ ID NO: 24420 - RNA, 21 nt, Artificial Sequence
  Marburg virus siRNA sense strand
auuaagaaaaacuaugaagaa

SEQ ID NO: 24421 - RNA, 21 nt, Artificial Sequence
  Marburg virus siRNA sense strand
uuaagaaaaacuaugaagaac

SEQ ID NO: 24422 - RNA, 21 nt, Artificial Sequence
  Marburg virus siRNA sense strand
uaagaaaaacuaugaagaaca

SEQ ID NO: 24423 - RNA, 21 nt, Artificial Sequence
  Marburg virus siRNA sense strand
aagaaaaacuaugaagaacau

SEQ ID NO: 24424 - RNA, 21 nt, Artificial Sequence
  Marburg virus siRNA sense strand
agaaaaacuaugaagaacauu

SEQ ID NO: 24425 - RNA, 21 nt, Artificial Sequence
  Marburg virus siRNA sense strand
gaaaaacuaugaagaacauua

SEQ ID NO: 24426 - RNA, 21 nt, Artificial Sequence
  Marburg virus siRNA sense strand
aaaaacuaugaagaacauuaa

SEQ ID NO: 24427 - RNA, 21 nt, Artificial Sequence
  Marburg virus siRNA sense strand
aaaacuaugaagaacauuaag

SEQ ID NO: 24428 - RNA, 21 nt, Artificial Sequence
  Marburg virus siRNA sense strand
aaacuaugaagaacauuaaga

SEQ ID NO: 24429 - RNA, 21 nt, Artificial Sequence
  Marburg virus siRNA sense strand
aacuaugaagaacauuaagaa

SEQ ID NO: 24430 - RNA, 21 nt, Artificial Sequence
  Marburg virus siRNA sense strand
acuaugaagaacauuaagaag

SEQ ID NO: 24431 - RNA, 21 nt, Artificial Sequence
  Marburg virus siRNA sense strand
cuaugaagaacauuaagaaga

SEQ ID NO: 24432 - RNA, 21 nt, Artificial Sequence
  Marburg virus siRNA sense strand
uaugaagaacauuaagaagau

SEQ ID NO: 24433 - RNA, 21 nt, Artificial Sequence
  Marburg virus siRNA sense strand
augaagaacauuaagaagauc

SEQ ID NO: 24434 - RNA, 21 nt, Artificial Sequence
  Marburg virus siRNA sense strand
ugaagaacauuaagaagaucu

SEQ ID NO: 24435 - RNA, 21 nt, Artificial Sequence
  Marburg virus siRNA sense strand
gaagaacauuaagaagaucuu

SEQ ID NO: 24436 - RNA, 21 nt, Artificial Sequence
  Marburg virus siRNA sense strand
aagaacauuaagaagaucuuu

SEQ ID NO: 24437 - RNA, 21 nt, Artificial Sequence
  Marburg virus siRNA sense strand
agaacauuaagaagaucuuuc

SEQ ID NO: 24438 - RNA, 21 nt, Artificial Sequence
  Marburg virus siRNA sense strand
gaacauuaagaagaucuuucu

SEQ ID NO: 24439 - RNA, 21 nt, Artificial Sequence
  Marburg virus siRNA sense strand
aacauuaagaagaucuuucuc

SEQ ID NO: 24440 - RNA, 21 nt, Artificial Sequence
  Marburg virus siRNA sense strand
acauuaagaagaucuuucucu

SEQ ID NO: 24441 - RNA, 21 nt, Artificial Sequence
  Marburg virus siRNA sense strand
cauuaagaagaucuuucucuc

SEQ ID NO: 24442 - RNA, 21 nt, Artificial Sequence
  Marburg virus siRNA sense strand
auuaagaagaucuuucucucg

SEQ ID NO: 24443 - RNA, 21 nt, Artificial Sequence
  Marburg virus siRNA sense strand
uuaagaagaucuuucucucgu

SEQ ID NO: 24444 - RNA, 21 nt, Artificial Sequence
  Marburg virus siRNA sense strand
uaagaagaucuuucucucgua

SEQ ID NO: 24445 - RNA, 21 nt, Artificial Sequence
  Marburg virus siRNA sense strand
aagaagaucuuucucucguag

SEQ ID NO: 24446 - RNA, 21 nt, Artificial Sequence
  Marburg virus siRNA sense strand
agaagaucuuucucucguagu

SEQ ID NO: 24447 - RNA, 21 nt, Artificial Sequence
  Marburg virus siRNA sense strand
gaagaucuuucucucguagug

SEQ ID NO: 24448 - RNA, 21 nt, Artificial Sequence
  Marburg virus siRNA sense strand
aagaucuuucucucguagugu

SEQ ID NO: 24449 - RNA, 21 nt, Artificial Sequence
  Marburg virus siRNA sense strand
agaucuuucucucguaguguu

SEQ ID NO: 24450 - RNA, 21 nt, Artificial Sequence
  Marburg virus siRNA sense strand
gaucuuucucucguaguguuc

SEQ ID NO: 24451 - RNA, 21 nt, Artificial Sequence
  Marburg virus siRNA sense strand
aucuuucucucguaguguucu

SEQ ID NO: 24452 - RNA, 21 nt, Artificial Sequence
  Marburg virus siRNA sense strand
ucuuucucucguaguguucuu

SEQ ID NO: 24453 - RNA, 21 nt, Artificial Sequence
  Marburg virus siRNA sense strand
cuuucucucguaguguucuuu

SEQ ID NO: 24454 - RNA, 21 nt, Artificial Sequence
  Marburg virus siRNA sense strand
uuucucucguaguguucuuuu

SEQ ID NO: 24455 - RNA, 21 nt, Artificial Sequence
  Marburg virus siRNA sense strand
uucucucguaguguucuuuua

SEQ ID NO: 24456 - RNA, 21 nt, Artificial Sequence
  Marburg virus siRNA sense strand
ucucucguaguguucuuuuac

SEQ ID NO: 24457 - RNA, 21 nt, Artificial Sequence
  Marburg virus siRNA sense strand
cucucguaguguucuuuuacu

SEQ ID NO: 24458 - RNA, 21 nt, Artificial Sequence
  Marburg virus siRNA sense strand
ucucguaguguucuuuuacug

SEQ ID NO: 24459 - RNA, 21 nt, Artificial Sequence
  Marburg virus siRNA sense strand
cucguaguguucuuuuacugg

SEQ ID NO: 24460 - RNA, 21 nt, Artificial Sequence
  Marburg virus siRNA sense strand
ucguaguguucuuuuacugga

SEQ ID NO: 24461 - RNA, 21 nt, Artificial Sequence
  Marburg virus siRNA sense strand
cguaguguucuuuuacuggaa

SEQ ID NO: 24462 - RNA, 21 nt, Artificial Sequence
  Marburg virus siRNA sense strand
guaguguucuuuuacuggaag

SEQ ID NO: 24463 - RNA, 21 nt, Artificial Sequence
  Marburg virus siRNA sense strand
uaguguucuuuuacuggaagg

SEQ ID NO: 24464 - RNA, 21 nt, Artificial Sequence
  Marburg virus siRNA sense strand
aguguucuuuuacuggaagga

SEQ ID NO: 24465 - RNA, 21 nt, Artificial Sequence
  Marburg virus siRNA sense strand
guguucuuuuacuggaaggag

SEQ ID NO: 24466 - RNA, 21 nt, Artificial Sequence
  Marburg virus siRNA sense strand
uguucuuuuacuggaaggagu

SEQ ID NO: 24467 - RNA, 21 nt, Artificial Sequence
  Marburg virus siRNA sense strand
guucuuuuacuggaaggagua

SEQ ID NO: 24468 - RNA, 21 nt, Artificial Sequence
  Marburg virus siRNA sense strand
uucuuuuacuggaaggaguau

SEQ ID NO: 24469 - RNA, 21 nt, Artificial Sequence
  Marburg virus siRNA sense strand
ucuuuuacuggaaggaguauc

SEQ ID NO: 24470 - RNA, 21 nt, Artificial Sequence
  Marburg virus siRNA sense strand
cuuuuacuggaaggaguaucc

SEQ ID NO: 24471 - RNA, 21 nt, Artificial Sequence
  Marburg virus siRNA sense strand
uuuuacuggaaggaguauccc

SEQ ID NO: 24472 - RNA, 21 nt, Artificial Sequence
  Marburg virus siRNA sense strand
uuuacuggaaggaguauccca

SEQ ID NO: 24473 - RNA, 21 nt, Artificial Sequence
  Marburg virus siRNA sense strand
uuacuggaaggaguaucccaa

SEQ ID NO: 24474 - RNA, 21 nt, Artificial Sequence
  Marburg virus siRNA sense strand
uacuggaaggaguaucccaau

SEQ ID NO: 24475 - RNA, 21 nt, Artificial Sequence
  Marburg virus siRNA sense strand
acuggaaggaguaucccaauc

SEQ ID NO: 24476 - RNA, 21 nt, Artificial Sequence
  Marburg virus siRNA sense strand
cuggaaggaguaucccaaucu

SEQ ID NO: 24477 - RNA, 21 nt, Artificial Sequence
  Marburg virus siRNA sense strand
uggaaggaguaucccaaucuc

SEQ ID NO: 24478 - RNA, 21 nt, Artificial Sequence
  Marburg virus siRNA sense strand
ggaaggaguaucccaaucuca

SEQ ID NO: 24479 - RNA, 21 nt, Artificial Sequence
  Marburg virus siRNA sense strand
gaaggaguaucccaaucucag

SEQ ID NO: 24480 - RNA, 21 nt, Artificial Sequence
  Marburg virus siRNA sense strand
aaggaguaucccaaucucagc

SEQ ID NO: 24481 - RNA, 21 nt, Artificial Sequence
  Marburg virus siRNA sense strand
aggaguaucccaaucucagcu

SEQ ID NO: 24482 - RNA, 21 nt, Artificial Sequence
  Marburg virus siRNA sense strand
ggaguaucccaaucucagcuu

SEQ ID NO: 24483 - RNA, 21 nt, Artificial Sequence
  Marburg virus siRNA sense strand
gaguaucccaaucucagcuug

SEQ ID NO: 24484 - RNA, 21 nt, Artificial Sequence
  Marburg virus siRNA sense strand
aguaucccaaucucagcuugu

SEQ ID NO: 24485 - RNA, 21 nt, Artificial Sequence
  Marburg virus siRNA sense strand
guaucccaaucucagcuuguu

SEQ ID NO: 24486 - RNA, 21 nt, Artificial Sequence
  Marburg virus siRNA sense strand
uaucccaaucucagcuuguug

SEQ ID NO: 24487 - RNA, 21 nt, Artificial Sequence
  Marburg virus siRNA sense strand
aucccaaucucagcuuguuga

SEQ ID NO: 24488 - RNA, 21 nt, Artificial Sequence
  Marburg virus siRNA sense strand
ucccaaucucagcuuguugaa

SEQ ID NO: 24489 - RNA, 21 nt, Artificial Sequence
  Marburg virus siRNA sense strand
cccaaucucagcuuguugaau

SEQ ID NO: 24490 - RNA, 21 nt, Artificial Sequence
  Marburg virus siRNA sense strand
ccaaucucagcuuguugaauu

SEQ ID NO: 24491 - RNA, 21 nt, Artificial Sequence
  Marburg virus siRNA sense strand
caaucucagcuuguugaauua

SEQ ID NO: 24492 - RNA, 21 nt, Artificial Sequence
  Marburg virus siRNA sense strand
aaucucagcuuguugaauuaa

SEQ ID NO: 24493 - RNA, 21 nt, Artificial Sequence
  Marburg virus siRNA sense strand
aucucagcuuguugaauuaau

SEQ ID NO: 24494 - RNA, 21 nt, Artificial Sequence
  Marburg virus siRNA sense strand
ucucagcuuguugaauuaauu

SEQ ID NO: 24495 - RNA, 21 nt, Artificial Sequence
  Marburg virus siRNA sense strand
cucagcuuguugaauuaauug

SEQ ID NO: 24496 - RNA, 21 nt, Artificial Sequence
  Marburg virus siRNA sense strand
ucagcuuguugaauuaauugu

SEQ ID NO: 24497 - RNA, 21 nt, Artificial Sequence
  Marburg virus siRNA sense strand
cagcuuguugaauuaauuguu

SEQ ID NO: 24498 - RNA, 21 nt, Artificial Sequence
  Marburg virus siRNA sense strand
agcuuguugaauuaauuguua

SEQ ID NO: 24499 - RNA, 21 nt, Artificial Sequence
  Marburg virus siRNA sense strand
gcuuguugaauuaauuguuac

SEQ ID NO: 24500 - RNA, 21 nt, Artificial Sequence
  Marburg virus siRNA sense strand
cuuguugaauuaauuguuacu

SEQ ID NO: 24501 - RNA, 21 nt, Artificial Sequence
  Marburg virus siRNA sense strand
uuguugaauuaauuguuacuu

SEQ ID NO: 24502 - RNA, 21 nt, Artificial Sequence
  Marburg virus siRNA sense strand
uguugaauuaauuguuacuua

SEQ ID NO: 24503 - RNA, 21 nt, Artificial Sequence
  Marburg virus siRNA sense strand
guugaauuaauuguuacuuaa

SEQ ID NO: 24504 - RNA, 21 nt, Artificial Sequence
  Marburg virus siRNA sense strand
uugaauuaauuguuacuuaag

SEQ ID NO: 24505 - RNA, 21 nt, Artificial Sequence
  Marburg virus siRNA sense strand
ugaauuaauuguuacuuaagu

SEQ ID NO: 24506 - RNA, 21 nt, Artificial Sequence
  Marburg virus siRNA sense strand
gaauuaauuguuacuuaaguc

SEQ ID NO: 24507 - RNA, 21 nt, Artificial Sequence
  Marburg virus siRNA sense strand
aauuaauuguuacuuaaguca

SEQ ID NO: 24508 - RNA, 21 nt, Artificial Sequence
  Marburg virus siRNA sense strand
auuaauuguuacuuaagucau

SEQ ID NO: 24509 - RNA, 21 nt, Artificial Sequence
  Marburg virus siRNA sense strand
uuaauuguuacuuaagucauu

SEQ ID NO: 24510 - RNA, 21 nt, Artificial Sequence
  Marburg virus siRNA sense strand
uaauuguuacuuaagucauuc

SEQ ID NO: 24511 - RNA, 21 nt, Artificial Sequence
  Marburg virus siRNA sense strand
aauuguuacuuaagucauucu

SEQ ID NO: 24512 - RNA, 21 nt, Artificial Sequence
  Marburg virus siRNA sense strand
auuguuacuuaagucauucuu

SEQ ID NO: 24513 - RNA, 21 nt, Artificial Sequence
  Marburg virus siRNA sense strand
uuguuacuuaagucauucuuu

SEQ ID NO: 24514 - RNA, 21 nt, Artificial Sequence
  Marburg virus siRNA sense strand
uguuacuuaagucauucuuuu

SEQ ID NO: 24515 - RNA, 21 nt, Artificial Sequence
  Marburg virus siRNA sense strand
guuacuuaagucauucuuuuu

SEQ ID NO: 24516 - RNA, 21 nt, Artificial Sequence
  Marburg virus siRNA sense strand
uuacuuaagucauucuuuuua

SEQ ID NO: 24517 - RNA, 21 nt, Artificial Sequence
  Marburg virus siRNA sense strand
uacuuaagucauucuuuuuaa

SEQ ID NO: 24518 - RNA, 21 nt, Artificial Sequence
  Marburg virus siRNA sense strand
acuuaagucauucuuuuuaaa

SEQ ID NO: 24519 - RNA, 21 nt, Artificial Sequence
  Marburg virus siRNA sense strand
cuuaagucauucuuuuuaaaa

SEQ ID NO: 24520 - RNA, 21 nt, Artificial Sequence
  Marburg virus siRNA sense strand
uuaagucauucuuuuuaaaau

SEQ ID NO: 24521 - RNA, 21 nt, Artificial Sequence
  Marburg virus siRNA sense strand
uaagucauucuuuuuaaaauu

SEQ ID NO: 24522 - RNA, 21 nt, Artificial Sequence
  Marburg virus siRNA sense strand
aagucauucuuuuuaaaauua

SEQ ID NO: 24523 - RNA, 21 nt, Artificial Sequence
  Marburg virus siRNA sense strand
agucauucuuuuuaaaauuaa

SEQ ID NO: 24524 - RNA, 21 nt, Artificial Sequence
  Marburg virus siRNA sense strand
gucauucuuuuuaaaauuaau

SEQ ID NO: 24525 - RNA, 21 nt, Artificial Sequence
  Marburg virus siRNA sense strand
ucauucuuuuuaaaauuaauu

SEQ ID NO: 24526 - RNA, 21 nt, Artificial Sequence
  Marburg virus siRNA sense strand
cauucuuuuuaaaauuaauuc

SEQ ID NO: 24527 - RNA, 21 nt, Artificial Sequence
  Marburg virus siRNA sense strand
auucuuuuuaaaauuaauuca

SEQ ID NO: 24528 - RNA, 21 nt, Artificial Sequence
  Marburg virus siRNA sense strand
uucuuuuuaaaauuaauucac

SEQ ID NO: 24529 - RNA, 21 nt, Artificial Sequence
  Marburg virus siRNA sense strand
ucuuuuuaaaauuaauucaca

SEQ ID NO: 24530 - RNA, 21 nt, Artificial Sequence
  Marburg virus siRNA sense strand
cuuuuuaaaauuaauucacac

SEQ ID NO: 24531 - RNA, 21 nt, Artificial Sequence
  Marburg virus siRNA sense strand
uuuuuaaaauuaauucacaca

SEQ ID NO: 24532 - RNA, 21 nt, Artificial Sequence
  Marburg virus siRNA sense strand
uuuuaaaauuaauucacacaa

SEQ ID NO: 24533 - RNA, 21 nt, Artificial Sequence
  Marburg virus siRNA sense strand
uuuaaaauuaauucacacaag

SEQ ID NO: 24534 - RNA, 21 nt, Artificial Sequence
  Marburg virus siRNA sense strand
uuaaaauuaauucacacaagg

SEQ ID NO: 24535 - RNA, 21 nt, Artificial Sequence
  Marburg virus siRNA sense strand
uaaaauuaauucacacaaggu

SEQ ID NO: 24536 - RNA, 21 nt, Artificial Sequence
  Marburg virus siRNA sense strand
aaaauuaauucacacaaggua

SEQ ID NO: 24537 - RNA, 21 nt, Artificial Sequence
  Marburg virus siRNA sense strand
aaauuaauucacacaagguag

SEQ ID NO: 24538 - RNA, 21 nt, Artificial Sequence
  Marburg virus siRNA sense strand
aauuaauucacacaagguagu

SEQ ID NO: 24539 - RNA, 21 nt, Artificial Sequence
  Marburg virus siRNA sense strand
auuaauucacacaagguaguu

SEQ ID NO: 24540 - RNA, 21 nt, Artificial Sequence
  Marburg virus siRNA sense strand
uuaauucacacaagguaguuu

SEQ ID NO: 24541 - RNA, 21 nt, Artificial Sequence
  Marburg virus siRNA sense strand
uaauucacacaagguaguuug

SEQ ID NO: 24542 - RNA, 21 nt, Artificial Sequence
  Marburg virus siRNA sense strand
aauucacacaagguaguuugg

SEQ ID NO: 24543 - RNA, 21 nt, Artificial Sequence
  Marburg virus siRNA sense strand
auucacacaagguaguuuggg

SEQ ID NO: 24544 - RNA, 21 nt, Artificial Sequence
  Marburg virus siRNA sense strand
uucacacaagguaguuugggu

SEQ ID NO: 24545 - RNA, 21 nt, Artificial Sequence
  Marburg virus siRNA sense strand
ucacacaagguaguuuggguu

SEQ ID NO: 24546 - RNA, 21 nt, Artificial Sequence
  Marburg virus siRNA sense strand
cacacaagguaguuuggguuu

SEQ ID NO: 24547 - RNA, 21 nt, Artificial Sequence
  Marburg virus siRNA sense strand
acacaagguaguuuggguuua

SEQ ID NO: 24548 - RNA, 21 nt, Artificial Sequence
  Marburg virus siRNA sense strand
cacaagguaguuuggguuuau

SEQ ID NO: 24549 - RNA, 21 nt, Artificial Sequence
  Marburg virus siRNA sense strand
acaagguaguuuggguuuaua

SEQ ID NO: 24550 - RNA, 21 nt, Artificial Sequence
  Marburg virus siRNA sense strand
caagguaguuuggguuuauau

SEQ ID NO: 24551 - RNA, 21 nt, Artificial Sequence
  Marburg virus siRNA sense strand
aagguaguuuggguuuauauc

SEQ ID NO: 24552 - RNA, 21 nt, Artificial Sequence
  Marburg virus siRNA sense strand
agguaguuuggguuuauaucu

SEQ ID NO: 24553 - RNA, 21 nt, Artificial Sequence
  Marburg virus siRNA sense strand
gguaguuuggguuuauaucua

SEQ ID NO: 24554 - RNA, 21 nt, Artificial Sequence
  Marburg virus siRNA sense strand
guaguuuggguuuauaucuag

SEQ ID NO: 24555 - RNA, 21 nt, Artificial Sequence
  Marburg virus siRNA sense strand
uaguuuggguuuauaucuaga

SEQ ID NO: 24556 - RNA, 21 nt, Artificial Sequence
  Marburg virus siRNA sense strand
aguuuggguuuauaucuagaa

SEQ ID NO: 24557 - RNA, 21 nt, Artificial Sequence
  Marburg virus siRNA sense strand
guuuggguuuauaucuagaac

SEQ ID NO: 24558 - RNA, 21 nt, Artificial Sequence
  Marburg virus siRNA sense strand
uuuggguuuauaucuagaaca

SEQ ID NO: 24559 - RNA, 21 nt, Artificial Sequence
  Marburg virus siRNA sense strand
uuggguuuauaucuagaacaa

SEQ ID NO: 24560 - RNA, 21 nt, Artificial Sequence
  Marburg virus siRNA sense strand
uggguuuauaucuagaacaaa

SEQ ID NO: 24561 - RNA, 21 nt, Artificial Sequence
  Marburg virus siRNA sense strand
ggguuuauaucuagaacaaau

SEQ ID NO: 24562 - RNA, 21 nt, Artificial Sequence
  Marburg virus siRNA sense strand
gguuuauaucuagaacaaauu

SEQ ID NO: 24563 - RNA, 21 nt, Artificial Sequence
  Marburg virus siRNA sense strand
guuuauaucuagaacaaauuu

SEQ ID NO: 24564 - RNA, 21 nt, Artificial Sequence
  Marburg virus siRNA sense strand
uuuauaucuagaacaaauuuu

SEQ ID NO: 24565 - RNA, 21 nt, Artificial Sequence
  Marburg virus siRNA sense strand
uuauaucuagaacaaauuuua

SEQ ID NO: 24566 - RNA, 21 nt, Artificial Sequence
  Marburg virus siRNA sense strand
uauaucuagaacaaauuuuaa

SEQ ID NO: 24567 - RNA, 21 nt, Artificial Sequence
  Marburg virus siRNA sense strand
auaucuagaacaaauuuuaau

SEQ ID NO: 24568 - RNA, 21 nt, Artificial Sequence
  Marburg virus siRNA sense strand
uaucuagaacaaauuuuaaua

SEQ ID NO: 24569 - RNA, 21 nt, Artificial Sequence
  Marburg virus siRNA sense strand
aucuagaacaaauuuuaauau

SEQ ID NO: 24570 - RNA, 21 nt, Artificial Sequence
  Marburg virus siRNA sense strand
ucuagaacaaauuuuaauaug

SEQ ID NO: 24571 - RNA, 21 nt, Artificial Sequence
  Marburg virus siRNA sense strand
cuagaacaaauuuuaauaugg

SEQ ID NO: 24572 - RNA, 21 nt, Artificial Sequence
  Marburg virus siRNA sense strand
uagaacaaauuuuaauauggc

SEQ ID NO: 24573 - RNA, 21 nt, Artificial Sequence
  Marburg virus siRNA sense strand
agaacaaauuuuaauauggcc

SEQ ID NO: 24574 - RNA, 21 nt, Artificial Sequence
  Marburg virus siRNA sense strand
gaacaaauuuuaauauggcca

SEQ ID NO: 24575 - RNA, 21 nt, Artificial Sequence
  Marburg virus siRNA sense strand
aacaaauuuuaauauggccag

SEQ ID NO: 24576 - RNA, 21 nt, Artificial Sequence
  Marburg virus siRNA sense strand
acaaauuuuaauauggccagu

SEQ ID NO: 24577 - RNA, 21 nt, Artificial Sequence
  Marburg virus siRNA sense strand
caaauuuuaauauggccaguu

SEQ ID NO: 24578 - RNA, 21 nt, Artificial Sequence
  Marburg virus siRNA sense strand
aaauuuuaauauggccaguuc

SEQ ID NO: 24579 - RNA, 21 nt, Artificial Sequence
  Marburg virus siRNA sense strand
aauuuuaauauggccaguucc

SEQ ID NO: 24580 - RNA, 21 nt, Artificial Sequence
  Marburg virus siRNA sense strand
auuuuaauauggccaguucca

SEQ ID NO: 24581 - RNA, 21 nt, Artificial Sequence
  Marburg virus siRNA sense strand
uuuuaauauggccaguuccag

SEQ ID NO: 24582 - RNA, 21 nt, Artificial Sequence
  Marburg virus siRNA sense strand
uuuaauauggccaguuccagc

SEQ ID NO: 24583 - RNA, 21 nt, Artificial Sequence
  Marburg virus siRNA sense strand
uuaauauggccaguuccagca

SEQ ID NO: 24584 - RNA, 21 nt, Artificial Sequence
  Marburg virus siRNA sense strand
uaauauggccaguuccagcaa

SEQ ID NO: 24585 - RNA, 21 nt, Artificial Sequence
  Marburg virus siRNA sense strand
aauauggccaguuccagcaau

SEQ ID NO: 24586 - RNA, 21 nt, Artificial Sequence
  Marburg virus siRNA sense strand
auauggccaguuccagcaauu

SEQ ID NO: 24587 - RNA, 21 nt, Artificial Sequence
  Marburg virus siRNA sense strand
uauggccaguuccagcaauua

SEQ ID NO: 24588 - RNA, 21 nt, Artificial Sequence
  Marburg virus siRNA sense strand
auggccaguuccagcaauuac

SEQ ID NO: 24589 - RNA, 21 nt, Artificial Sequence
  Marburg virus siRNA sense strand
uggccaguuccagcaauuaca

SEQ ID NO: 24590 - RNA, 21 nt, Artificial Sequence
  Marburg virus siRNA sense strand
ggccaguuccagcaauuacaa

SEQ ID NO: 24591 - RNA, 21 nt, Artificial Sequence
  Marburg virus siRNA sense strand
gccaguuccagcaauuacaac

SEQ ID NO: 24592 - RNA, 21 nt, Artificial Sequence
  Marburg virus siRNA sense strand
ccaguuccagcaauuacaaca

SEQ ID NO: 24593 - RNA, 21 nt, Artificial Sequence
  Marburg virus siRNA sense strand
caguuccagcaauuacaacac

SEQ ID NO: 24594 - RNA, 21 nt, Artificial Sequence
  Marburg virus siRNA sense strand
aguuccagcaauuacaacaca

SEQ ID NO: 24595 - RNA, 21 nt, Artificial Sequence
  Marburg virus siRNA sense strand
guuccagcaauuacaacacau

SEQ ID NO: 24596 - RNA, 21 nt, Artificial Sequence
  Marburg virus siRNA sense strand
uuccagcaauuacaacacaua

SEQ ID NO: 24597 - RNA, 21 nt, Artificial Sequence
  Marburg virus siRNA sense strand
uccagcaauuacaacacauac

SEQ ID NO: 24598 - RNA, 21 nt, Artificial Sequence
  Marburg virus siRNA sense strand
ccagcaauuacaacacauaca

SEQ ID NO: 24599 - RNA, 21 nt, Artificial Sequence
  Marburg virus siRNA sense strand
cagcaauuacaacacauacau

SEQ ID NO: 24600 - RNA, 21 nt, Artificial Sequence
  Marburg virus siRNA sense strand
agcaauuacaacacauacaug

SEQ ID NO: 24601 - RNA, 21 nt, Artificial Sequence
  Marburg virus siRNA sense strand
gcaauuacaacacauacaugc

SEQ ID NO: 24602 - RNA, 21 nt, Artificial Sequence
  Marburg virus siRNA sense strand
caauuacaacacauacaugca

SEQ ID NO: 24603 - RNA, 21 nt, Artificial Sequence
  Marburg virus siRNA sense strand
aauuacaacacauacaugcaa

SEQ ID NO: 24604 - RNA, 21 nt, Artificial Sequence
  Marburg virus siRNA sense strand
auuacaacacauacaugcaau

SEQ ID NO: 24605 - RNA, 21 nt, Artificial Sequence
  Marburg virus siRNA sense strand
uuacaacacauacaugcaaua

SEQ ID NO: 24606 - RNA, 21 nt, Artificial Sequence
  Marburg virus siRNA sense strand
uacaacacauacaugcaauac

SEQ ID NO: 24607 - RNA, 21 nt, Artificial Sequence
  Marburg virus siRNA sense strand
acaacacauacaugcaauacu

SEQ ID NO: 24608 - RNA, 21 nt, Artificial Sequence
  Marburg virus siRNA sense strand
caacacauacaugcaauacuu

SEQ ID NO: 24609 - RNA, 21 nt, Artificial Sequence
  Marburg virus siRNA sense strand
aacacauacaugcaauacuug

SEQ ID NO: 24610 - RNA, 21 nt, Artificial Sequence
  Marburg virus siRNA sense strand
acacauacaugcaauacuuga

SEQ ID NO: 24611 - RNA, 21 nt, Artificial Sequence
  Marburg virus siRNA sense strand
cacauacaugcaauacuugaa

SEQ ID NO: 24612 - RNA, 21 nt, Artificial Sequence
  Marburg virus siRNA sense strand
acauacaugcaauacuugaac

SEQ ID NO: 24613 - RNA, 21 nt, Artificial Sequence
  Marburg virus siRNA sense strand
cauacaugcaauacuugaacc

SEQ ID NO: 24614 - RNA, 21 nt, Artificial Sequence
  Marburg virus siRNA sense strand
auacaugcaauacuugaaccc

SEQ ID NO: 24615 - RNA, 21 nt, Artificial Sequence
  Marburg virus siRNA sense strand
uacaugcaauacuugaacccc

SEQ ID NO: 24616 - RNA, 21 nt, Artificial Sequence
  Marburg virus siRNA sense strand
acaugcaauacuugaaccccc

SEQ ID NO: 24617 - RNA, 21 nt, Artificial Sequence
  Marburg virus siRNA sense strand
caugcaauacuugaacccccc

SEQ ID NO: 24618 - RNA, 21 nt, Artificial Sequence
  Marburg virus siRNA sense strand
augcaauacuugaaccccccu

SEQ ID NO: 24619 - RNA, 21 nt, Artificial Sequence
  Marburg virus siRNA sense strand
ugcaauacuugaaccccccuc

SEQ ID NO: 24620 - RNA, 21 nt, Artificial Sequence
  Marburg virus siRNA sense strand
gcaauacuugaaccccccucc

SEQ ID NO: 24621 - RNA, 21 nt, Artificial Sequence
  Marburg virus siRNA sense strand
caauacuugaaccccccuccu

SEQ ID NO: 24622 - RNA, 21 nt, Artificial Sequence
  Marburg virus siRNA sense strand
aauacuugaaccccccuccuu

SEQ ID NO: 24623 - RNA, 21 nt, Artificial Sequence
  Marburg virus siRNA sense strand
auacuugaaccccccuccuua

SEQ ID NO: 24624 - RNA, 21 nt, Artificial Sequence
  Marburg virus siRNA sense strand
uacuugaaccccccuccuuau

SEQ ID NO: 24625 - RNA, 21 nt, Artificial Sequence
  Marburg virus siRNA sense strand
acuugaaccccccuccuuaug

SEQ ID NO: 24626 - RNA, 21 nt, Artificial Sequence
  Marburg virus siRNA sense strand
cuugaaccccccuccuuaugc

SEQ ID NO: 24627 - RNA, 21 nt, Artificial Sequence
  Marburg virus siRNA sense strand
uugaaccccccuccuuaugcu

SEQ ID NO: 24628 - RNA, 21 nt, Artificial Sequence
  Marburg virus siRNA sense strand
ugaaccccccuccuuaugcug

SEQ ID NO: 24629 - RNA, 21 nt, Artificial Sequence
  Marburg virus siRNA sense strand
gaaccccccuccuuaugcuga

SEQ ID NO: 24630 - RNA, 21 nt, Artificial Sequence
  Marburg virus siRNA sense strand
aaccccccuccuuaugcugau

SEQ ID NO: 24631 - RNA, 21 nt, Artificial Sequence
  Marburg virus siRNA sense strand
accccccuccuuaugcugauc

SEQ ID NO: 24632 - RNA, 21 nt, Artificial Sequence
  Marburg virus siRNA sense strand
ccccccuccuuaugcugauca

SEQ ID NO: 24633 - RNA, 21 nt, Artificial Sequence
  Marburg virus siRNA sense strand
cccccuccuuaugcugaucac

SEQ ID NO: 24634 - RNA, 21 nt, Artificial Sequence
  Marburg virus siRNA sense strand
ccccuccuuaugcugaucacg

SEQ ID NO: 24635 - RNA, 21 nt, Artificial Sequence
  Marburg virus siRNA sense strand
cccuccuuaugcugaucacgg

SEQ ID NO: 24636 - RNA, 21 nt, Artificial Sequence
  Marburg virus siRNA sense strand
ccuccuuaugcugaucacggu

SEQ ID NO: 24637 - RNA, 21 nt, Artificial Sequence
  Marburg virus siRNA sense strand
cuccuuaugcugaucacggug

SEQ ID NO: 24638 - RNA, 21 nt, Artificial Sequence
  Marburg virus siRNA sense strand
uccuuaugcugaucacggugc

SEQ ID NO: 24639 - RNA, 21 nt, Artificial Sequence
  Marburg virus siRNA sense strand
ccuuaugcugaucacggugca

SEQ ID NO: 24640 - RNA, 21 nt, Artificial Sequence
  Marburg virus siRNA sense strand
cuuaugcugaucacggugcaa

SEQ ID NO: 24641 - RNA, 21 nt, Artificial Sequence
  Marburg virus siRNA sense strand
uuaugcugaucacggugcaaa

SEQ ID NO: 24642 - RNA, 21 nt, Artificial Sequence
  Marburg virus siRNA sense strand
uaugcugaucacggugcaaac

SEQ ID NO: 24643 - RNA, 21 nt, Artificial Sequence
  Marburg virus siRNA sense strand
augcugaucacggugcaaacc

SEQ ID NO: 24644 - RNA, 21 nt, Artificial Sequence
  Marburg virus siRNA sense strand
ugcugaucacggugcaaacca

SEQ ID NO: 24645 - RNA, 21 nt, Artificial Sequence
  Marburg virus siRNA sense strand
gcugaucacggugcaaaccag

SEQ ID NO: 24646 - RNA, 21 nt, Artificial Sequence
  Marburg virus siRNA sense strand
cugaucacggugcaaaccagu

SEQ ID NO: 24647 - RNA, 21 nt, Artificial Sequence
  Marburg virus siRNA sense strand
ugaucacggugcaaaccaguu

SEQ ID NO: 24648 - RNA, 21 nt, Artificial Sequence
  Marburg virus siRNA sense strand
gaucacggugcaaaccaguug

SEQ ID NO: 24649 - RNA, 21 nt, Artificial Sequence
  Marburg virus siRNA sense strand
aucacggugcaaaccaguuga

SEQ ID NO: 24650 - RNA, 21 nt, Artificial Sequence
  Marburg virus siRNA sense strand
ucacggugcaaaccaguugau

SEQ ID NO: 24651 - RNA, 21 nt, Artificial Sequence
  Marburg virus siRNA sense strand
cacggugcaaaccaguugauc

SEQ ID NO: 24652 - RNA, 21 nt, Artificial Sequence
  Marburg virus siRNA sense strand
acggugcaaaccaguugaucc

SEQ ID NO: 24653 - RNA, 21 nt, Artificial Sequence
  Marburg virus siRNA sense strand
cggugcaaaccaguugauccc

SEQ ID NO: 24654 - RNA, 21 nt, Artificial Sequence
  Marburg virus siRNA sense strand
ggugcaaaccaguugaucccg

SEQ ID NO: 24655 - RNA, 21 nt, Artificial Sequence
  Marburg virus siRNA sense strand
gugcaaaccaguugaucccgg

SEQ ID NO: 24656 - RNA, 21 nt, Artificial Sequence
  Marburg virus siRNA sense strand
ugcaaaccaguugaucccggc

SEQ ID NO: 24657 - RNA, 21 nt, Artificial Sequence
  Marburg virus siRNA sense strand
gcaaaccaguugaucccggcg

SEQ ID NO: 24658 - RNA, 21 nt, Artificial Sequence
  Marburg virus siRNA sense strand
caaaccaguugaucccggcgg

SEQ ID NO: 24659 - RNA, 21 nt, Artificial Sequence
  Marburg virus siRNA sense strand
aaaccaguugaucccggcgga

SEQ ID NO: 24660 - RNA, 21 nt, Artificial Sequence
  Marburg virus siRNA sense strand
aaccaguugaucccggcggau

SEQ ID NO: 24661 - RNA, 21 nt, Artificial Sequence
  Marburg virus siRNA sense strand
accaguugaucccggcggauc

SEQ ID NO: 24662 - RNA, 21 nt, Artificial Sequence
  Marburg virus siRNA sense strand
ccaguugaucccggcggauca

SEQ ID NO: 24663 - RNA, 21 nt, Artificial Sequence
  Marburg virus siRNA sense strand
caguugaucccggcggaucag

SEQ ID NO: 24664 - RNA, 21 nt, Artificial Sequence
  Marburg virus siRNA sense strand
aguugaucccggcggaucagc

SEQ ID NO: 24665 - RNA, 21 nt, Artificial Sequence
  Marburg virus siRNA sense strand
guugaucccggcggaucagcu

SEQ ID NO: 24666 - RNA, 21 nt, Artificial Sequence
  Marburg virus siRNA sense strand
uugaucccggcggaucagcua

SEQ ID NO: 24667 - RNA, 21 nt, Artificial Sequence
  Marburg virus siRNA sense strand
ugaucccggcggaucagcuau

SEQ ID NO: 24668 - RNA, 21 nt, Artificial Sequence
  Marburg virus siRNA sense strand
gaucccggcggaucagcuauc

SEQ ID NO: 24669 - RNA, 21 nt, Artificial Sequence
  Marburg virus siRNA sense strand
aucccggcggaucagcuauca

SEQ ID NO: 24670 - RNA, 21 nt, Artificial Sequence
  Marburg virus siRNA sense strand
ucccggcggaucagcuaucaa

SEQ ID NO: 24671 - RNA, 21 nt, Artificial Sequence
  Marburg virus siRNA sense strand
cccggcggaucagcuaucaaa

SEQ ID NO: 24672 - RNA, 21 nt, Artificial Sequence
  Marburg virus siRNA sense strand
ccggcggaucagcuaucaaau

SEQ ID NO: 24673 - RNA, 21 nt, Artificial Sequence
  Marburg virus siRNA sense strand
cggcggaucagcuaucaaauc

SEQ ID NO: 24674 - RNA, 21 nt, Artificial Sequence
  Marburg virus siRNA sense strand
ggcggaucagcuaucaaauca

SEQ ID NO: 24675 - RNA, 21 nt, Artificial Sequence
  Marburg virus siRNA sense strand
gcggaucagcuaucaaaucag

SEQ ID NO: 24676 - RNA, 21 nt, Artificial Sequence
  Marburg virus siRNA sense strand
cggaucagcuaucaaaucagc

SEQ ID NO: 24677 - RNA, 21 nt, Artificial Sequence
  Marburg virus siRNA sense strand
ggaucagcuaucaaaucagca

SEQ ID NO: 24678 - RNA, 21 nt, Artificial Sequence
  Marburg virus siRNA sense strand
gaucagcuaucaaaucagcag

SEQ ID NO: 24679 - RNA, 21 nt, Artificial Sequence
  Marburg virus siRNA sense strand
aucagcuaucaaaucagcagg

SEQ ID NO: 24680 - RNA, 21 nt, Artificial Sequence
  Marburg virus siRNA sense strand
ucagcuaucaaaucagcaggg

SEQ ID NO: 24681 - RNA, 21 nt, Artificial Sequence
  Marburg virus siRNA sense strand
cagcuaucaaaucagcagggu

SEQ ID NO: 24682 - RNA, 21 nt, Artificial Sequence
  Marburg virus siRNA sense strand
agcuaucaaaucagcagggua

SEQ ID NO: 24683 - RNA, 21 nt, Artificial Sequence
  Marburg virus siRNA sense strand
gcuaucaaaucagcaggguau

SEQ ID NO: 24684 - RNA, 21 nt, Artificial Sequence
  Marburg virus siRNA sense strand
cuaucaaaucagcaggguaua

SEQ ID NO: 24685 - RNA, 21 nt, Artificial Sequence
  Marburg virus siRNA sense strand
uaucaaaucagcaggguauaa

SEQ ID NO: 24686 - RNA, 21 nt, Artificial Sequence
  Marburg virus siRNA sense strand
aucaaaucagcaggguauaac

SEQ ID NO: 24687 - RNA, 21 nt, Artificial Sequence
  Marburg virus siRNA sense strand
ucaaaucagcaggguauaacu

SEQ ID NO: 24688 - RNA, 21 nt, Artificial Sequence
  Marburg virus siRNA sense strand
caaaucagcaggguauaacuc

SEQ ID NO: 24689 - RNA, 21 nt, Artificial Sequence
  Marburg virus siRNA sense strand
aaaucagcaggguauaacucc

SEQ ID NO: 24690 - RNA, 21 nt, Artificial Sequence
  Marburg virus siRNA sense strand
aaucagcaggguauaacucca

SEQ ID NO: 24691 - RNA, 21 nt, Artificial Sequence
  Marburg virus siRNA sense strand
aucagcaggguauaacuccaa

SEQ ID NO: 24692 - RNA, 21 nt, Artificial Sequence
  Marburg virus siRNA sense strand
ucagcaggguauaacuccaaa

SEQ ID NO: 24693 - RNA, 21 nt, Artificial Sequence
  Marburg virus siRNA sense strand
cagcaggguauaacuccaaau

SEQ ID NO: 24694 - RNA, 21 nt, Artificial Sequence
  Marburg virus siRNA sense strand
agcaggguauaacuccaaauu

SEQ ID NO: 24695 - RNA, 21 nt, Artificial Sequence
  Marburg virus siRNA sense strand
gcaggguauaacuccaaauua

SEQ ID NO: 24696 - RNA, 21 nt, Artificial Sequence
  Marburg virus siRNA sense strand
caggguauaacuccaaauuau

SEQ ID NO: 24697 - RNA, 21 nt, Artificial Sequence
  Marburg virus siRNA sense strand
aggguauaacuccaaauuaug

SEQ ID NO: 24698 - RNA, 21 nt, Artificial Sequence
  Marburg virus siRNA sense strand
ggguauaacuccaaauuaugu

SEQ ID NO: 24699 - RNA, 21 nt, Artificial Sequence
  Marburg virus siRNA sense strand
gguauaacuccaaauuaugug

SEQ ID NO: 24700 - RNA, 21 nt, Artificial Sequence
  Marburg virus siRNA sense strand
guauaacuccaaauuaugugg

SEQ ID NO: 24701 - RNA, 21 nt, Artificial Sequence
  Marburg virus siRNA sense strand
uauaacuccaaauuauguggg

SEQ ID NO: 24702 - RNA, 21 nt, Artificial Sequence
  Marburg virus siRNA sense strand
auaacuccaaauuaugugggu

SEQ ID NO: 24703 - RNA, 21 nt, Artificial Sequence
  Marburg virus siRNA sense strand
uaacuccaaauuaugugggug

SEQ ID NO: 24704 - RNA, 21 nt, Artificial Sequence
  Marburg virus siRNA sense strand
aacuccaaauuauguggguga

SEQ ID NO: 24705 - RNA, 21 nt, Artificial Sequence
  Marburg virus siRNA sense strand
acuccaaauuaugugggugac

SEQ ID NO: 24706 - RNA, 21 nt, Artificial Sequence
  Marburg virus siRNA sense strand
cuccaaauuaugugggugacu

SEQ ID NO: 24707 - RNA, 21 nt, Artificial Sequence
  Marburg virus siRNA sense strand
uccaaauuaugugggugacuu

SEQ ID NO: 24708 - RNA, 21 nt, Artificial Sequence
  Marburg virus siRNA sense strand
ccaaauuaugugggugacuua

SEQ ID NO: 24709 - RNA, 21 nt, Artificial Sequence
  Marburg virus siRNA sense strand
caaauuaugugggugacuuaa

SEQ ID NO: 24710 - RNA, 21 nt, Artificial Sequence
  Marburg virus siRNA sense strand
aaauuaugugggugacuuaaa

SEQ ID NO: 24711 - RNA, 21 nt, Artificial Sequence
  Marburg virus siRNA sense strand
aauuaugugggugacuuaaac

SEQ ID NO: 24712 - RNA, 21 nt, Artificial Sequence
  Marburg virus siRNA sense strand
auuaugugggugacuuaaacc

SEQ ID NO: 24713 - RNA, 21 nt, Artificial Sequence
  Marburg virus siRNA sense strand
uuaugugggugacuuaaaccu

SEQ ID NO: 24714 - RNA, 21 nt, Artificial Sequence
  Marburg virus siRNA sense strand
uaugugggugacuuaaaccua

SEQ ID NO: 24715 - RNA, 21 nt, Artificial Sequence
  Marburg virus siRNA sense strand
augugggugacuuaaaccuag

SEQ ID NO: 24716 - RNA, 21 nt, Artificial Sequence
  Marburg virus siRNA sense strand
ugugggugacuuaaaccuaga

SEQ ID NO: 24717 - RNA, 21 nt, Artificial Sequence
  Marburg virus siRNA sense strand
gugggugacuuaaaccuagau

SEQ ID NO: 24718 - RNA, 21 nt, Artificial Sequence
  Marburg virus siRNA sense strand
ugggugacuuaaaccuagaug

SEQ ID NO: 24719 - RNA, 21 nt, Artificial Sequence
  Marburg virus siRNA sense strand
gggugacuuaaaccuagauga

SEQ ID NO: 24720 - RNA, 21 nt, Artificial Sequence
  Marburg virus siRNA sense strand
ggugacuuaaaccuagaugau

SEQ ID NO: 24721 - RNA, 21 nt, Artificial Sequence
  Marburg virus siRNA sense strand
gugacuuaaaccuagaugauc

SEQ ID NO: 24722 - RNA, 21 nt, Artificial Sequence
  Marburg virus siRNA sense strand
ugacuuaaaccuagaugauca

SEQ ID NO: 24723 - RNA, 21 nt, Artificial Sequence
  Marburg virus siRNA sense strand
gacuuaaaccuagaugaucag

SEQ ID NO: 24724 - RNA, 21 nt, Artificial Sequence
  Marburg virus siRNA sense strand
acuuaaaccuagaugaucagu

SEQ ID NO: 24725 - RNA, 21 nt, Artificial Sequence
  Marburg virus siRNA sense strand
cuuaaaccuagaugaucaguu

SEQ ID NO: 24726 - RNA, 21 nt, Artificial Sequence
  Marburg virus siRNA sense strand
uuaaaccuagaugaucaguuc

SEQ ID NO: 24727 - RNA, 21 nt, Artificial Sequence
  Marburg virus siRNA sense strand
uaaaccuagaugaucaguuca

SEQ ID NO: 24728 - RNA, 21 nt, Artificial Sequence
  Marburg virus siRNA sense strand
aaaccuagaugaucaguucaa

SEQ ID NO: 24729 - RNA, 21 nt, Artificial Sequence
  Marburg virus siRNA sense strand
aaccuagaugaucaguucaaa

SEQ ID NO: 24730 - RNA, 21 nt, Artificial Sequence
  Marburg virus siRNA sense strand
accuagaugaucaguucaaag

SEQ ID NO: 24731 - RNA, 21 nt, Artificial Sequence
  Marburg virus siRNA sense strand
ccuagaugaucaguucaaagg

SEQ ID NO: 24732 - RNA, 21 nt, Artificial Sequence
  Marburg virus siRNA sense strand
cuagaugaucaguucaaaggg

SEQ ID NO: 24733 - RNA, 21 nt, Artificial Sequence
  Marburg virus siRNA sense strand
uagaugaucaguucaaaggga

SEQ ID NO: 24734 - RNA, 21 nt, Artificial Sequence
  Marburg virus siRNA sense strand
agaugaucaguucaaagggaa

SEQ ID NO: 24735 - RNA, 21 nt, Artificial Sequence
  Marburg virus siRNA sense strand
gaugaucaguucaaagggaau

SEQ ID NO: 24736 - RNA, 21 nt, Artificial Sequence
  Marburg virus siRNA sense strand
augaucaguucaaagggaaug

SEQ ID NO: 24737 - RNA, 21 nt, Artificial Sequence
  Marburg virus siRNA sense strand
ugaucaguucaaagggaaugu

SEQ ID NO: 24738 - RNA, 21 nt, Artificial Sequence
  Marburg virus siRNA sense strand
gaucaguucaaagggaauguc

SEQ ID NO: 24739 - RNA, 21 nt, Artificial Sequence
  Marburg virus siRNA sense strand
aucaguucaaagggaaugucu

SEQ ID NO: 24740 - RNA, 21 nt, Artificial Sequence
  Marburg virus siRNA sense strand
ucaguucaaagggaaugucug

SEQ ID NO: 24741 - RNA, 21 nt, Artificial Sequence
  Marburg virus siRNA sense strand
caguucaaagggaaugucugc

SEQ ID NO: 24742 - RNA, 21 nt, Artificial Sequence
  Marburg virus siRNA sense strand
aguucaaagggaaugucugcc

SEQ ID NO: 24743 - RNA, 21 nt, Artificial Sequence
  Marburg virus siRNA sense strand
guucaaagggaaugucugcca

SEQ ID NO: 24744 - RNA, 21 nt, Artificial Sequence
  Marburg virus siRNA sense strand
uucaaagggaaugucugccau

SEQ ID NO: 24745 - RNA, 21 nt, Artificial Sequence
  Marburg virus siRNA sense strand
ucaaagggaaugucugccaug

SEQ ID NO: 24746 - RNA, 21 nt, Artificial Sequence
  Marburg virus siRNA sense strand
caaagggaaugucugccaugc

SEQ ID NO: 24747 - RNA, 21 nt, Artificial Sequence
  Marburg virus siRNA sense strand
aaagggaaugucugccaugcu

SEQ ID NO: 24748 - RNA, 21 nt, Artificial Sequence
  Marburg virus siRNA sense strand
aagggaaugucugccaugcuu

SEQ ID NO: 24749 - RNA, 21 nt, Artificial Sequence
  Marburg virus siRNA sense strand
agggaaugucugccaugcuuu

SEQ ID NO: 24750 - RNA, 21 nt, Artificial Sequence
  Marburg virus siRNA sense strand
gggaaugucugccaugcuuuc

SEQ ID NO: 24751 - RNA, 21 nt, Artificial Sequence
  Marburg virus siRNA sense strand
ggaaugucugccaugcuuuca

SEQ ID NO: 24752 - RNA, 21 nt, Artificial Sequence
  Marburg virus siRNA sense strand
gaaugucugccaugcuuucac

SEQ ID NO: 24753 - RNA, 21 nt, Artificial Sequence
  Marburg virus siRNA sense strand
aaugucugccaugcuuucacu

SEQ ID NO: 24754 - RNA, 21 nt, Artificial Sequence
  Marburg virus siRNA sense strand
augucugccaugcuuucacuu

SEQ ID NO: 24755 - RNA, 21 nt, Artificial Sequence
  Marburg virus siRNA sense strand
ugucugccaugcuuucacuuu

SEQ ID NO: 24756 - RNA, 21 nt, Artificial Sequence
  Marburg virus siRNA sense strand
gucugccaugcuuucacuuua

SEQ ID NO: 24757 - RNA, 21 nt, Artificial Sequence
  Marburg virus siRNA sense strand
ucugccaugcuuucacuuuag

SEQ ID NO: 24758 - RNA, 21 nt, Artificial Sequence
  Marburg virus siRNA sense strand
cugccaugcuuucacuuuaga

SEQ ID NO: 24759 - RNA, 21 nt, Artificial Sequence
  Marburg virus siRNA sense strand
ugccaugcuuucacuuuagag

SEQ ID NO: 24760 - RNA, 21 nt, Artificial Sequence
  Marburg virus siRNA sense strand
gccaugcuuucacuuuagagg

SEQ ID NO: 24761 - RNA, 21 nt, Artificial Sequence
  Marburg virus siRNA sense strand
ccaugcuuucacuuuagaggc

SEQ ID NO: 24762 - RNA, 21 nt, Artificial Sequence
  Marburg virus siRNA sense strand
caugcuuucacuuuagaggca

SEQ ID NO: 24763 - RNA, 21 nt, Artificial Sequence
  Marburg virus siRNA sense strand
augcuuucacuuuagaggcaa

SEQ ID NO: 24764 - RNA, 21 nt, Artificial Sequence
  Marburg virus siRNA sense strand
ugcuuucacuuuagaggcaau

SEQ ID NO: 24765 - RNA, 21 nt, Artificial Sequence
  Marburg virus siRNA sense strand
gcuuucacuuuagaggcaaua

SEQ ID NO: 24766 - RNA, 21 nt, Artificial Sequence
  Marburg virus siRNA sense strand
cuuucacuuuagaggcaauaa

SEQ ID NO: 24767 - RNA, 21 nt, Artificial Sequence
  Marburg virus siRNA sense strand
uuucacuuuagaggcaauaau

SEQ ID NO: 24768 - RNA, 21 nt, Artificial Sequence
  Marburg virus siRNA sense strand
uucacuuuagaggcaauaauu

SEQ ID NO: 24769 - RNA, 21 nt, Artificial Sequence
  Marburg virus siRNA sense strand
ucacuuuagaggcaauaauug

SEQ ID NO: 24770 - RNA, 21 nt, Artificial Sequence
  Marburg virus siRNA sense strand
cacuuuagaggcaauaauuga

SEQ ID NO: 24771 - RNA, 21 nt, Artificial Sequence
  Marburg virus siRNA sense strand
acuuuagaggcaauaauugac

SEQ ID NO: 24772 - RNA, 21 nt, Artificial Sequence
  Marburg virus siRNA sense strand
cuuuagaggcaauaauugaca

SEQ ID NO: 24773 - RNA, 21 nt, Artificial Sequence
  Marburg virus siRNA sense strand
uuuagaggcaauaauugacau

SEQ ID NO: 24774 - RNA, 21 nt, Artificial Sequence
  Marburg virus siRNA sense strand
uuagaggcaauaauugacaua

SEQ ID NO: 24775 - RNA, 21 nt, Artificial Sequence
  Marburg virus siRNA sense strand
uagaggcaauaauugacauau

SEQ ID NO: 24776 - RNA, 21 nt, Artificial Sequence
  Marburg virus siRNA sense strand
agaggcaauaauugacauauc

SEQ ID NO: 24777 - RNA, 21 nt, Artificial Sequence
  Marburg virus siRNA sense strand
gaggcaauaauugacauaucu

SEQ ID NO: 24778 - RNA, 21 nt, Artificial Sequence
  Marburg virus siRNA sense strand
aggcaauaauugacauaucug

SEQ ID NO: 24779 - RNA, 21 nt, Artificial Sequence
  Marburg virus siRNA sense strand
ggcaauaauugacauaucugc

SEQ ID NO: 24780 - RNA, 21 nt, Artificial Sequence
  Marburg virus siRNA sense strand
gcaauaauugacauaucugcg

SEQ ID NO: 24781 - RNA, 21 nt, Artificial Sequence
  Marburg virus siRNA sense strand
caauaauugacauaucugcgu

SEQ ID NO: 24782 - RNA, 21 nt, Artificial Sequence
  Marburg virus siRNA sense strand
aauaauugacauaucugcgua

SEQ ID NO: 24783 - RNA, 21 nt, Artificial Sequence
  Marburg virus siRNA sense strand
auaauugacauaucugcguau

SEQ ID NO: 24784 - RNA, 21 nt, Artificial Sequence
  Marburg virus siRNA sense strand
uaauugacauaucugcguaua

SEQ ID NO: 24785 - RNA, 21 nt, Artificial Sequence
  Marburg virus siRNA sense strand
aauugacauaucugcguauaa

SEQ ID NO: 24786 - RNA, 21 nt, Artificial Sequence
  Marburg virus siRNA sense strand
auugacauaucugcguauaau

SEQ ID NO: 24787 - RNA, 21 nt, Artificial Sequence
  Marburg virus siRNA sense strand
uugacauaucugcguauaaug

SEQ ID NO: 24788 - RNA, 21 nt, Artificial Sequence
  Marburg virus siRNA sense strand
ugacauaucugcguauaauga

SEQ ID NO: 24789 - RNA, 21 nt, Artificial Sequence
  Marburg virus siRNA sense strand
gacauaucugcguauaaugaa

SEQ ID NO: 24790 - RNA, 21 nt, Artificial Sequence
  Marburg virus siRNA sense strand
acauaucugcguauaaugaac

SEQ ID NO: 24791 - RNA, 21 nt, Artificial Sequence
  Marburg virus siRNA sense strand
cauaucugcguauaaugaacc

SEQ ID NO: 24792 - RNA, 21 nt, Artificial Sequence
  Marburg virus siRNA sense strand
auaucugcguauaaugaacca

SEQ ID NO: 24793 - RNA, 21 nt, Artificial Sequence
  Marburg virus siRNA sense strand
uaucugcguauaaugaaccaa

SEQ ID NO: 24794 - RNA, 21 nt, Artificial Sequence
  Marburg virus siRNA sense strand
aucugcguauaaugaaccaac

SEQ ID NO: 24795 - RNA, 21 nt, Artificial Sequence
  Marburg virus siRNA sense strand
ucugcguauaaugaaccaaca

SEQ ID NO: 24796 - RNA, 21 nt, Artificial Sequence
  Marburg virus siRNA sense strand
cugcguauaaugaaccaacag

SEQ ID NO: 24797 - RNA, 21 nt, Artificial Sequence
  Marburg virus siRNA sense strand
ugcguauaaugaaccaacagu

SEQ ID NO: 24798 - RNA, 21 nt, Artificial Sequence
  Marburg virus siRNA sense strand
gcguauaaugaaccaacaguc

SEQ ID NO: 24799 - RNA, 21 nt, Artificial Sequence
  Marburg virus siRNA sense strand
cguauaaugaaccaacaguca

SEQ ID NO: 24800 - RNA, 21 nt, Artificial Sequence
  Marburg virus siRNA sense strand
guauaaugaaccaacagucaa

SEQ ID NO: 24801 - RNA, 21 nt, Artificial Sequence
  Marburg virus siRNA sense strand
uauaaugaaccaacagucaaa

SEQ ID NO: 24802 - RNA, 21 nt, Artificial Sequence
  Marburg virus siRNA sense strand
auaaugaaccaacagucaaag

SEQ ID NO: 24803 - RNA, 21 nt, Artificial Sequence
  Marburg virus siRNA sense strand
uaaugaaccaacagucaaagg

SEQ ID NO: 24804 - RNA, 21 nt, Artificial Sequence
  Marburg virus siRNA sense strand
aaugaaccaacagucaaaggu

SEQ ID NO: 24805 - RNA, 21 nt, Artificial Sequence
  Marburg virus siRNA sense strand
augaaccaacagucaaaggug

SEQ ID NO: 24806 - RNA, 21 nt, Artificial Sequence
  Marburg virus siRNA sense strand
ugaaccaacagucaaaggugu

SEQ ID NO: 24807 - RNA, 21 nt, Artificial Sequence
  Marburg virus siRNA sense strand
gaaccaacagucaaagguguu

SEQ ID NO: 24808 - RNA, 21 nt, Artificial Sequence
  Marburg virus siRNA sense strand
aaccaacagucaaagguguuc

SEQ ID NO: 24809 - RNA, 21 nt, Artificial Sequence
  Marburg virus siRNA sense strand
accaacagucaaagguguucc

SEQ ID NO: 24810 - RNA, 21 nt, Artificial Sequence
  Marburg virus siRNA sense strand
ccaacagucaaagguguucca

SEQ ID NO: 24811 - RNA, 21 nt, Artificial Sequence
  Marburg virus siRNA sense strand
caacagucaaagguguuccag

SEQ ID NO: 24812 - RNA, 21 nt, Artificial Sequence
  Marburg virus siRNA sense strand
aacagucaaagguguuccagc

SEQ ID NO: 24813 - RNA, 21 nt, Artificial Sequence
  Marburg virus siRNA sense strand
acagucaaagguguuccagca

SEQ ID NO: 24814 - RNA, 21 nt, Artificial Sequence
  Marburg virus siRNA sense strand
cagucaaagguguuccagcau

SEQ ID NO: 24815 - RNA, 21 nt, Artificial Sequence
  Marburg virus siRNA sense strand
agucaaagguguuccagcaug

SEQ ID NO: 24816 - RNA, 21 nt, Artificial Sequence
  Marburg virus siRNA sense strand
gucaaagguguuccagcaugg

SEQ ID NO: 24817 - RNA, 21 nt, Artificial Sequence
  Marburg virus siRNA sense strand
ucaaagguguuccagcauggc

SEQ ID NO: 24818 - RNA, 21 nt, Artificial Sequence
  Marburg virus siRNA sense strand
caaagguguuccagcauggcu

SEQ ID NO: 24819 - RNA, 21 nt, Artificial Sequence
  Marburg virus siRNA sense strand
aaagguguuccagcauggcug

SEQ ID NO: 24820 - RNA, 21 nt, Artificial Sequence
  Marburg virus siRNA sense strand
aagguguuccagcauggcugc

SEQ ID NO: 24821 - RNA, 21 nt, Artificial Sequence
  Marburg virus siRNA sense strand
agguguuccagcauggcugcc

SEQ ID NO: 24822 - RNA, 21 nt, Artificial Sequence
  Marburg virus siRNA sense strand
gguguuccagcauggcugccu

SEQ ID NO: 24823 - RNA, 21 nt, Artificial Sequence
  Marburg virus siRNA sense strand
guguuccagcauggcugccuc

SEQ ID NO: 24824 - RNA, 21 nt, Artificial Sequence
  Marburg virus siRNA sense strand
uguuccagcauggcugccucu

SEQ ID NO: 24825 - RNA, 21 nt, Artificial Sequence
  Marburg virus siRNA sense strand
guuccagcauggcugccucuc

SEQ ID NO: 24826 - RNA, 21 nt, Artificial Sequence
  Marburg virus siRNA sense strand
uuccagcauggcugccucucg

SEQ ID NO: 24827 - RNA, 21 nt, Artificial Sequence
  Marburg virus siRNA sense strand
uccagcauggcugccucucgg

SEQ ID NO: 24828 - RNA, 21 nt, Artificial Sequence
  Marburg virus siRNA sense strand
ccagcauggcugccucucggg

SEQ ID NO: 24829 - RNA, 21 nt, Artificial Sequence
  Marburg virus siRNA sense strand
cagcauggcugccucucggga

SEQ ID NO: 24830 - RNA, 21 nt, Artificial Sequence
  Marburg virus siRNA sense strand
agcauggcugccucucgggau

SEQ ID NO: 24831 - RNA, 21 nt, Artificial Sequence
  Marburg virus siRNA sense strand
gcauggcugccucucgggauu

SEQ ID NO: 24832 - RNA, 21 nt, Artificial Sequence
  Marburg virus siRNA sense strand
cauggcugccucucgggauua

SEQ ID NO: 24833 - RNA, 21 nt, Artificial Sequence
  Marburg virus siRNA sense strand
auggcugccucucgggauuau

SEQ ID NO: 24834 - RNA, 21 nt, Artificial Sequence
  Marburg virus siRNA sense strand
uggcugccucucgggauuaug

SEQ ID NO: 24835 - RNA, 21 nt, Artificial Sequence
  Marburg virus siRNA sense strand
ggcugccucucgggauuauga

SEQ ID NO: 24836 - RNA, 21 nt, Artificial Sequence
  Marburg virus siRNA sense strand
gcugccucucgggauuaugag

SEQ ID NO: 24837 - RNA, 21 nt, Artificial Sequence
  Marburg virus siRNA sense strand
cugccucucgggauuaugagc

SEQ ID NO: 24838 - RNA, 21 nt, Artificial Sequence
  Marburg virus siRNA sense strand
ugccucucgggauuaugagca

SEQ ID NO: 24839 - RNA, 21 nt, Artificial Sequence
  Marburg virus siRNA sense strand
gccucucgggauuaugagcaa

SEQ ID NO: 24840 - RNA, 21 nt, Artificial Sequence
  Marburg virus siRNA sense strand
ccucucgggauuaugagcaau

SEQ ID NO: 24841 - RNA, 21 nt, Artificial Sequence
  Marburg virus siRNA sense strand
cucucgggauuaugagcaauu

SEQ ID NO: 24842 - RNA, 21 nt, Artificial Sequence
  Marburg virus siRNA sense strand
ucucgggauuaugagcaauuu

SEQ ID NO: 24843 - RNA, 21 nt, Artificial Sequence
  Marburg virus siRNA sense strand
cucgggauuaugagcaauuuu

SEQ ID NO: 24844 - RNA, 21 nt, Artificial Sequence
  Marburg virus siRNA sense strand
ucgggauuaugagcaauuuug

SEQ ID NO: 24845 - RNA, 21 nt, Artificial Sequence
  Marburg virus siRNA sense strand
cgggauuaugagcaauuuuga

SEQ ID NO: 24846 - RNA, 21 nt, Artificial Sequence
  Marburg virus siRNA sense strand
gggauuaugagcaauuuugaa

SEQ ID NO: 24847 - RNA, 21 nt, Artificial Sequence
  Marburg virus siRNA sense strand
ggauuaugagcaauuuugaau

SEQ ID NO: 24848 - RNA, 21 nt, Artificial Sequence
  Marburg virus siRNA sense strand
gauuaugagcaauuuugaaua

SEQ ID NO: 24849 - RNA, 21 nt, Artificial Sequence
  Marburg virus siRNA sense strand
auuaugagcaauuuugaauau

SEQ ID NO: 24850 - RNA, 21 nt, Artificial Sequence
  Marburg virus siRNA sense strand
uuaugagcaauuuugaauauc

SEQ ID NO: 24851 - RNA, 21 nt, Artificial Sequence
  Marburg virus siRNA sense strand
uaugagcaauuuugaauaucc

SEQ ID NO: 24852 - RNA, 21 nt, Artificial Sequence
  Marburg virus siRNA sense strand
augagcaauuuugaauauccu

SEQ ID NO: 24853 - RNA, 21 nt, Artificial Sequence
  Marburg virus siRNA sense strand
ugagcaauuuugaauauccuu

SEQ ID NO: 24854 - RNA, 21 nt, Artificial Sequence
  Marburg virus siRNA sense strand
gagcaauuuugaauauccuuu

SEQ ID NO: 24855 - RNA, 21 nt, Artificial Sequence
  Marburg virus siRNA sense strand
agcaauuuugaauauccuuua

SEQ ID NO: 24856 - RNA, 21 nt, Artificial Sequence
  Marburg virus siRNA sense strand
gcaauuuugaauauccuuuag

SEQ ID NO: 24857 - RNA, 21 nt, Artificial Sequence
  Marburg virus siRNA sense strand
caauuuugaauauccuuuagc

SEQ ID NO: 24858 - RNA, 21 nt, Artificial Sequence
  Marburg virus siRNA sense strand
aauuuugaauauccuuuagcu

SEQ ID NO: 24859 - RNA, 21 nt, Artificial Sequence
  Marburg virus siRNA sense strand
auuuugaauauccuuuagcuc

SEQ ID NO: 24860 - RNA, 21 nt, Artificial Sequence
  Marburg virus siRNA sense strand
uuuugaauauccuuuagcuca

SEQ ID NO: 24861 - RNA, 21 nt, Artificial Sequence
  Marburg virus siRNA sense strand
uuugaauauccuuuagcucau

SEQ ID NO: 24862 - RNA, 21 nt, Artificial Sequence
  Marburg virus siRNA sense strand
uugaauauccuuuagcucaua

SEQ ID NO: 24863 - RNA, 21 nt, Artificial Sequence
  Marburg virus siRNA sense strand
ugaauauccuuuagcucauac

SEQ ID NO: 24864 - RNA, 21 nt, Artificial Sequence
  Marburg virus siRNA sense strand
gaauauccuuuagcucauacu

SEQ ID NO: 24865 - RNA, 21 nt, Artificial Sequence
  Marburg virus siRNA sense strand
aauauccuuuagcucauacug

SEQ ID NO: 24866 - RNA, 21 nt, Artificial Sequence
  Marburg virus siRNA sense strand
auauccuuuagcucauacugu

SEQ ID NO: 24867 - RNA, 21 nt, Artificial Sequence
  Marburg virus siRNA sense strand
uauccuuuagcucauacugug

SEQ ID NO: 24868 - RNA, 21 nt, Artificial Sequence
  Marburg virus siRNA sense strand
auccuuuagcucauacugugg

SEQ ID NO: 24869 - RNA, 21 nt, Artificial Sequence
  Marburg virus siRNA sense strand
uccuuuagcucauacuguggc

SEQ ID NO: 24870 - RNA, 21 nt, Artificial Sequence
  Marburg virus siRNA sense strand
ccuuuagcucauacuguggcu

SEQ ID NO: 24871 - RNA, 21 nt, Artificial Sequence
  Marburg virus siRNA sense strand
cuuuagcucauacuguggcug

SEQ ID NO: 24872 - RNA, 21 nt, Artificial Sequence
  Marburg virus siRNA sense strand
uuuagcucauacuguggcugc

SEQ ID NO: 24873 - RNA, 21 nt, Artificial Sequence
  Marburg virus siRNA sense strand
uuagcucauacuguggcugcg

SEQ ID NO: 24874 - RNA, 21 nt, Artificial Sequence
  Marburg virus siRNA sense strand
uagcucauacuguggcugcgu

SEQ ID NO: 24875 - RNA, 21 nt, Artificial Sequence
  Marburg virus siRNA sense strand
agcucauacuguggcugcguu

SEQ ID NO: 24876 - RNA, 21 nt, Artificial Sequence
  Marburg virus siRNA sense strand
gcucauacuguggcugcguug

SEQ ID NO: 24877 - RNA, 21 nt, Artificial Sequence
  Marburg virus siRNA sense strand
cucauacuguggcugcguugc

SEQ ID NO: 24878 - RNA, 21 nt, Artificial Sequence
  Marburg virus siRNA sense strand
ucauacuguggcugcguugcu

SEQ ID NO: 24879 - RNA, 21 nt, Artificial Sequence
  Marburg virus siRNA sense strand
cauacuguggcugcguugcuc

SEQ ID NO: 24880 - RNA, 21 nt, Artificial Sequence
  Marburg virus siRNA sense strand
auacuguggcugcguugcuca

SEQ ID NO: 24881 - RNA, 21 nt, Artificial Sequence
  Marburg virus siRNA sense strand
uacuguggcugcguugcucac

SEQ ID NO: 24882 - RNA, 21 nt, Artificial Sequence
  Marburg virus siRNA sense strand
acuguggcugcguugcucaca

SEQ ID NO: 24883 - RNA, 21 nt, Artificial Sequence
  Marburg virus siRNA sense strand
cuguggcugcguugcucacag

SEQ ID NO: 24884 - RNA, 21 nt, Artificial Sequence
  Marburg virus siRNA sense strand
uguggcugcguugcucacagg

SEQ ID NO: 24885 - RNA, 21 nt, Artificial Sequence
  Marburg virus siRNA sense strand
guggcugcguugcucacaggc

SEQ ID NO: 24886 - RNA, 21 nt, Artificial Sequence
  Marburg virus siRNA sense strand
uggcugcguugcucacaggca

SEQ ID NO: 24887 - RNA, 21 nt, Artificial Sequence
  Marburg virus siRNA sense strand
ggcugcguugcucacaggcag

SEQ ID NO: 24888 - RNA, 21 nt, Artificial Sequence
  Marburg virus siRNA sense strand
gcugcguugcucacaggcagc

SEQ ID NO: 24889 - RNA, 21 nt, Artificial Sequence
  Marburg virus siRNA sense strand
cugcguugcucacaggcagcu

SEQ ID NO: 24890 - RNA, 21 nt, Artificial Sequence
  Marburg virus siRNA sense strand
ugcguugcucacaggcagcua

SEQ ID NO: 24891 - RNA, 21 nt, Artificial Sequence
  Marburg virus siRNA sense strand
gcguugcucacaggcagcuau

SEQ ID NO: 24892 - RNA, 21 nt, Artificial Sequence
  Marburg virus siRNA sense strand
cguugcucacaggcagcuaua

SEQ ID NO: 24893 - RNA, 21 nt, Artificial Sequence
  Marburg virus siRNA sense strand
guugcucacaggcagcuauac

SEQ ID NO: 24894 - RNA, 21 nt, Artificial Sequence
  Marburg virus siRNA sense strand
uugcucacaggcagcuauaca

SEQ ID NO: 24895 - RNA, 21 nt, Artificial Sequence
  Marburg virus siRNA sense strand
ugcucacaggcagcuauacaa

SEQ ID NO: 24896 - RNA, 21 nt, Artificial Sequence
  Marburg virus siRNA sense strand
gcucacaggcagcuauacaau

SEQ ID NO: 24897 - RNA, 21 nt, Artificial Sequence
  Marburg virus siRNA sense strand
cucacaggcagcuauacaauc

SEQ ID NO: 24898 - RNA, 21 nt, Artificial Sequence
  Marburg virus siRNA sense strand
ucacaggcagcuauacaauca

SEQ ID NO: 24899 - RNA, 21 nt, Artificial Sequence
  Marburg virus siRNA sense strand
cacaggcagcuauacaaucac

SEQ ID NO: 24900 - RNA, 21 nt, Artificial Sequence
  Marburg virus siRNA sense strand
acaggcagcuauacaaucacc

SEQ ID NO: 24901 - RNA, 21 nt, Artificial Sequence
  Marburg virus siRNA sense strand
caggcagcuauacaaucaccc

SEQ ID NO: 24902 - RNA, 21 nt, Artificial Sequence
  Marburg virus siRNA sense strand
aggcagcuauacaaucaccca

SEQ ID NO: 24903 - RNA, 21 nt, Artificial Sequence
  Marburg virus siRNA sense strand
ggcagcuauacaaucacccaa

SEQ ID NO: 24904 - RNA, 21 nt, Artificial Sequence
  Marburg virus siRNA sense strand
gcagcuauacaaucacccaau

SEQ ID NO: 24905 - RNA, 21 nt, Artificial Sequence
  Marburg virus siRNA sense strand
cagcuauacaaucacccaauu

SEQ ID NO: 24906 - RNA, 21 nt, Artificial Sequence
  Marburg virus siRNA sense strand
agcuauacaaucacccaauuu

SEQ ID NO: 24907 - RNA, 21 nt, Artificial Sequence
  Marburg virus siRNA sense strand
gcuauacaaucacccaauuua

SEQ ID NO: 24908 - RNA, 21 nt, Artificial Sequence
  Marburg virus siRNA sense strand
cuauacaaucacccaauuuac

SEQ ID NO: 24909 - RNA, 21 nt, Artificial Sequence
  Marburg virus siRNA sense strand
uauacaaucacccaauuuacu

SEQ ID NO: 24910 - RNA, 21 nt, Artificial Sequence
  Marburg virus siRNA sense strand
auacaaucacccaauuuacuc

SEQ ID NO: 24911 - RNA, 21 nt, Artificial Sequence
  Marburg virus siRNA sense strand
uacaaucacccaauuuacuca

SEQ ID NO: 24912 - RNA, 21 nt, Artificial Sequence
  Marburg virus siRNA sense strand
acaaucacccaauuuacucau

SEQ ID NO: 24913 - RNA, 21 nt, Artificial Sequence
  Marburg virus siRNA sense strand
caaucacccaauuuacucaua

SEQ ID NO: 24914 - RNA, 21 nt, Artificial Sequence
  Marburg virus siRNA sense strand
aaucacccaauuuacucauaa

SEQ ID NO: 24915 - RNA, 21 nt, Artificial Sequence
  Marburg virus siRNA sense strand
aucacccaauuuacucauaau

SEQ ID NO: 24916 - RNA, 21 nt, Artificial Sequence
  Marburg virus siRNA sense strand
ucacccaauuuacucauaaug

SEQ ID NO: 24917 - RNA, 21 nt, Artificial Sequence
  Marburg virus siRNA sense strand
cacccaauuuacucauaaugg

SEQ ID NO: 24918 - RNA, 21 nt, Artificial Sequence
  Marburg virus siRNA sense strand
acccaauuuacucauaauggg

SEQ ID NO: 24919 - RNA, 21 nt, Artificial Sequence
  Marburg virus siRNA sense strand
cccaauuuacucauaaugggc

SEQ ID NO: 24920 - RNA, 21 nt, Artificial Sequence
  Marburg virus siRNA sense strand
ccaauuuacucauaaugggca

SEQ ID NO: 24921 - RNA, 21 nt, Artificial Sequence
  Marburg virus siRNA sense strand
caauuuacucauaaugggcaa

SEQ ID NO: 24922 - RNA, 21 nt, Artificial Sequence
  Marburg virus siRNA sense strand
aauuuacucauaaugggcaaa

SEQ ID NO: 24923 - RNA, 21 nt, Artificial Sequence
  Marburg virus siRNA sense strand
auuuacucauaaugggcaaaa

SEQ ID NO: 24924 - RNA, 21 nt, Artificial Sequence
  Marburg virus siRNA sense strand
uuuacucauaaugggcaaaaa

SEQ ID NO: 24925 - RNA, 21 nt, Artificial Sequence
  Marburg virus siRNA sense strand
uuacucauaaugggcaaaaau

SEQ ID NO: 24926 - RNA, 21 nt, Artificial Sequence
  Marburg virus siRNA sense strand
uacucauaaugggcaaaaauu

SEQ ID NO: 24927 - RNA, 21 nt, Artificial Sequence
  Marburg virus siRNA sense strand
acucauaaugggcaaaaauuc

SEQ ID NO: 24928 - RNA, 21 nt, Artificial Sequence
  Marburg virus siRNA sense strand
cucauaaugggcaaaaauucg

SEQ ID NO: 24929 - RNA, 21 nt, Artificial Sequence
  Marburg virus siRNA sense strand
ucauaaugggcaaaaauucgu

SEQ ID NO: 24930 - RNA, 21 nt, Artificial Sequence
  Marburg virus siRNA sense strand
cauaaugggcaaaaauucguc

SEQ ID NO: 24931 - RNA, 21 nt, Artificial Sequence
  Marburg virus siRNA sense strand
auaaugggcaaaaauucgucc

SEQ ID NO: 24932 - RNA, 21 nt, Artificial Sequence
  Marburg virus siRNA sense strand
uaaugggcaaaaauucguccg

SEQ ID NO: 24933 - RNA, 21 nt, Artificial Sequence
  Marburg virus siRNA sense strand
aaugggcaaaaauucguccgu

SEQ ID NO: 24934 - RNA, 21 nt, Artificial Sequence
  Marburg virus siRNA sense strand
augggcaaaaauucguccgug

SEQ ID NO: 24935 - RNA, 21 nt, Artificial Sequence
  Marburg virus siRNA sense strand
ugggcaaaaauucguccgugu

SEQ ID NO: 24936 - RNA, 21 nt, Artificial Sequence
  Marburg virus siRNA sense strand
gggcaaaaauucguccgugua

SEQ ID NO: 24937 - RNA, 21 nt, Artificial Sequence
  Marburg virus siRNA sense strand
ggcaaaaauucguccguguaa

SEQ ID NO: 24938 - RNA, 21 nt, Artificial Sequence
  Marburg virus siRNA sense strand
gcaaaaauucguccguguaaa

SEQ ID NO: 24939 - RNA, 21 nt, Artificial Sequence
  Marburg virus siRNA sense strand
caaaaauucguccguguaaau

SEQ ID NO: 24940 - RNA, 21 nt, Artificial Sequence
  Marburg virus siRNA sense strand
aaaaauucguccguguaaauc

SEQ ID NO: 24941 - RNA, 21 nt, Artificial Sequence
  Marburg virus siRNA sense strand
aaaauucguccguguaaaucg

SEQ ID NO: 24942 - RNA, 21 nt, Artificial Sequence
  Marburg virus siRNA sense strand
aaauucguccguguaaaucga

SEQ ID NO: 24943 - RNA, 21 nt, Artificial Sequence
  Marburg virus siRNA sense strand
aauucguccguguaaaucgac

SEQ ID NO: 24944 - RNA, 21 nt, Artificial Sequence
  Marburg virus siRNA sense strand
auucguccguguaaaucgacu

SEQ ID NO: 24945 - RNA, 21 nt, Artificial Sequence
  Marburg virus siRNA sense strand
uucguccguguaaaucgacuc

SEQ ID NO: 24946 - RNA, 21 nt, Artificial Sequence
  Marburg virus siRNA sense strand
ucguccguguaaaucgacucg

SEQ ID NO: 24947 - RNA, 21 nt, Artificial Sequence
  Marburg virus siRNA sense strand
cguccguguaaaucgacucgg

SEQ ID NO: 24948 - RNA, 21 nt, Artificial Sequence
  Marburg virus siRNA sense strand
guccguguaaaucgacucggu

SEQ ID NO: 24949 - RNA, 21 nt, Artificial Sequence
  Marburg virus siRNA sense strand
uccguguaaaucgacucggua

SEQ ID NO: 24950 - RNA, 21 nt, Artificial Sequence
  Marburg virus siRNA sense strand
ccguguaaaucgacucgguac

SEQ ID NO: 24951 - RNA, 21 nt, Artificial Sequence
  Marburg virus siRNA sense strand
cguguaaaucgacucgguaca

SEQ ID NO: 24952 - RNA, 21 nt, Artificial Sequence
  Marburg virus siRNA sense strand
guguaaaucgacucgguacag

SEQ ID NO: 24953 - RNA, 21 nt, Artificial Sequence
  Marburg virus siRNA sense strand
uguaaaucgacucgguacagg

SEQ ID NO: 24954 - RNA, 21 nt, Artificial Sequence
  Marburg virus siRNA sense strand
guaaaucgacucgguacagga

SEQ ID NO: 24955 - RNA, 21 nt, Artificial Sequence
  Marburg virus siRNA sense strand
uaaaucgacucgguacaggaa

SEQ ID NO: 24956 - RNA, 21 nt, Artificial Sequence
  Marburg virus siRNA sense strand
aaaucgacucgguacaggaau

SEQ ID NO: 24957 - RNA, 21 nt, Artificial Sequence
  Marburg virus siRNA sense strand
aaucgacucgguacaggaauc

SEQ ID NO: 24958 - RNA, 21 nt, Artificial Sequence
  Marburg virus siRNA sense strand
aucgacucgguacaggaaucc

SEQ ID NO: 24959 - RNA, 21 nt, Artificial Sequence
  Marburg virus siRNA sense strand
ucgacucgguacaggaauccc

SEQ ID NO: 24960 - RNA, 21 nt, Artificial Sequence
  Marburg virus siRNA sense strand
cgacucgguacaggaauccca

SEQ ID NO: 24961 - RNA, 21 nt, Artificial Sequence
  Marburg virus siRNA sense strand
gacucgguacaggaaucccag

SEQ ID NO: 24962 - RNA, 21 nt, Artificial Sequence
  Marburg virus siRNA sense strand
acucgguacaggaaucccagc

SEQ ID NO: 24963 - RNA, 21 nt, Artificial Sequence
  Marburg virus siRNA sense strand
cucgguacaggaaucccagca

SEQ ID NO: 24964 - RNA, 21 nt, Artificial Sequence
  Marburg virus siRNA sense strand
ucgguacaggaaucccagcac

SEQ ID NO: 24965 - RNA, 21 nt, Artificial Sequence
  Marburg virus siRNA sense strand
cgguacaggaaucccagcaca

SEQ ID NO: 24966 - RNA, 21 nt, Artificial Sequence
  Marburg virus siRNA sense strand
gguacaggaaucccagcacac

SEQ ID NO: 24967 - RNA, 21 nt, Artificial Sequence
  Marburg virus siRNA sense strand
guacaggaaucccagcacacc

SEQ ID NO: 24968 - RNA, 21 nt, Artificial Sequence
  Marburg virus siRNA sense strand
uacaggaaucccagcacaccc

SEQ ID NO: 24969 - RNA, 21 nt, Artificial Sequence
  Marburg virus siRNA sense strand
acaggaaucccagcacaccca

SEQ ID NO: 24970 - RNA, 21 nt, Artificial Sequence
  Marburg virus siRNA sense strand
caggaaucccagcacacccac

SEQ ID NO: 24971 - RNA, 21 nt, Artificial Sequence
  Marburg virus siRNA sense strand
aggaaucccagcacacccacu

SEQ ID NO: 24972 - RNA, 21 nt, Artificial Sequence
  Marburg virus siRNA sense strand
ggaaucccagcacacccacuc

SEQ ID NO: 24973 - RNA, 21 nt, Artificial Sequence
  Marburg virus siRNA sense strand
gaaucccagcacacccacuca

SEQ ID NO: 24974 - RNA, 21 nt, Artificial Sequence
  Marburg virus siRNA sense strand
aaucccagcacacccacucag

SEQ ID NO: 24975 - RNA, 21 nt, Artificial Sequence
  Marburg virus siRNA sense strand
aucccagcacacccacucaga

SEQ ID NO: 24976 - RNA, 21 nt, Artificial Sequence
  Marburg virus siRNA sense strand
ucccagcacacccacucagaa

SEQ ID NO: 24977 - RNA, 21 nt, Artificial Sequence
  Marburg virus siRNA sense strand
cccagcacacccacucagaau

SEQ ID NO: 24978 - RNA, 21 nt, Artificial Sequence
  Marburg virus siRNA sense strand
ccagcacacccacucagaaug

SEQ ID NO: 24979 - RNA, 21 nt, Artificial Sequence
  Marburg virus siRNA sense strand
cagcacacccacucagaaugu

SEQ ID NO: 24980 - RNA, 21 nt, Artificial Sequence
  Marburg virus siRNA sense strand
agcacacccacucagaauguu

SEQ ID NO: 24981 - RNA, 21 nt, Artificial Sequence
  Marburg virus siRNA sense strand
gcacacccacucagaauguug

SEQ ID NO: 24982 - RNA, 21 nt, Artificial Sequence
  Marburg virus siRNA sense strand
cacacccacucagaauguugc

SEQ ID NO: 24983 - RNA, 21 nt, Artificial Sequence
  Marburg virus siRNA sense strand
acacccacucagaauguugcg

SEQ ID NO: 24984 - RNA, 21 nt, Artificial Sequence
  Marburg virus siRNA sense strand
cacccacucagaauguugcgu

SEQ ID NO: 24985 - RNA, 21 nt, Artificial Sequence
  Marburg virus siRNA sense strand
acccacucagaauguugcgug

SEQ ID NO: 24986 - RNA, 21 nt, Artificial Sequence
  Marburg virus siRNA sense strand
cccacucagaauguugcguga

SEQ ID NO: 24987 - RNA, 21 nt, Artificial Sequence
  Marburg virus siRNA sense strand
ccacucagaauguugcgugaa

SEQ ID NO: 24988 - RNA, 21 nt, Artificial Sequence
  Marburg virus siRNA sense strand
cacucagaauguugcgugaag

SEQ ID NO: 24989 - RNA, 21 nt, Artificial Sequence
  Marburg virus siRNA sense strand
acucagaauguugcgugaagg

SEQ ID NO: 24990 - RNA, 21 nt, Artificial Sequence
  Marburg virus siRNA sense strand
cucagaauguugcgugaagga

SEQ ID NO: 24991 - RNA, 21 nt, Artificial Sequence
  Marburg virus siRNA sense strand
ucagaauguugcgugaaggaa

SEQ ID NO: 24992 - RNA, 21 nt, Artificial Sequence
  Marburg virus siRNA sense strand
cagaauguugcgugaaggaaa

SEQ ID NO: 24993 - RNA, 21 nt, Artificial Sequence
  Marburg virus siRNA sense strand
agaauguugcgugaaggaaau

SEQ ID NO: 24994 - RNA, 21 nt, Artificial Sequence
  Marburg virus siRNA sense strand
gaauguugcgugaaggaaauc

SEQ ID NO: 24995 - RNA, 21 nt, Artificial Sequence
  Marburg virus siRNA sense strand
aauguugcgugaaggaaauca

SEQ ID NO: 24996 - RNA, 21 nt, Artificial Sequence
  Marburg virus siRNA sense strand
auguugcgugaaggaaaucaa

SEQ ID NO: 24997 - RNA, 21 nt, Artificial Sequence
  Marburg virus siRNA sense strand
uguugcgugaaggaaaucaag

SEQ ID NO: 24998 - RNA, 21 nt, Artificial Sequence
  Marburg virus siRNA sense strand
guugcgugaaggaaaucaagc

SEQ ID NO: 24999 - RNA, 21 nt, Artificial Sequence
  Marburg virus siRNA sense strand
uugcgugaaggaaaucaagcu

SEQ ID NO: 25000 - RNA, 21 nt, Artificial Sequence
  Marburg virus siRNA sense strand
ugcgugaaggaaaucaagcuu

SEQ ID NO: 25001 - RNA, 21 nt, Artificial Sequence
  Marburg virus siRNA sense strand
gcgugaaggaaaucaagcuuu

SEQ ID NO: 25002 - RNA, 21 nt, Artificial Sequence
  Marburg virus siRNA sense strand
cgugaaggaaaucaagcuuuu

SEQ ID NO: 25003 - RNA, 21 nt, Artificial Sequence
  Marburg virus siRNA sense strand
gugaaggaaaucaagcuuuua

SEQ ID NO: 25004 - RNA, 21 nt, Artificial Sequence
  Marburg virus siRNA sense strand
ugaaggaaaucaagcuuuuau

SEQ ID NO: 25005 - RNA, 21 nt, Artificial Sequence
  Marburg virus siRNA sense strand
gaaggaaaucaagcuuuuauu

SEQ ID NO: 25006 - RNA, 21 nt, Artificial Sequence
  Marburg virus siRNA sense strand
aaggaaaucaagcuuuuauuc

SEQ ID NO: 25007 - RNA, 21 nt, Artificial Sequence
  Marburg virus siRNA sense strand
aggaaaucaagcuuuuauuca

SEQ ID NO: 25008 - RNA, 21 nt, Artificial Sequence
  Marburg virus siRNA sense strand
ggaaaucaagcuuuuauucag

SEQ ID NO: 25009 - RNA, 21 nt, Artificial Sequence
  Marburg virus siRNA sense strand
gaaaucaagcuuuuauucaga

SEQ ID NO: 25010 - RNA, 21 nt, Artificial Sequence
  Marburg virus siRNA sense strand
aaaucaagcuuuuauucagaa

SEQ ID NO: 25011 - RNA, 21 nt, Artificial Sequence
  Marburg virus siRNA sense strand
aaucaagcuuuuauucagaau

SEQ ID NO: 25012 - RNA, 21 nt, Artificial Sequence
  Marburg virus siRNA sense strand
aucaagcuuuuauucagaaua

SEQ ID NO: 25013 - RNA, 21 nt, Artificial Sequence
  Marburg virus siRNA sense strand
ucaagcuuuuauucagaauau

SEQ ID NO: 25014 - RNA, 21 nt, Artificial Sequence
  Marburg virus siRNA sense strand
caagcuuuuauucagaauaug

SEQ ID NO: 25015 - RNA, 21 nt, Artificial Sequence
  Marburg virus siRNA sense strand
aagcuuuuauucagaauaugg

SEQ ID NO: 25016 - RNA, 21 nt, Artificial Sequence
  Marburg virus siRNA sense strand
agcuuuuauucagaauauggu

SEQ ID NO: 25017 - RNA, 21 nt, Artificial Sequence
  Marburg virus siRNA sense strand
gcuuuuauucagaauauggug

SEQ ID NO: 25018 - RNA, 21 nt, Artificial Sequence
  Marburg virus siRNA sense strand
cuuuuauucagaauaugguga

SEQ ID NO: 25019 - RNA, 21 nt, Artificial Sequence
  Marburg virus siRNA sense strand
uuuuauucagaauauggugau

SEQ ID NO: 25020 - RNA, 21 nt, Artificial Sequence
  Marburg virus siRNA sense strand
uuuauucagaauauggugauc

SEQ ID NO: 25021 - RNA, 21 nt, Artificial Sequence
  Marburg virus siRNA sense strand
uuauucagaauauggugaucc

SEQ ID NO: 25022 - RNA, 21 nt, Artificial Sequence
  Marburg virus siRNA sense strand
uauucagaauauggugauccc

SEQ ID NO: 25023 - RNA, 21 nt, Artificial Sequence
  Marburg virus siRNA sense strand
auucagaauauggugaucccc

SEQ ID NO: 25024 - RNA, 21 nt, Artificial Sequence
  Marburg virus siRNA sense strand
uucagaauauggugaucccca

SEQ ID NO: 25025 - RNA, 21 nt, Artificial Sequence
  Marburg virus siRNA sense strand
ucagaauauggugauccccag

SEQ ID NO: 25026 - RNA, 21 nt, Artificial Sequence
  Marburg virus siRNA sense strand
cagaauauggugauccccaga

SEQ ID NO: 25027 - RNA, 21 nt, Artificial Sequence
  Marburg virus siRNA sense strand
agaauauggugauccccagaa

SEQ ID NO: 25028 - RNA, 21 nt, Artificial Sequence
  Marburg virus siRNA sense strand
gaauauggugauccccagaaa

SEQ ID NO: 25029 - RNA, 21 nt, Artificial Sequence
  Marburg virus siRNA sense strand
aauauggugauccccagaaau

SEQ ID NO: 25030 - RNA, 21 nt, Artificial Sequence
  Marburg virus siRNA sense strand
auauggugauccccagaaauu

SEQ ID NO: 25031 - RNA, 21 nt, Artificial Sequence
  Marburg virus siRNA sense strand
uauggugauccccagaaauuu

SEQ ID NO: 25032 - RNA, 21 nt, Artificial Sequence
  Marburg virus siRNA sense strand
auggugauccccagaaauuuu

SEQ ID NO: 25033 - RNA, 21 nt, Artificial Sequence
  Marburg virus siRNA sense strand
uggugauccccagaaauuuuu

SEQ ID NO: 25034 - RNA, 21 nt, Artificial Sequence
  Marburg virus siRNA sense strand
ggugauccccagaaauuuuuc

SEQ ID NO: 25035 - RNA, 21 nt, Artificial Sequence
  Marburg virus siRNA sense strand
gugauccccagaaauuuuucc

SEQ ID NO: 25036 - RNA, 21 nt, Artificial Sequence
  Marburg virus siRNA sense strand
ugauccccagaaauuuuucca

SEQ ID NO: 25037 - RNA, 21 nt, Artificial Sequence
  Marburg virus siRNA sense strand
gauccccagaaauuuuuccac

SEQ ID NO: 25038 - RNA, 21 nt, Artificial Sequence
  Marburg virus siRNA sense strand
auccccagaaauuuuuccacu

SEQ ID NO: 25039 - RNA, 21 nt, Artificial Sequence
  Marburg virus siRNA sense strand
uccccagaaauuuuuccacua

SEQ ID NO: 25040 - RNA, 21 nt, Artificial Sequence
  Marburg virus siRNA sense strand
ccccagaaauuuuuccacuaa

SEQ ID NO: 25041 - RNA, 21 nt, Artificial Sequence
  Marburg virus siRNA sense strand
cccagaaauuuuuccacuaau

SEQ ID NO: 25042 - RNA, 21 nt, Artificial Sequence
  Marburg virus siRNA sense strand
ccagaaauuuuuccacuaauc

SEQ ID NO: 25043 - RNA, 21 nt, Artificial Sequence
  Marburg virus siRNA sense strand
cagaaauuuuuccacuaauca

SEQ ID NO: 25044 - RNA, 21 nt, Artificial Sequence
  Marburg virus siRNA sense strand
agaaauuuuuccacuaaucaa

SEQ ID NO: 25045 - RNA, 21 nt, Artificial Sequence
  Marburg virus siRNA sense strand
gaaauuuuuccacuaaucaau

SEQ ID NO: 25046 - RNA, 21 nt, Artificial Sequence
  Marburg virus siRNA sense strand
aaauuuuuccacuaaucaauu

SEQ ID NO: 25047 - RNA, 21 nt, Artificial Sequence
  Marburg virus siRNA sense strand
aauuuuuccacuaaucaauuc

SEQ ID NO: 25048 - RNA, 21 nt, Artificial Sequence
  Marburg virus siRNA sense strand
auuuuuccacuaaucaauuca

SEQ ID NO: 25049 - RNA, 21 nt, Artificial Sequence
  Marburg virus siRNA sense strand
uuuuuccacuaaucaauucac

SEQ ID NO: 25050 - RNA, 21 nt, Artificial Sequence
  Marburg virus siRNA sense strand
uuuuccacuaaucaauucacc

SEQ ID NO: 25051 - RNA, 21 nt, Artificial Sequence
  Marburg virus siRNA sense strand
uuuccacuaaucaauucaccu

SEQ ID NO: 25052 - RNA, 21 nt, Artificial Sequence
  Marburg virus siRNA sense strand
uuccacuaaucaauucaccua

SEQ ID NO: 25053 - RNA, 21 nt, Artificial Sequence
  Marburg virus siRNA sense strand
uccacuaaucaauucaccuac

SEQ ID NO: 25054 - RNA, 21 nt, Artificial Sequence
  Marburg virus siRNA sense strand
ccacuaaucaauucaccuaca

SEQ ID NO: 25055 - RNA, 21 nt, Artificial Sequence
  Marburg virus siRNA sense strand
cacuaaucaauucaccuacaa

SEQ ID NO: 25056 - RNA, 21 nt, Artificial Sequence
  Marburg virus siRNA sense strand
acuaaucaauucaccuacaau

SEQ ID NO: 25057 - RNA, 21 nt, Artificial Sequence
  Marburg virus siRNA sense strand
cuaaucaauucaccuacaauc

SEQ ID NO: 25058 - RNA, 21 nt, Artificial Sequence
  Marburg virus siRNA sense strand
uaaucaauucaccuacaaucu

SEQ ID NO: 25059 - RNA, 21 nt, Artificial Sequence
  Marburg virus siRNA sense strand
aaucaauucaccuacaaucuc

SEQ ID NO: 25060 - RNA, 21 nt, Artificial Sequence
  Marburg virus siRNA sense strand
aucaauucaccuacaaucuca

SEQ ID NO: 25061 - RNA, 21 nt, Artificial Sequence
  Marburg virus siRNA sense strand
ucaauucaccuacaaucucac

SEQ ID NO: 25062 - RNA, 21 nt, Artificial Sequence
  Marburg virus siRNA sense strand
caauucaccuacaaucucacu

SEQ ID NO: 25063 - RNA, 21 nt, Artificial Sequence
  Marburg virus siRNA sense strand
aauucaccuacaaucucacua

SEQ ID NO: 25064 - RNA, 21 nt, Artificial Sequence
  Marburg virus siRNA sense strand
auucaccuacaaucucacuaa

SEQ ID NO: 25065 - RNA, 21 nt, Artificial Sequence
  Marburg virus siRNA sense strand
uucaccuacaaucucacuaac

SEQ ID NO: 25066 - RNA, 21 nt, Artificial Sequence
  Marburg virus siRNA sense strand
ucaccuacaaucucacuaacu

SEQ ID NO: 25067 - RNA, 21 nt, Artificial Sequence
  Marburg virus siRNA sense strand
caccuacaaucucacuaacuu

SEQ ID NO: 25068 - RNA, 21 nt, Artificial Sequence
  Marburg virus siRNA sense strand
accuacaaucucacuaacuua

SEQ ID NO: 25069 - RNA, 21 nt, Artificial Sequence
  Marburg virus siRNA sense strand
ccuacaaucucacuaacuuag

SEQ ID NO: 25070 - RNA, 21 nt, Artificial Sequence
  Marburg virus siRNA sense strand
cuacaaucucacuaacuuagu

SEQ ID NO: 25071 - RNA, 21 nt, Artificial Sequence
  Marburg virus siRNA sense strand
uacaaucucacuaacuuagua

SEQ ID NO: 25072 - RNA, 21 nt, Artificial Sequence
  Marburg virus siRNA sense strand
acaaucucacuaacuuaguau

SEQ ID NO: 25073 - RNA, 21 nt, Artificial Sequence
  Marburg virus siRNA sense strand
caaucucacuaacuuaguauu

SEQ ID NO: 25074 - RNA, 21 nt, Artificial Sequence
  Marburg virus siRNA sense strand
aaucucacuaacuuaguauug

SEQ ID NO: 25075 - RNA, 21 nt, Artificial Sequence
  Marburg virus siRNA sense strand
aucucacuaacuuaguauuga

SEQ ID NO: 25076 - RNA, 21 nt, Artificial Sequence
  Marburg virus siRNA sense strand
ucucacuaacuuaguauugag

SEQ ID NO: 25077 - RNA, 21 nt, Artificial Sequence
  Marburg virus siRNA sense strand
cucacuaacuuaguauugagu

SEQ ID NO: 25078 - RNA, 21 nt, Artificial Sequence
  Marburg virus siRNA sense strand
ucacuaacuuaguauugagug

SEQ ID NO: 25079 - RNA, 21 nt, Artificial Sequence
  Marburg virus siRNA sense strand
cacuaacuuaguauugagugu

SEQ ID NO: 25080 - RNA, 21 nt, Artificial Sequence
  Marburg virus siRNA sense strand
acuaacuuaguauugagugug

SEQ ID NO: 25081 - RNA, 21 nt, Artificial Sequence
  Marburg virus siRNA sense strand
cuaacuuaguauugagugugc

SEQ ID NO: 25082 - RNA, 21 nt, Artificial Sequence
  Marburg virus siRNA sense strand
uaacuuaguauugagugugca

SEQ ID NO: 25083 - RNA, 21 nt, Artificial Sequence
  Marburg virus siRNA sense strand
aacuuaguauugagugugcaa

SEQ ID NO: 25084 - RNA, 21 nt, Artificial Sequence
  Marburg virus siRNA sense strand
acuuaguauugagugugcaaa

SEQ ID NO: 25085 - RNA, 21 nt, Artificial Sequence
  Marburg virus siRNA sense strand
cuuaguauugagugugcaaaa

SEQ ID NO: 25086 - RNA, 21 nt, Artificial Sequence
  Marburg virus siRNA sense strand
uuaguauugagugugcaaaag

SEQ ID NO: 25087 - RNA, 21 nt, Artificial Sequence
  Marburg virus siRNA sense strand
uaguauugagugugcaaaagc

SEQ ID NO: 25088 - RNA, 21 nt, Artificial Sequence
  Marburg virus siRNA sense strand
aguauugagugugcaaaagcu

SEQ ID NO: 25089 - RNA, 21 nt, Artificial Sequence
  Marburg virus siRNA sense strand
guauugagugugcaaaagcuu

SEQ ID NO: 25090 - RNA, 21 nt, Artificial Sequence
  Marburg virus siRNA sense strand
uauugagugugcaaaagcuuc

SEQ ID NO: 25091 - RNA, 21 nt, Artificial Sequence
  Marburg virus siRNA sense strand
auugagugugcaaaagcuucc

SEQ ID NO: 25092 - RNA, 21 nt, Artificial Sequence
  Marburg virus siRNA sense strand
uugagugugcaaaagcuuccu

SEQ ID NO: 25093 - RNA, 21 nt, Artificial Sequence
  Marburg virus siRNA sense strand
ugagugugcaaaagcuuccug

SEQ ID NO: 25094 - RNA, 21 nt, Artificial Sequence
  Marburg virus siRNA sense strand
gagugugcaaaagcuuccuga

SEQ ID NO: 25095 - RNA, 21 nt, Artificial Sequence
  Marburg virus siRNA sense strand
agugugcaaaagcuuccugau

SEQ ID NO: 25096 - RNA, 21 nt, Artificial Sequence
  Marburg virus siRNA sense strand
gugugcaaaagcuuccugaug

SEQ ID NO: 25097 - RNA, 21 nt, Artificial Sequence
  Marburg virus siRNA sense strand
ugugcaaaagcuuccugauga

SEQ ID NO: 25098 - RNA, 21 nt, Artificial Sequence
  Marburg virus siRNA sense strand
gugcaaaagcuuccugaugau

SEQ ID NO: 25099 - RNA, 21 nt, Artificial Sequence
  Marburg virus siRNA sense strand
ugcaaaagcuuccugaugaug

SEQ ID NO: 25100 - RNA, 21 nt, Artificial Sequence
  Marburg virus siRNA sense strand
gcaaaagcuuccugaugaugc

SEQ ID NO: 25101 - RNA, 21 nt, Artificial Sequence
  Marburg virus siRNA sense strand
caaaagcuuccugaugaugcc

SEQ ID NO: 25102 - RNA, 21 nt, Artificial Sequence
  Marburg virus siRNA sense strand
aaaagcuuccugaugaugccu

SEQ ID NO: 25103 - RNA, 21 nt, Artificial Sequence
  Marburg virus siRNA sense strand
aaagcuuccugaugaugccug

SEQ ID NO: 25104 - RNA, 21 nt, Artificial Sequence
  Marburg virus siRNA sense strand
aagcuuccugaugaugccugg

SEQ ID NO: 25105 - RNA, 21 nt, Artificial Sequence
  Marburg virus siRNA sense strand
agcuuccugaugaugccuggc

SEQ ID NO: 25106 - RNA, 21 nt, Artificial Sequence
  Marburg virus siRNA sense strand
gcuuccugaugaugccuggcg

SEQ ID NO: 25107 - RNA, 21 nt, Artificial Sequence
  Marburg virus siRNA sense strand
cuuccugaugaugccuggcgc

SEQ ID NO: 25108 - RNA, 21 nt, Artificial Sequence
  Marburg virus siRNA sense strand
uuccugaugaugccuggcgcc

SEQ ID NO: 25109 - RNA, 21 nt, Artificial Sequence
  Marburg virus siRNA sense strand
uccugaugaugccuggcgccc

SEQ ID NO: 25110 - RNA, 21 nt, Artificial Sequence
  Marburg virus siRNA sense strand
ccugaugaugccuggcgccca

SEQ ID NO: 25111 - RNA, 21 nt, Artificial Sequence
  Marburg virus siRNA sense strand
cugaugaugccuggcgcccau

SEQ ID NO: 25112 - RNA, 21 nt, Artificial Sequence
  Marburg virus siRNA sense strand
ugaugaugccuggcgcccauc

SEQ ID NO: 25113 - RNA, 21 nt, Artificial Sequence
  Marburg virus siRNA sense strand
gaugaugccuggcgcccaucc

SEQ ID NO: 25114 - RNA, 21 nt, Artificial Sequence
  Marburg virus siRNA sense strand
augaugccuggcgcccaucca

SEQ ID NO: 25115 - RNA, 21 nt, Artificial Sequence
  Marburg virus siRNA sense strand
ugaugccuggcgcccauccaa

SEQ ID NO: 25116 - RNA, 21 nt, Artificial Sequence
  Marburg virus siRNA sense strand
gaugccuggcgcccauccaag

SEQ ID NO: 25117 - RNA, 21 nt, Artificial Sequence
  Marburg virus siRNA sense strand
augccuggcgcccauccaagg

SEQ ID NO: 25118 - RNA, 21 nt, Artificial Sequence
  Marburg virus siRNA sense strand
ugccuggcgcccauccaagga

SEQ ID NO: 25119 - RNA, 21 nt, Artificial Sequence
  Marburg virus siRNA sense strand
gccuggcgcccauccaaggac

SEQ ID NO: 25120 - RNA, 21 nt, Artificial Sequence
  Marburg virus siRNA sense strand
ccuggcgcccauccaaggaca

SEQ ID NO: 25121 - RNA, 21 nt, Artificial Sequence
  Marburg virus siRNA sense strand
cuggcgcccauccaaggacaa

SEQ ID NO: 25122 - RNA, 21 nt, Artificial Sequence
  Marburg virus siRNA sense strand
uggcgcccauccaaggacaaa

SEQ ID NO: 25123 - RNA, 21 nt, Artificial Sequence
  Marburg virus siRNA sense strand
ggcgcccauccaaggacaaau

SEQ ID NO: 25124 - RNA, 21 nt, Artificial Sequence
  Marburg virus siRNA sense strand
gcgcccauccaaggacaaauu

SEQ ID NO: 25125 - RNA, 21 nt, Artificial Sequence
  Marburg virus siRNA sense strand
cgcccauccaaggacaaauua

SEQ ID NO: 25126 - RNA, 21 nt, Artificial Sequence
  Marburg virus siRNA sense strand
gcccauccaaggacaaauuaa

SEQ ID NO: 25127 - RNA, 21 nt, Artificial Sequence
  Marburg virus siRNA sense strand
cccauccaaggacaaauuaau

SEQ ID NO: 25128 - RNA, 21 nt, Artificial Sequence
  Marburg virus siRNA sense strand
ccauccaaggacaaauuaauu

SEQ ID NO: 25129 - RNA, 21 nt, Artificial Sequence
  Marburg virus siRNA sense strand
cauccaaggacaaauuaauug

SEQ ID NO: 25130 - RNA, 21 nt, Artificial Sequence
  Marburg virus siRNA sense strand
auccaaggacaaauuaauugg

SEQ ID NO: 25131 - RNA, 21 nt, Artificial Sequence
  Marburg virus siRNA sense strand
uccaaggacaaauuaauuggg

SEQ ID NO: 25132 - RNA, 21 nt, Artificial Sequence
  Marburg virus siRNA sense strand
ccaaggacaaauuaauuggga

SEQ ID NO: 25133 - RNA, 21 nt, Artificial Sequence
  Marburg virus siRNA sense strand
caaggacaaauuaauugggaa

SEQ ID NO: 25134 - RNA, 21 nt, Artificial Sequence
  Marburg virus siRNA sense strand
aaggacaaauuaauugggaac

SEQ ID NO: 25135 - RNA, 21 nt, Artificial Sequence
  Marburg virus siRNA sense strand
aggacaaauuaauugggaaca

SEQ ID NO: 25136 - RNA, 21 nt, Artificial Sequence
  Marburg virus siRNA sense strand
ggacaaauuaauugggaacac

SEQ ID NO: 25137 - RNA, 21 nt, Artificial Sequence
  Marburg virus siRNA sense strand
gacaaauuaauugggaacacc

SEQ ID NO: 25138 - RNA, 21 nt, Artificial Sequence
  Marburg virus siRNA sense strand
acaaauuaauugggaacacca

SEQ ID NO: 25139 - RNA, 21 nt, Artificial Sequence
  Marburg virus siRNA sense strand
caaauuaauugggaacaccau

SEQ ID NO: 25140 - RNA, 21 nt, Artificial Sequence
  Marburg virus siRNA sense strand
aaauuaauugggaacaccaug

SEQ ID NO: 25141 - RNA, 21 nt, Artificial Sequence
  Marburg virus siRNA sense strand
aauuaauugggaacaccaugc

SEQ ID NO: 25142 - RNA, 21 nt, Artificial Sequence
  Marburg virus siRNA sense strand
auuaauugggaacaccaugca

SEQ ID NO: 25143 - RNA, 21 nt, Artificial Sequence
  Marburg virus siRNA sense strand
uuaauugggaacaccaugcau

SEQ ID NO: 25144 - RNA, 21 nt, Artificial Sequence
  Marburg virus siRNA sense strand
uaauugggaacaccaugcauc

SEQ ID NO: 25145 - RNA, 21 nt, Artificial Sequence
  Marburg virus siRNA sense strand
aauugggaacaccaugcaucc

SEQ ID NO: 25146 - RNA, 21 nt, Artificial Sequence
  Marburg virus siRNA sense strand
auugggaacaccaugcauccc

SEQ ID NO: 25147 - RNA, 21 nt, Artificial Sequence
  Marburg virus siRNA sense strand
uugggaacaccaugcaucccg

SEQ ID NO: 25148 - RNA, 21 nt, Artificial Sequence
  Marburg virus siRNA sense strand
ugggaacaccaugcaucccgc

SEQ ID NO: 25149 - RNA, 21 nt, Artificial Sequence
  Marburg virus siRNA sense strand
gggaacaccaugcaucccgca

SEQ ID NO: 25150 - RNA, 21 nt, Artificial Sequence
  Marburg virus siRNA sense strand
ggaacaccaugcaucccgcag

SEQ ID NO: 25151 - RNA, 21 nt, Artificial Sequence
  Marburg virus siRNA sense strand
gaacaccaugcaucccgcagu

SEQ ID NO: 25152 - RNA, 21 nt, Artificial Sequence
  Marburg virus siRNA sense strand
aacaccaugcaucccgcaguc

SEQ ID NO: 25153 - RNA, 21 nt, Artificial Sequence
  Marburg virus siRNA sense strand
acaccaugcaucccgcagucu

SEQ ID NO: 25154 - RNA, 21 nt, Artificial Sequence
  Marburg virus siRNA sense strand
caccaugcaucccgcagucuc

SEQ ID NO: 25155 - RNA, 21 nt, Artificial Sequence
  Marburg virus siRNA sense strand
accaugcaucccgcagucucc

SEQ ID NO: 25156 - RNA, 21 nt, Artificial Sequence
  Marburg virus siRNA sense strand
ccaugcaucccgcagucucca

SEQ ID NO: 25157 - RNA, 21 nt, Artificial Sequence
  Marburg virus siRNA sense strand
caugcaucccgcagucuccau

SEQ ID NO: 25158 - RNA, 21 nt, Artificial Sequence
  Marburg virus siRNA sense strand
augcaucccgcagucuccaua

SEQ ID NO: 25159 - RNA, 21 nt, Artificial Sequence
  Marburg virus siRNA sense strand
ugcaucccgcagucuccauac

SEQ ID NO: 25160 - RNA, 21 nt, Artificial Sequence
  Marburg virus siRNA sense strand
gcaucccgcagucuccauaca

SEQ ID NO: 25161 - RNA, 21 nt, Artificial Sequence
  Marburg virus siRNA sense strand
caucccgcagucuccauacac

SEQ ID NO: 25162 - RNA, 21 nt, Artificial Sequence
  Marburg virus siRNA sense strand
aucccgcagucuccauacacc

SEQ ID NO: 25163 - RNA, 21 nt, Artificial Sequence
  Marburg virus siRNA sense strand
ucccgcagucuccauacaccc

SEQ ID NO: 25164 - RNA, 21 nt, Artificial Sequence
  Marburg virus siRNA sense strand
cccgcagucuccauacacccg

SEQ ID NO: 25165 - RNA, 21 nt, Artificial Sequence
  Marburg virus siRNA sense strand
ccgcagucuccauacacccga

SEQ ID NO: 25166 - RNA, 21 nt, Artificial Sequence
  Marburg virus siRNA sense strand
cgcagucuccauacacccgaa

SEQ ID NO: 25167 - RNA, 21 nt, Artificial Sequence
  Marburg virus siRNA sense strand
gcagucuccauacacccgaau

SEQ ID NO: 25168 - RNA, 21 nt, Artificial Sequence
  Marburg virus siRNA sense strand
cagucuccauacacccgaauu

SEQ ID NO: 25169 - RNA, 21 nt, Artificial Sequence
  Marburg virus siRNA sense strand
agucuccauacacccgaauuu

SEQ ID NO: 25170 - RNA, 21 nt, Artificial Sequence
  Marburg virus siRNA sense strand
gucuccauacacccgaauuug

SEQ ID NO: 25171 - RNA, 21 nt, Artificial Sequence
  Marburg virus siRNA sense strand
ucuccauacacccgaauuugc

SEQ ID NO: 25172 - RNA, 21 nt, Artificial Sequence
  Marburg virus siRNA sense strand
cuccauacacccgaauuugcc

SEQ ID NO: 25173 - RNA, 21 nt, Artificial Sequence
  Marburg virus siRNA sense strand
uccauacacccgaauuugcca

SEQ ID NO: 25174 - RNA, 21 nt, Artificial Sequence
  Marburg virus siRNA sense strand
ccauacacccgaauuugccac

SEQ ID NO: 25175 - RNA, 21 nt, Artificial Sequence
  Marburg virus siRNA sense strand
cauacacccgaauuugccacc

SEQ ID NO: 25176 - RNA, 21 nt, Artificial Sequence
  Marburg virus siRNA sense strand
auacacccgaauuugccaccc

SEQ ID NO: 25177 - RNA, 21 nt, Artificial Sequence
  Marburg virus siRNA sense strand
uacacccgaauuugccaccca

SEQ ID NO: 25178 - RNA, 21 nt, Artificial Sequence
  Marburg virus siRNA sense strand
acacccgaauuugccacccau

SEQ ID NO: 25179 - RNA, 21 nt, Artificial Sequence
  Marburg virus siRNA sense strand
cacccgaauuugccacccauu

SEQ ID NO: 25180 - RNA, 21 nt, Artificial Sequence
  Marburg virus siRNA sense strand
acccgaauuugccacccauug

SEQ ID NO: 25181 - RNA, 21 nt, Artificial Sequence
  Marburg virus siRNA sense strand
cccgaauuugccacccauugu

SEQ ID NO: 25182 - RNA, 21 nt, Artificial Sequence
  Marburg virus siRNA sense strand
ccgaauuugccacccauuguu

SEQ ID NO: 25183 - RNA, 21 nt, Artificial Sequence
  Marburg virus siRNA sense strand
cgaauuugccacccauuguuc

SEQ ID NO: 25184 - RNA, 21 nt, Artificial Sequence
  Marburg virus siRNA sense strand
gaauuugccacccauuguucu

SEQ ID NO: 25185 - RNA, 21 nt, Artificial Sequence
  Marburg virus siRNA sense strand
aauuugccacccauuguucua

SEQ ID NO: 25186 - RNA, 21 nt, Artificial Sequence
  Marburg virus siRNA sense strand
auuugccacccauuguucuac

SEQ ID NO: 25187 - RNA, 21 nt, Artificial Sequence
  Marburg virus siRNA sense strand
uuugccacccauuguucuacc

SEQ ID NO: 25188 - RNA, 21 nt, Artificial Sequence
  Marburg virus siRNA sense strand
uugccacccauuguucuacca

SEQ ID NO: 25189 - RNA, 21 nt, Artificial Sequence
  Marburg virus siRNA sense strand
ugccacccauuguucuaccaa

SEQ ID NO: 25190 - RNA, 21 nt, Artificial Sequence
  Marburg virus siRNA sense strand
gccacccauuguucuaccaac

SEQ ID NO: 25191 - RNA, 21 nt, Artificial Sequence
  Marburg virus siRNA sense strand
ccacccauuguucuaccaaca

SEQ ID NO: 25192 - RNA, 21 nt, Artificial Sequence
  Marburg virus siRNA sense strand
cacccauuguucuaccaacag

SEQ ID NO: 25193 - RNA, 21 nt, Artificial Sequence
  Marburg virus siRNA sense strand
acccauuguucuaccaacagu

SEQ ID NO: 25194 - RNA, 21 nt, Artificial Sequence
  Marburg virus siRNA sense strand
cccauuguucuaccaacaguc

SEQ ID NO: 25195 - RNA, 21 nt, Artificial Sequence
  Marburg virus siRNA sense strand
ccauuguucuaccaacaguca

SEQ ID NO: 25196 - RNA, 21 nt, Artificial Sequence
  Marburg virus siRNA sense strand
cauuguucuaccaacagucaa

SEQ ID NO: 25197 - RNA, 21 nt, Artificial Sequence
  Marburg virus siRNA sense strand
auuguucuaccaacagucaag

SEQ ID NO: 25198 - RNA, 21 nt, Artificial Sequence
  Marburg virus siRNA sense strand
uuguucuaccaacagucaaga

SEQ ID NO: 25199 - RNA, 21 nt, Artificial Sequence
  Marburg virus siRNA sense strand
uguucuaccaacagucaagaa

SEQ ID NO: 25200 - RNA, 21 nt, Artificial Sequence
  Marburg virus siRNA sense strand
guucuaccaacagucaagaag

SEQ ID NO: 25201 - RNA, 21 nt, Artificial Sequence
  Marburg virus siRNA sense strand
uucuaccaacagucaagaagc

SEQ ID NO: 25202 - RNA, 21 nt, Artificial Sequence
  Marburg virus siRNA sense strand
ucuaccaacagucaagaagca

SEQ ID NO: 25203 - RNA, 21 nt, Artificial Sequence
  Marburg virus siRNA sense strand
cuaccaacagucaagaagcag

SEQ ID NO: 25204 - RNA, 21 nt, Artificial Sequence
  Marburg virus siRNA sense strand
uaccaacagucaagaagcagg

SEQ ID NO: 25205 - RNA, 21 nt, Artificial Sequence
  Marburg virus siRNA sense strand
accaacagucaagaagcaggc

SEQ ID NO: 25206 - RNA, 21 nt, Artificial Sequence
  Marburg virus siRNA sense strand
ccaacagucaagaagcaggcu

SEQ ID NO: 25207 - RNA, 21 nt, Artificial Sequence
  Marburg virus siRNA sense strand
caacagucaagaagcaggcuu

SEQ ID NO: 25208 - RNA, 21 nt, Artificial Sequence
  Marburg virus siRNA sense strand
aacagucaagaagcaggcuua

SEQ ID NO: 25209 - RNA, 21 nt, Artificial Sequence
  Marburg virus siRNA sense strand
acagucaagaagcaggcuuau

SEQ ID NO: 25210 - RNA, 21 nt, Artificial Sequence
  Marburg virus siRNA sense strand
cagucaagaagcaggcuuauc

SEQ ID NO: 25211 - RNA, 21 nt, Artificial Sequence
  Marburg virus siRNA sense strand
agucaagaagcaggcuuaucg

SEQ ID NO: 25212 - RNA, 21 nt, Artificial Sequence
  Marburg virus siRNA sense strand
gucaagaagcaggcuuaucgu

SEQ ID NO: 25213 - RNA, 21 nt, Artificial Sequence
  Marburg virus siRNA sense strand
ucaagaagcaggcuuaucguc

SEQ ID NO: 25214 - RNA, 21 nt, Artificial Sequence
  Marburg virus siRNA sense strand
caagaagcaggcuuaucguca

SEQ ID NO: 25215 - RNA, 21 nt, Artificial Sequence
  Marburg virus siRNA sense strand
aagaagcaggcuuaucgucag

SEQ ID NO: 25216 - RNA, 21 nt, Artificial Sequence
  Marburg virus siRNA sense strand
agaagcaggcuuaucgucagc

SEQ ID NO: 25217 - RNA, 21 nt, Artificial Sequence
  Marburg virus siRNA sense strand
gaagcaggcuuaucgucagca

SEQ ID NO: 25218 - RNA, 21 nt, Artificial Sequence
  Marburg virus siRNA sense strand
aagcaggcuuaucgucagcau

SEQ ID NO: 25219 - RNA, 21 nt, Artificial Sequence
  Marburg virus siRNA sense strand
agcaggcuuaucgucagcaua

SEQ ID NO: 25220 - RNA, 21 nt, Artificial Sequence
  Marburg virus siRNA sense strand
gcaggcuuaucgucagcauaa

SEQ ID NO: 25221 - RNA, 21 nt, Artificial Sequence
  Marburg virus siRNA sense strand
caggcuuaucgucagcauaaa

SEQ ID NO: 25222 - RNA, 21 nt, Artificial Sequence
  Marburg virus siRNA sense strand
aggcuuaucgucagcauaaaa

SEQ ID NO: 25223 - RNA, 21 nt, Artificial Sequence
  Marburg virus siRNA sense strand
ggcuuaucgucagcauaaaaa

SEQ ID NO: 25224 - RNA, 21 nt, Artificial Sequence
  Marburg virus siRNA sense strand
gcuuaucgucagcauaaaaau

SEQ ID NO: 25225 - RNA, 21 nt, Artificial Sequence
  Marburg virus siRNA sense strand
cuuaucgucagcauaaaaauc

SEQ ID NO: 25226 - RNA, 21 nt, Artificial Sequence
  Marburg virus siRNA sense strand
uuaucgucagcauaaaaaucc

SEQ ID NO: 25227 - RNA, 21 nt, Artificial Sequence
  Marburg virus siRNA sense strand
uaucgucagcauaaaaauccc

SEQ ID NO: 25228 - RNA, 21 nt, Artificial Sequence
  Marburg virus siRNA sense strand
aucgucagcauaaaaauccca

SEQ ID NO: 25229 - RNA, 21 nt, Artificial Sequence
  Marburg virus siRNA sense strand
ucgucagcauaaaaaucccaa

SEQ ID NO: 25230 - RNA, 21 nt, Artificial Sequence
  Marburg virus siRNA sense strand
cgucagcauaaaaaucccaac

SEQ ID NO: 25231 - RNA, 21 nt, Artificial Sequence
  Marburg virus siRNA sense strand
gucagcauaaaaaucccaaca

SEQ ID NO: 25232 - RNA, 21 nt, Artificial Sequence
  Marburg virus siRNA sense strand
ucagcauaaaaaucccaacaa

SEQ ID NO: 25233 - RNA, 21 nt, Artificial Sequence
  Marburg virus siRNA sense strand
cagcauaaaaaucccaacaau

SEQ ID NO: 25234 - RNA, 21 nt, Artificial Sequence
  Marburg virus siRNA sense strand
agcauaaaaaucccaacaaug

SEQ ID NO: 25235 - RNA, 21 nt, Artificial Sequence
  Marburg virus siRNA sense strand
gcauaaaaaucccaacaaugg

SEQ ID NO: 25236 - RNA, 21 nt, Artificial Sequence
  Marburg virus siRNA sense strand
cauaaaaaucccaacaaugga

SEQ ID NO: 25237 - RNA, 21 nt, Artificial Sequence
  Marburg virus siRNA sense strand
auaaaaaucccaacaauggac

SEQ ID NO: 25238 - RNA, 21 nt, Artificial Sequence
  Marburg virus siRNA sense strand
uaaaaaucccaacaauggacc

SEQ ID NO: 25239 - RNA, 21 nt, Artificial Sequence
  Marburg virus siRNA sense strand
aaaaaucccaacaauggacca

SEQ ID NO: 25240 - RNA, 21 nt, Artificial Sequence
  Marburg virus siRNA sense strand
aaaaucccaacaauggaccac

SEQ ID NO: 25241 - RNA, 21 nt, Artificial Sequence
  Marburg virus siRNA sense strand
aaaucccaacaauggaccacu

SEQ ID NO: 25242 - RNA, 21 nt, Artificial Sequence
  Marburg virus siRNA sense strand
aaucccaacaauggaccacug

SEQ ID NO: 25243 - RNA, 21 nt, Artificial Sequence
  Marburg virus siRNA sense strand
aucccaacaauggaccacugc

SEQ ID NO: 25244 - RNA, 21 nt, Artificial Sequence
  Marburg virus siRNA sense strand
ucccaacaauggaccacugcu

SEQ ID NO: 25245 - RNA, 21 nt, Artificial Sequence
  Marburg virus siRNA sense strand
cccaacaauggaccacugcug

SEQ ID NO: 25246 - RNA, 21 nt, Artificial Sequence
  Marburg virus siRNA sense strand
ccaacaauggaccacugcugg

SEQ ID NO: 25247 - RNA, 21 nt, Artificial Sequence
  Marburg virus siRNA sense strand
caacaauggaccacugcuggc

SEQ ID NO: 25248 - RNA, 21 nt, Artificial Sequence
  Marburg virus siRNA sense strand
aacaauggaccacugcuggcc

SEQ ID NO: 25249 - RNA, 21 nt, Artificial Sequence
  Marburg virus siRNA sense strand
acaauggaccacugcuggcca

SEQ ID NO: 25250 - RNA, 21 nt, Artificial Sequence
  Marburg virus siRNA sense strand
caauggaccacugcuggccau

SEQ ID NO: 25251 - RNA, 21 nt, Artificial Sequence
  Marburg virus siRNA sense strand
aauggaccacugcuggccaua

SEQ ID NO: 25252 - RNA, 21 nt, Artificial Sequence
  Marburg virus siRNA sense strand
auggaccacugcuggccauau

SEQ ID NO: 25253 - RNA, 21 nt, Artificial Sequence
  Marburg virus siRNA sense strand
uggaccacugcuggccauauc

SEQ ID NO: 25254 - RNA, 21 nt, Artificial Sequence
  Marburg virus siRNA sense strand
ggaccacugcuggccauaucu

SEQ ID NO: 25255 - RNA, 21 nt, Artificial Sequence
  Marburg virus siRNA sense strand
gaccacugcuggccauaucug

SEQ ID NO: 25256 - RNA, 21 nt, Artificial Sequence
  Marburg virus siRNA sense strand
accacugcuggccauaucugg

SEQ ID NO: 25257 - RNA, 21 nt, Artificial Sequence
  Marburg virus siRNA sense strand
ccacugcuggccauaucuggc

SEQ ID NO: 25258 - RNA, 21 nt, Artificial Sequence
  Marburg virus siRNA sense strand
cacugcuggccauaucuggca

SEQ ID NO: 25259 - RNA, 21 nt, Artificial Sequence
  Marburg virus siRNA sense strand
acugcuggccauaucuggcau

SEQ ID NO: 25260 - RNA, 21 nt, Artificial Sequence
  Marburg virus siRNA sense strand
cugcuggccauaucuggcauc

SEQ ID NO: 25261 - RNA, 21 nt, Artificial Sequence
  Marburg virus siRNA sense strand
ugcuggccauaucuggcaucc

SEQ ID NO: 25262 - RNA, 21 nt, Artificial Sequence
  Marburg virus siRNA sense strand
gcuggccauaucuggcauccu

SEQ ID NO: 25263 - RNA, 21 nt, Artificial Sequence
  Marburg virus siRNA sense strand
cuggccauaucuggcauccuu

SEQ ID NO: 25264 - RNA, 21 nt, Artificial Sequence
  Marburg virus siRNA sense strand
uggccauaucuggcauccuuc

SEQ ID NO: 25265 - RNA, 21 nt, Artificial Sequence
  Marburg virus siRNA sense strand
ggccauaucuggcauccuuca

SEQ ID NO: 25266 - RNA, 21 nt, Artificial Sequence
  Marburg virus siRNA sense strand
gccauaucuggcauccuucac

SEQ ID NO: 25267 - RNA, 21 nt, Artificial Sequence
  Marburg virus siRNA sense strand
ccauaucuggcauccuucacc

SEQ ID NO: 25268 - RNA, 21 nt, Artificial Sequence
  Marburg virus siRNA sense strand
cauaucuggcauccuucacca

SEQ ID NO: 25269 - RNA, 21 nt, Artificial Sequence
  Marburg virus siRNA sense strand
auaucuggcauccuucaccaa

SEQ ID NO: 25270 - RNA, 21 nt, Artificial Sequence
  Marburg virus siRNA sense strand
uaucuggcauccuucaccaac

SEQ ID NO: 25271 - RNA, 21 nt, Artificial Sequence
  Marburg virus siRNA sense strand
aucuggcauccuucaccaacu

SEQ ID NO: 25272 - RNA, 21 nt, Artificial Sequence
  Marburg virus siRNA sense strand
ucuggcauccuucaccaacug

SEQ ID NO: 25273 - RNA, 21 nt, Artificial Sequence
  Marburg virus siRNA sense strand
cuggcauccuucaccaacuga

SEQ ID NO: 25274 - RNA, 21 nt, Artificial Sequence
  Marburg virus siRNA sense strand
uggcauccuucaccaacugag

SEQ ID NO: 25275 - RNA, 21 nt, Artificial Sequence
  Marburg virus siRNA sense strand
ggcauccuucaccaacugagg

SEQ ID NO: 25276 - RNA, 21 nt, Artificial Sequence
  Marburg virus siRNA sense strand
gcauccuucaccaacugaggg

SEQ ID NO: 25277 - RNA, 21 nt, Artificial Sequence
  Marburg virus siRNA sense strand
cauccuucaccaacugagggu

SEQ ID NO: 25278 - RNA, 21 nt, Artificial Sequence
  Marburg virus siRNA sense strand
auccuucaccaacugaggguc

SEQ ID NO: 25279 - RNA, 21 nt, Artificial Sequence
  Marburg virus siRNA sense strand
uccuucaccaacugagggucg

SEQ ID NO: 25280 - RNA, 21 nt, Artificial Sequence
  Marburg virus siRNA sense strand
ccuucaccaacugagggucga

SEQ ID NO: 25281 - RNA, 21 nt, Artificial Sequence
  Marburg virus siRNA sense strand
cuucaccaacugagggucgag

SEQ ID NO: 25282 - RNA, 21 nt, Artificial Sequence
  Marburg virus siRNA sense strand
uucaccaacugagggucgaga

SEQ ID NO: 25283 - RNA, 21 nt, Artificial Sequence
  Marburg virus siRNA sense strand
ucaccaacugagggucgagaa

SEQ ID NO: 25284 - RNA, 21 nt, Artificial Sequence
  Marburg virus siRNA sense strand
caccaacugagggucgagaaa

SEQ ID NO: 25285 - RNA, 21 nt, Artificial Sequence
  Marburg virus siRNA sense strand
accaacugagggucgagaaag

SEQ ID NO: 25286 - RNA, 21 nt, Artificial Sequence
  Marburg virus siRNA sense strand
ccaacugagggucgagaaagu

SEQ ID NO: 25287 - RNA, 21 nt, Artificial Sequence
  Marburg virus siRNA sense strand
caacugagggucgagaaaguc

SEQ ID NO: 25288 - RNA, 21 nt, Artificial Sequence
  Marburg virus siRNA sense strand
aacugagggucgagaaagucc

SEQ ID NO: 25289 - RNA, 21 nt, Artificial Sequence
  Marburg virus siRNA sense strand
acugagggucgagaaaguccc

SEQ ID NO: 25290 - RNA, 21 nt, Artificial Sequence
  Marburg virus siRNA sense strand
cugagggucgagaaaguccca

SEQ ID NO: 25291 - RNA, 21 nt, Artificial Sequence
  Marburg virus siRNA sense strand
ugagggucgagaaagucccag

SEQ ID NO: 25292 - RNA, 21 nt, Artificial Sequence
  Marburg virus siRNA sense strand
gagggucgagaaagucccaga

SEQ ID NO: 25293 - RNA, 21 nt, Artificial Sequence
  Marburg virus siRNA sense strand
agggucgagaaagucccagag

SEQ ID NO: 25294 - RNA, 21 nt, Artificial Sequence
  Marburg virus siRNA sense strand
gggucgagaaagucccagaga

SEQ ID NO: 25295 - RNA, 21 nt, Artificial Sequence
  Marburg virus siRNA sense strand
ggucgagaaagucccagagaa

SEQ ID NO: 25296 - RNA, 21 nt, Artificial Sequence
  Marburg virus siRNA sense strand
gucgagaaagucccagagaag

SEQ ID NO: 25297 - RNA, 21 nt, Artificial Sequence
  Marburg virus siRNA sense strand
ucgagaaagucccagagaaga

SEQ ID NO: 25298 - RNA, 21 nt, Artificial Sequence
  Marburg virus siRNA sense strand
cgagaaagucccagagaagac

SEQ ID NO: 25299 - RNA, 21 nt, Artificial Sequence
  Marburg virus siRNA sense strand
gagaaagucccagagaagaca

SEQ ID NO: 25300 - RNA, 21 nt, Artificial Sequence
  Marburg virus siRNA sense strand
agaaagucccagagaagacaa

SEQ ID NO: 25301 - RNA, 21 nt, Artificial Sequence
  Marburg virus siRNA sense strand
gaaagucccagagaagacaag

SEQ ID NO: 25302 - RNA, 21 nt, Artificial Sequence
  Marburg virus siRNA sense strand
aaagucccagagaagacaagc

SEQ ID NO: 25303 - RNA, 21 nt, Artificial Sequence
  Marburg virus siRNA sense strand
aagucccagagaagacaagcc

SEQ ID NO: 25304 - RNA, 21 nt, Artificial Sequence
  Marburg virus siRNA sense strand
agucccagagaagacaagccu

SEQ ID NO: 25305 - RNA, 21 nt, Artificial Sequence
  Marburg virus siRNA sense strand
gucccagagaagacaagccug

SEQ ID NO: 25306 - RNA, 21 nt, Artificial Sequence
  Marburg virus siRNA sense strand
ucccagagaagacaagccugu

SEQ ID NO: 25307 - RNA, 21 nt, Artificial Sequence
  Marburg virus siRNA sense strand
cccagagaagacaagccuguu

SEQ ID NO: 25308 - RNA, 21 nt, Artificial Sequence
  Marburg virus siRNA sense strand
ccagagaagacaagccuguuu

SEQ ID NO: 25309 - RNA, 21 nt, Artificial Sequence
  Marburg virus siRNA sense strand
cagagaagacaagccuguuua

SEQ ID NO: 25310 - RNA, 21 nt, Artificial Sequence
  Marburg virus siRNA sense strand
agagaagacaagccuguuuag

SEQ ID NO: 25311 - RNA, 21 nt, Artificial Sequence
  Marburg virus siRNA sense strand
gagaagacaagccuguuuagg

SEQ ID NO: 25312 - RNA, 21 nt, Artificial Sequence
  Marburg virus siRNA sense strand
agaagacaagccuguuuagga

SEQ ID NO: 25313 - RNA, 21 nt, Artificial Sequence
  Marburg virus siRNA sense strand
gaagacaagccuguuuaggau

SEQ ID NO: 25314 - RNA, 21 nt, Artificial Sequence
  Marburg virus siRNA sense strand
aagacaagccuguuuaggauu

SEQ ID NO: 25315 - RNA, 21 nt, Artificial Sequence
  Marburg virus siRNA sense strand
agacaagccuguuuaggauuu

SEQ ID NO: 25316 - RNA, 21 nt, Artificial Sequence
  Marburg virus siRNA sense strand
gacaagccuguuuaggauuuc

SEQ ID NO: 25317 - RNA, 21 nt, Artificial Sequence
  Marburg virus siRNA sense strand
acaagccuguuuaggauuuca

SEQ ID NO: 25318 - RNA, 21 nt, Artificial Sequence
  Marburg virus siRNA sense strand
caagccuguuuaggauuucac

SEQ ID NO: 25319 - RNA, 21 nt, Artificial Sequence
  Marburg virus siRNA sense strand
aagccuguuuaggauuucacu

SEQ ID NO: 25320 - RNA, 21 nt, Artificial Sequence
  Marburg virus siRNA sense strand
agccuguuuaggauuucacuu

SEQ ID NO: 25321 - RNA, 21 nt, Artificial Sequence
  Marburg virus siRNA sense strand
gccuguuuaggauuucacuuc

SEQ ID NO: 25322 - RNA, 21 nt, Artificial Sequence
  Marburg virus siRNA sense strand
ccuguuuaggauuucacuucc

SEQ ID NO: 25323 - RNA, 21 nt, Artificial Sequence
  Marburg virus siRNA sense strand
cuguuuaggauuucacuuccu

SEQ ID NO: 25324 - RNA, 21 nt, Artificial Sequence
  Marburg virus siRNA sense strand
uguuuaggauuucacuuccug

SEQ ID NO: 25325 - RNA, 21 nt, Artificial Sequence
  Marburg virus siRNA sense strand
guuuaggauuucacuuccugc

SEQ ID NO: 25326 - RNA, 21 nt, Artificial Sequence
  Marburg virus siRNA sense strand
uuuaggauuucacuuccugcc

SEQ ID NO: 25327 - RNA, 21 nt, Artificial Sequence
  Marburg virus siRNA sense strand
uuaggauuucacuuccugccg

SEQ ID NO: 25328 - RNA, 21 nt, Artificial Sequence
  Marburg virus siRNA sense strand
uaggauuucacuuccugccga

SEQ ID NO: 25329 - RNA, 21 nt, Artificial Sequence
  Marburg virus siRNA sense strand
aggauuucacuuccugccgau

SEQ ID NO: 25330 - RNA, 21 nt, Artificial Sequence
  Marburg virus siRNA sense strand
ggauuucacuuccugccgaua

SEQ ID NO: 25331 - RNA, 21 nt, Artificial Sequence
  Marburg virus siRNA sense strand
gauuucacuuccugccgauau

SEQ ID NO: 25332 - RNA, 21 nt, Artificial Sequence
  Marburg virus siRNA sense strand
auuucacuuccugccgauaug

SEQ ID NO: 25333 - RNA, 21 nt, Artificial Sequence
  Marburg virus siRNA sense strand
uuucacuuccugccgauaugu

SEQ ID NO: 25334 - RNA, 21 nt, Artificial Sequence
  Marburg virus siRNA sense strand
uucacuuccugccgauauguu

SEQ ID NO: 25335 - RNA, 21 nt, Artificial Sequence
  Marburg virus siRNA sense strand
ucacuuccugccgauauguuc

SEQ ID NO: 25336 - RNA, 21 nt, Artificial Sequence
  Marburg virus siRNA sense strand
cacuuccugccgauauguucu

SEQ ID NO: 25337 - RNA, 21 nt, Artificial Sequence
  Marburg virus siRNA sense strand
acuuccugccgauauguucuc

SEQ ID NO: 25338 - RNA, 21 nt, Artificial Sequence
  Marburg virus siRNA sense strand
cuuccugccgauauguucuca

SEQ ID NO: 25339 - RNA, 21 nt, Artificial Sequence
  Marburg virus siRNA sense strand
uuccugccgauauguucucag

SEQ ID NO: 25340 - RNA, 21 nt, Artificial Sequence
  Marburg virus siRNA sense strand
uccugccgauauguucucagu

SEQ ID NO: 25341 - RNA, 21 nt, Artificial Sequence
  Marburg virus siRNA sense strand
ccugccgauauguucucagua

SEQ ID NO: 25342 - RNA, 21 nt, Artificial Sequence
  Marburg virus siRNA sense strand
cugccgauauguucucaguaa

SEQ ID NO: 25343 - RNA, 21 nt, Artificial Sequence
  Marburg virus siRNA sense strand
ugccgauauguucucaguaaa

SEQ ID NO: 25344 - RNA, 21 nt, Artificial Sequence
  Marburg virus siRNA sense strand
gccgauauguucucaguaaaa

SEQ ID NO: 25345 - RNA, 21 nt, Artificial Sequence
  Marburg virus siRNA sense strand
ccgauauguucucaguaaaag

SEQ ID NO: 25346 - RNA, 21 nt, Artificial Sequence
  Marburg virus siRNA sense strand
cgauauguucucaguaaaaga

SEQ ID NO: 25347 - RNA, 21 nt, Artificial Sequence
  Marburg virus siRNA sense strand
gauauguucucaguaaaagaa

SEQ ID NO: 25348 - RNA, 21 nt, Artificial Sequence
  Marburg virus siRNA sense strand
auauguucucaguaaaagaag

SEQ ID NO: 25349 - RNA, 21 nt, Artificial Sequence
  Marburg virus siRNA sense strand
uauguucucaguaaaagaagg

SEQ ID NO: 25350 - RNA, 21 nt, Artificial Sequence
  Marburg virus siRNA sense strand
auguucucaguaaaagaaggu

SEQ ID NO: 25351 - RNA, 21 nt, Artificial Sequence
  Marburg virus siRNA sense strand
uguucucaguaaaagaaggua

SEQ ID NO: 25352 - RNA, 21 nt, Artificial Sequence
  Marburg virus siRNA sense strand
guucucaguaaaagaagguau

SEQ ID NO: 25353 - RNA, 21 nt, Artificial Sequence
  Marburg virus siRNA sense strand
uucucaguaaaagaagguaug

SEQ ID NO: 25354 - RNA, 21 nt, Artificial Sequence
  Marburg virus siRNA sense strand
ucucaguaaaagaagguauga

SEQ ID NO: 25355 - RNA, 21 nt, Artificial Sequence
  Marburg virus siRNA sense strand
cucaguaaaagaagguaugau

SEQ ID NO: 25356 - RNA, 21 nt, Artificial Sequence
  Marburg virus siRNA sense strand
ucaguaaaagaagguaugaug

SEQ ID NO: 25357 - RNA, 21 nt, Artificial Sequence
  Marburg virus siRNA sense strand
caguaaaagaagguaugauga

SEQ ID NO: 25358 - RNA, 21 nt, Artificial Sequence
  Marburg virus siRNA sense strand
aguaaaagaagguaugaugaa

SEQ ID NO: 25359 - RNA, 21 nt, Artificial Sequence
  Marburg virus siRNA sense strand
guaaaagaagguaugaugaag

SEQ ID NO: 25360 - RNA, 21 nt, Artificial Sequence
  Marburg virus siRNA sense strand
uaaaagaagguaugaugaaga

SEQ ID NO: 25361 - RNA, 21 nt, Artificial Sequence
  Marburg virus siRNA sense strand
aaaagaagguaugaugaagaa

SEQ ID NO: 25362 - RNA, 21 nt, Artificial Sequence
  Marburg virus siRNA sense strand
aaagaagguaugaugaagaaa

SEQ ID NO: 25363 - RNA, 21 nt, Artificial Sequence
  Marburg virus siRNA sense strand
aagaagguaugaugaagaaaa

SEQ ID NO: 25364 - RNA, 21 nt, Artificial Sequence
  Marburg virus siRNA sense strand
agaagguaugaugaagaaaag

SEQ ID NO: 25365 - RNA, 21 nt, Artificial Sequence
  Marburg virus siRNA sense strand
gaagguaugaugaagaaaagg

SEQ ID NO: 25366 - RNA, 21 nt, Artificial Sequence
  Marburg virus siRNA sense strand
aagguaugaugaagaaaaggg

SEQ ID NO: 25367 - RNA, 21 nt, Artificial Sequence
  Marburg virus siRNA sense strand
agguaugaugaagaaaagggg

SEQ ID NO: 25368 - RNA, 21 nt, Artificial Sequence
  Marburg virus siRNA sense strand
gguaugaugaagaaaagggga

SEQ ID NO: 25369 - RNA, 21 nt, Artificial Sequence
  Marburg virus siRNA sense strand
guaugaugaagaaaaggggag

SEQ ID NO: 25370 - RNA, 21 nt, Artificial Sequence
  Marburg virus siRNA sense strand
uaugaugaagaaaaggggaga

SEQ ID NO: 25371 - RNA, 21 nt, Artificial Sequence
  Marburg virus siRNA sense strand
augaugaagaaaaggggagaa

SEQ ID NO: 25372 - RNA, 21 nt, Artificial Sequence
  Marburg virus siRNA sense strand
ugaugaagaaaaggggagaaa

SEQ ID NO: 25373 - RNA, 21 nt, Artificial Sequence
  Marburg virus siRNA sense strand
gaugaagaaaaggggagaaaa

SEQ ID NO: 25374 - RNA, 21 nt, Artificial Sequence
  Marburg virus siRNA sense strand
augaagaaaaggggagaaaau

SEQ ID NO: 25375 - RNA, 21 nt, Artificial Sequence
  Marburg virus siRNA sense strand
ugaagaaaaggggagaaaauu

SEQ ID NO: 25376 - RNA, 21 nt, Artificial Sequence
  Marburg virus siRNA sense strand
gaagaaaaggggagaaaauuc

SEQ ID NO: 25377 - RNA, 21 nt, Artificial Sequence
  Marburg virus siRNA sense strand
aagaaaaggggagaaaauucc

SEQ ID NO: 25378 - RNA, 21 nt, Artificial Sequence
  Marburg virus siRNA sense strand
agaaaaggggagaaaauuccc

SEQ ID NO: 25379 - RNA, 21 nt, Artificial Sequence
  Marburg virus siRNA sense strand
gaaaaggggagaaaauucccc

SEQ ID NO: 25380 - RNA, 21 nt, Artificial Sequence
  Marburg virus siRNA sense strand
aaaaggggagaaaauuccccg

SEQ ID NO: 25381 - RNA, 21 nt, Artificial Sequence
  Marburg virus siRNA sense strand
aaaggggagaaaauuccccgg

SEQ ID NO: 25382 - RNA, 21 nt, Artificial Sequence
  Marburg virus siRNA sense strand
aaggggagaaaauuccccggu

SEQ ID NO: 25383 - RNA, 21 nt, Artificial Sequence
  Marburg virus siRNA sense strand
aggggagaaaauuccccggug

SEQ ID NO: 25384 - RNA, 21 nt, Artificial Sequence
  Marburg virus siRNA sense strand
ggggagaaaauuccccggugg

SEQ ID NO: 25385 - RNA, 21 nt, Artificial Sequence
  Marburg virus siRNA sense strand
gggagaaaauuccccgguggu

SEQ ID NO: 25386 - RNA, 21 nt, Artificial Sequence
  Marburg virus siRNA sense strand
ggagaaaauuccccggugguu

SEQ ID NO: 25387 - RNA, 21 nt, Artificial Sequence
  Marburg virus siRNA sense strand
gagaaaauuccccggugguuu

SEQ ID NO: 25388 - RNA, 21 nt, Artificial Sequence
  Marburg virus siRNA sense strand
agaaaauuccccggugguuua

SEQ ID NO: 25389 - RNA, 21 nt, Artificial Sequence
  Marburg virus siRNA sense strand
gaaaauuccccggugguuuau

SEQ ID NO: 25390 - RNA, 21 nt, Artificial Sequence
  Marburg virus siRNA sense strand
aaaauuccccggugguuuauu

SEQ ID NO: 25391 - RNA, 21 nt, Artificial Sequence
  Marburg virus siRNA sense strand
aaauuccccggugguuuauuu

SEQ ID NO: 25392 - RNA, 21 nt, Artificial Sequence
  Marburg virus siRNA sense strand
aauuccccggugguuuauuuu

SEQ ID NO: 25393 - RNA, 21 nt, Artificial Sequence
  Marburg virus siRNA sense strand
auuccccggugguuuauuuuc

SEQ ID NO: 25394 - RNA, 21 nt, Artificial Sequence
  Marburg virus siRNA sense strand
uuccccggugguuuauuuuca

SEQ ID NO: 25395 - RNA, 21 nt, Artificial Sequence
  Marburg virus siRNA sense strand
uccccggugguuuauuuucaa

SEQ ID NO: 25396 - RNA, 21 nt, Artificial Sequence
  Marburg virus siRNA sense strand
ccccggugguuuauuuucaag

SEQ ID NO: 25397 - RNA, 21 nt, Artificial Sequence
  Marburg virus siRNA sense strand
cccggugguuuauuuucaagc

SEQ ID NO: 25398 - RNA, 21 nt, Artificial Sequence
  Marburg virus siRNA sense strand
ccggugguuuauuuucaagca

SEQ ID NO: 25399 - RNA, 21 nt, Artificial Sequence
  Marburg virus siRNA sense strand
cggugguuuauuuucaagcac

SEQ ID NO: 25400 - RNA, 21 nt, Artificial Sequence
  Marburg virus siRNA sense strand
ggugguuuauuuucaagcacc

SEQ ID NO: 25401 - RNA, 21 nt, Artificial Sequence
  Marburg virus siRNA sense strand
gugguuuauuuucaagcaccu

SEQ ID NO: 25402 - RNA, 21 nt, Artificial Sequence
  Marburg virus siRNA sense strand
ugguuuauuuucaagcaccug

SEQ ID NO: 25403 - RNA, 21 nt, Artificial Sequence
  Marburg virus siRNA sense strand
gguuuauuuucaagcaccuga

SEQ ID NO: 25404 - RNA, 21 nt, Artificial Sequence
  Marburg virus siRNA sense strand
guuuauuuucaagcaccugag

SEQ ID NO: 25405 - RNA, 21 nt, Artificial Sequence
  Marburg virus siRNA sense strand
uuuauuuucaagcaccugaga

SEQ ID NO: 25406 - RNA, 21 nt, Artificial Sequence
  Marburg virus siRNA sense strand
uuauuuucaagcaccugagaa

SEQ ID NO: 25407 - RNA, 21 nt, Artificial Sequence
  Marburg virus siRNA sense strand
uauuuucaagcaccugagaac

SEQ ID NO: 25408 - RNA, 21 nt, Artificial Sequence
  Marburg virus siRNA sense strand
auuuucaagcaccugagaacu

SEQ ID NO: 25409 - RNA, 21 nt, Artificial Sequence
  Marburg virus siRNA sense strand
uuuucaagcaccugagaacuu

SEQ ID NO: 25410 - RNA, 21 nt, Artificial Sequence
  Marburg virus siRNA sense strand
uuucaagcaccugagaacuuc

SEQ ID NO: 25411 - RNA, 21 nt, Artificial Sequence
  Marburg virus siRNA sense strand
uucaagcaccugagaacuucc

SEQ ID NO: 25412 - RNA, 21 nt, Artificial Sequence
  Marburg virus siRNA sense strand
ucaagcaccugagaacuuccc

SEQ ID NO: 25413 - RNA, 21 nt, Artificial Sequence
  Marburg virus siRNA sense strand
caagcaccugagaacuucccu

SEQ ID NO: 25414 - RNA, 21 nt, Artificial Sequence
  Marburg virus siRNA sense strand
aagcaccugagaacuucccuu

SEQ ID NO: 25415 - RNA, 21 nt, Artificial Sequence
  Marburg virus siRNA sense strand
agcaccugagaacuucccuuu

SEQ ID NO: 25416 - RNA, 21 nt, Artificial Sequence
  Marburg virus siRNA sense strand
gcaccugagaacuucccuuug

SEQ ID NO: 25417 - RNA, 21 nt, Artificial Sequence
  Marburg virus siRNA sense strand
caccugagaacuucccuuuga

SEQ ID NO: 25418 - RNA, 21 nt, Artificial Sequence
  Marburg virus siRNA sense strand
accugagaacuucccuuugaa

SEQ ID NO: 25419 - RNA, 21 nt, Artificial Sequence
  Marburg virus siRNA sense strand
ccugagaacuucccuuugaau

SEQ ID NO: 25420 - RNA, 21 nt, Artificial Sequence
  Marburg virus siRNA sense strand
cugagaacuucccuuugaaug

SEQ ID NO: 25421 - RNA, 21 nt, Artificial Sequence
  Marburg virus siRNA sense strand
ugagaacuucccuuugaaugg

SEQ ID NO: 25422 - RNA, 21 nt, Artificial Sequence
  Marburg virus siRNA sense strand
gagaacuucccuuugaauggc

SEQ ID NO: 25423 - RNA, 21 nt, Artificial Sequence
  Marburg virus siRNA sense strand
agaacuucccuuugaauggcu

SEQ ID NO: 25424 - RNA, 21 nt, Artificial Sequence
  Marburg virus siRNA sense strand
gaacuucccuuugaauggcuu

SEQ ID NO: 25425 - RNA, 21 nt, Artificial Sequence
  Marburg virus siRNA sense strand
aacuucccuuugaauggcuuc

SEQ ID NO: 25426 - RNA, 21 nt, Artificial Sequence
  Marburg virus siRNA sense strand
acuucccuuugaauggcuuca

SEQ ID NO: 25427 - RNA, 21 nt, Artificial Sequence
  Marburg virus siRNA sense strand
cuucccuuugaauggcuucaa

SEQ ID NO: 25428 - RNA, 21 nt, Artificial Sequence
  Marburg virus siRNA sense strand
uucccuuugaauggcuucaac

SEQ ID NO: 25429 - RNA, 21 nt, Artificial Sequence
  Marburg virus siRNA sense strand
ucccuuugaauggcuucaaca

SEQ ID NO: 25430 - RNA, 21 nt, Artificial Sequence
  Marburg virus siRNA sense strand
cccuuugaauggcuucaacaa

SEQ ID NO: 25431 - RNA, 21 nt, Artificial Sequence
  Marburg virus siRNA sense strand
ccuuugaauggcuucaacaac

SEQ ID NO: 25432 - RNA, 21 nt, Artificial Sequence
  Marburg virus siRNA sense strand
cuuugaauggcuucaacaaca

SEQ ID NO: 25433 - RNA, 21 nt, Artificial Sequence
  Marburg virus siRNA sense strand
uuugaauggcuucaacaacag

SEQ ID NO: 25434 - RNA, 21 nt, Artificial Sequence
  Marburg virus siRNA sense strand
uugaauggcuucaacaacaga

SEQ ID NO: 25435 - RNA, 21 nt, Artificial Sequence
  Marburg virus siRNA sense strand
ugaauggcuucaacaacagac

SEQ ID NO: 25436 - RNA, 21 nt, Artificial Sequence
  Marburg virus siRNA sense strand
gaauggcuucaacaacagaca

SEQ ID NO: 25437 - RNA, 21 nt, Artificial Sequence
  Marburg virus siRNA sense strand
aauggcuucaacaacagacaa

SEQ ID NO: 25438 - RNA, 21 nt, Artificial Sequence
  Marburg virus siRNA sense strand
auggcuucaacaacagacaag

SEQ ID NO: 25439 - RNA, 21 nt, Artificial Sequence
  Marburg virus siRNA sense strand
uggcuucaacaacagacaagu

SEQ ID NO: 25440 - RNA, 21 nt, Artificial Sequence
  Marburg virus siRNA sense strand
ggcuucaacaacagacaaguu

SEQ ID NO: 25441 - RNA, 21 nt, Artificial Sequence
  Marburg virus siRNA sense strand
gcuucaacaacagacaaguug

SEQ ID NO: 25442 - RNA, 21 nt, Artificial Sequence
  Marburg virus siRNA sense strand
cuucaacaacagacaaguugu

SEQ ID NO: 25443 - RNA, 21 nt, Artificial Sequence
  Marburg virus siRNA sense strand
uucaacaacagacaaguugua

SEQ ID NO: 25444 - RNA, 21 nt, Artificial Sequence
  Marburg virus siRNA sense strand
ucaacaacagacaaguuguac

SEQ ID NO: 25445 - RNA, 21 nt, Artificial Sequence
  Marburg virus siRNA sense strand
caacaacagacaaguuguacu

SEQ ID NO: 25446 - RNA, 21 nt, Artificial Sequence
  Marburg virus siRNA sense strand
aacaacagacaaguuguacua

SEQ ID NO: 25447 - RNA, 21 nt, Artificial Sequence
  Marburg virus siRNA sense strand
acaacagacaaguuguacuag

SEQ ID NO: 25448 - RNA, 21 nt, Artificial Sequence
  Marburg virus siRNA sense strand
caacagacaaguuguacuagc

SEQ ID NO: 25449 - RNA, 21 nt, Artificial Sequence
  Marburg virus siRNA sense strand
aacagacaaguuguacuagcg

SEQ ID NO: 25450 - RNA, 21 nt, Artificial Sequence
  Marburg virus siRNA sense strand
acagacaaguuguacuagcgu

SEQ ID NO: 25451 - RNA, 21 nt, Artificial Sequence
  Marburg virus siRNA sense strand
cagacaaguuguacuagcgua

SEQ ID NO: 25452 - RNA, 21 nt, Artificial Sequence
  Marburg virus siRNA sense strand
agacaaguuguacuagcguau

SEQ ID NO: 25453 - RNA, 21 nt, Artificial Sequence
  Marburg virus siRNA sense strand
gacaaguuguacuagcguaug

SEQ ID NO: 25454 - RNA, 21 nt, Artificial Sequence
  Marburg virus siRNA sense strand
acaaguuguacuagcguaugc

SEQ ID NO: 25455 - RNA, 21 nt, Artificial Sequence
  Marburg virus siRNA sense strand
caaguuguacuagcguaugcg

SEQ ID NO: 25456 - RNA, 21 nt, Artificial Sequence
  Marburg virus siRNA sense strand
aaguuguacuagcguaugcga

SEQ ID NO: 25457 - RNA, 21 nt, Artificial Sequence
  Marburg virus siRNA sense strand
aguuguacuagcguaugcgaa

SEQ ID NO: 25458 - RNA, 21 nt, Artificial Sequence
  Marburg virus siRNA sense strand
guuguacuagcguaugcgaau

SEQ ID NO: 25459 - RNA, 21 nt, Artificial Sequence
  Marburg virus siRNA sense strand
uuguacuagcguaugcgaauc

SEQ ID NO: 25460 - RNA, 21 nt, Artificial Sequence
  Marburg virus siRNA sense strand
uguacuagcguaugcgaaucc

SEQ ID NO: 25461 - RNA, 21 nt, Artificial Sequence
  Marburg virus siRNA sense strand
guacuagcguaugcgaaucca

SEQ ID NO: 25462 - RNA, 21 nt, Artificial Sequence
  Marburg virus siRNA sense strand
uacuagcguaugcgaauccaa

SEQ ID NO: 25463 - RNA, 21 nt, Artificial Sequence
  Marburg virus siRNA sense strand
acuagcguaugcgaauccaac

SEQ ID NO: 25464 - RNA, 21 nt, Artificial Sequence
  Marburg virus siRNA sense strand
cuagcguaugcgaauccaacg

SEQ ID NO: 25465 - RNA, 21 nt, Artificial Sequence
  Marburg virus siRNA sense strand
uagcguaugcgaauccaacgc

SEQ ID NO: 25466 - RNA, 21 nt, Artificial Sequence
  Marburg virus siRNA sense strand
agcguaugcgaauccaacgcu

SEQ ID NO: 25467 - RNA, 21 nt, Artificial Sequence
  Marburg virus siRNA sense strand
gcguaugcgaauccaacgcuc

SEQ ID NO: 25468 - RNA, 21 nt, Artificial Sequence
  Marburg virus siRNA sense strand
cguaugcgaauccaacgcuca

SEQ ID NO: 25469 - RNA, 21 nt, Artificial Sequence
  Marburg virus siRNA sense strand
guaugcgaauccaacgcucag

SEQ ID NO: 25470 - RNA, 21 nt, Artificial Sequence
  Marburg virus siRNA sense strand
uaugcgaauccaacgcucagu

SEQ ID NO: 25471 - RNA, 21 nt, Artificial Sequence
  Marburg virus siRNA sense strand
augcgaauccaacgcucagug

SEQ ID NO: 25472 - RNA, 21 nt, Artificial Sequence
  Marburg virus siRNA sense strand
ugcgaauccaacgcucagugc

SEQ ID NO: 25473 - RNA, 21 nt, Artificial Sequence
  Marburg virus siRNA sense strand
gcgaauccaacgcucagugcc

SEQ ID NO: 25474 - RNA, 21 nt, Artificial Sequence
  Marburg virus siRNA sense strand
cgaauccaacgcucagugccg

SEQ ID NO: 25475 - RNA, 21 nt, Artificial Sequence
  Marburg virus siRNA sense strand
gaauccaacgcucagugccgu

SEQ ID NO: 25476 - RNA, 21 nt, Artificial Sequence
  Marburg virus siRNA sense strand
aauccaacgcucagugccguu

SEQ ID NO: 25477 - RNA, 21 nt, Artificial Sequence
  Marburg virus siRNA sense strand
auccaacgcucagugccguuu

SEQ ID NO: 25478 - RNA, 21 nt, Artificial Sequence
  Marburg virus siRNA sense strand
uccaacgcucagugccguuug

SEQ ID NO: 25479 - RNA, 21 nt, Artificial Sequence
  Marburg virus siRNA sense strand
ccaacgcucagugccguuuga

SEQ ID NO: 25480 - RNA, 21 nt, Artificial Sequence
  Marburg virus siRNA sense strand
caacgcucagugccguuugaa

SEQ ID NO: 25481 - RNA, 21 nt, Artificial Sequence
  Marburg virus siRNA sense strand
aacgcucagugccguuugaaa

SEQ ID NO: 25482 - RNA, 21 nt, Artificial Sequence
  Marburg virus siRNA sense strand
acgcucagugccguuugaaau

SEQ ID NO: 25483 - RNA, 21 nt, Artificial Sequence
  Marburg virus siRNA sense strand
cgcucagugccguuugaaaua

SEQ ID NO: 25484 - RNA, 21 nt, Artificial Sequence
  Marburg virus siRNA sense strand
gcucagugccguuugaaauaa

SEQ ID NO: 25485 - RNA, 21 nt, Artificial Sequence
  Marburg virus siRNA sense strand
cucagugccguuugaaauaau

SEQ ID NO: 25486 - RNA, 21 nt, Artificial Sequence
  Marburg virus siRNA sense strand
ucagugccguuugaaauaaug

SEQ ID NO: 25487 - RNA, 21 nt, Artificial Sequence
  Marburg virus siRNA sense strand
cagugccguuugaaauaaugc

SEQ ID NO: 25488 - RNA, 21 nt, Artificial Sequence
  Marburg virus siRNA sense strand
agugccguuugaaauaaugcu

SEQ ID NO: 25489 - RNA, 21 nt, Artificial Sequence
  Marburg virus siRNA sense strand
gugccguuugaaauaaugcuc

SEQ ID NO: 25490 - RNA, 21 nt, Artificial Sequence
  Marburg virus siRNA sense strand
ugccguuugaaauaaugcuca

SEQ ID NO: 25491 - RNA, 21 nt, Artificial Sequence
  Marburg virus siRNA sense strand
gccguuugaaauaaugcucaa

SEQ ID NO: 25492 - RNA, 21 nt, Artificial Sequence
  Marburg virus siRNA sense strand
ccguuugaaauaaugcucaaa

SEQ ID NO: 25493 - RNA, 21 nt, Artificial Sequence
  Marburg virus siRNA sense strand
cguuugaaauaaugcucaaau

SEQ ID NO: 25494 - RNA, 21 nt, Artificial Sequence
  Marburg virus siRNA sense strand
guuugaaauaaugcucaaaug

SEQ ID NO: 25495 - RNA, 21 nt, Artificial Sequence
  Marburg virus siRNA sense strand
uuugaaauaaugcucaaauga

SEQ ID NO: 25496 - RNA, 21 nt, Artificial Sequence
  Marburg virus siRNA sense strand
uugaaauaaugcucaaaugag

SEQ ID NO: 25497 - RNA, 21 nt, Artificial Sequence
  Marburg virus siRNA sense strand
ugaaauaaugcucaaaugaga

SEQ ID NO: 25498 - RNA, 21 nt, Artificial Sequence
  Marburg virus siRNA sense strand
gaaauaaugcucaaaugagac

SEQ ID NO: 25499 - RNA, 21 nt, Artificial Sequence
  Marburg virus siRNA sense strand
aaauaaugcucaaaugagaca

SEQ ID NO: 25500 - RNA, 21 nt, Artificial Sequence
  Marburg virus siRNA sense strand
aauaaugcucaaaugagacag

SEQ ID NO: 25501 - RNA, 21 nt, Artificial Sequence
  Marburg virus siRNA sense strand
auaaugcucaaaugagacagg

SEQ ID NO: 25502 - RNA, 21 nt, Artificial Sequence
  Marburg virus siRNA sense strand
uaaugcucaaaugagacagga

SEQ ID NO: 25503 - RNA, 21 nt, Artificial Sequence
  Marburg virus siRNA sense strand
aaugcucaaaugagacaggag

SEQ ID NO: 25504 - RNA, 21 nt, Artificial Sequence
  Marburg virus siRNA sense strand
augcucaaaugagacaggagu

SEQ ID NO: 25505 - RNA, 21 nt, Artificial Sequence
  Marburg virus siRNA sense strand
ugcucaaaugagacaggaguc

SEQ ID NO: 25506 - RNA, 21 nt, Artificial Sequence
  Marburg virus siRNA sense strand
gcucaaaugagacaggagucc

SEQ ID NO: 25507 - RNA, 21 nt, Artificial Sequence
  Marburg virus siRNA sense strand
cucaaaugagacaggagucca

SEQ ID NO: 25508 - RNA, 21 nt, Artificial Sequence
  Marburg virus siRNA sense strand
ucaaaugagacaggaguccau

SEQ ID NO: 25509 - RNA, 21 nt, Artificial Sequence
  Marburg virus siRNA sense strand
caaaugagacaggaguccauc

SEQ ID NO: 25510 - RNA, 21 nt, Artificial Sequence
  Marburg virus siRNA sense strand
aaaugagacaggaguccaucu

SEQ ID NO: 25511 - RNA, 21 nt, Artificial Sequence
  Marburg virus siRNA sense strand
aaugagacaggaguccaucug

SEQ ID NO: 25512 - RNA, 21 nt, Artificial Sequence
  Marburg virus siRNA sense strand
augagacaggaguccaucugc

SEQ ID NO: 25513 - RNA, 21 nt, Artificial Sequence
  Marburg virus siRNA sense strand
ugagacaggaguccaucugca

SEQ ID NO: 25514 - RNA, 21 nt, Artificial Sequence
  Marburg virus siRNA sense strand
gagacaggaguccaucugcau

SEQ ID NO: 25515 - RNA, 21 nt, Artificial Sequence
  Marburg virus siRNA sense strand
agacaggaguccaucugcaua

SEQ ID NO: 25516 - RNA, 21 nt, Artificial Sequence
  Marburg virus siRNA sense strand
gacaggaguccaucugcauaa

SEQ ID NO: 25517 - RNA, 21 nt, Artificial Sequence
  Marburg virus siRNA sense strand
acaggaguccaucugcauaag

SEQ ID NO: 25518 - RNA, 21 nt, Artificial Sequence
  Marburg virus siRNA sense strand
caggaguccaucugcauaaga

SEQ ID NO: 25519 - RNA, 21 nt, Artificial Sequence
  Marburg virus siRNA sense strand
aggaguccaucugcauaagaa

SEQ ID NO: 25520 - RNA, 21 nt, Artificial Sequence
  Marburg virus siRNA sense strand
ggaguccaucugcauaagaag

SEQ ID NO: 25521 - RNA, 21 nt, Artificial Sequence
  Marburg virus siRNA sense strand
gaguccaucugcauaagaagc

SEQ ID NO: 25522 - RNA, 21 nt, Artificial Sequence
  Marburg virus siRNA sense strand
aguccaucugcauaagaagca

SEQ ID NO: 25523 - RNA, 21 nt, Artificial Sequence
  Marburg virus siRNA sense strand
guccaucugcauaagaagcau

SEQ ID NO: 25524 - RNA, 21 nt, Artificial Sequence
  Marburg virus siRNA sense strand
uccaucugcauaagaagcaug

SEQ ID NO: 25525 - RNA, 21 nt, Artificial Sequence
  Marburg virus siRNA sense strand
ccaucugcauaagaagcaugg

SEQ ID NO: 25526 - RNA, 21 nt, Artificial Sequence
  Marburg virus siRNA sense strand
caucugcauaagaagcauggc

SEQ ID NO: 25527 - RNA, 21 nt, Artificial Sequence
  Marburg virus siRNA sense strand
aucugcauaagaagcauggcc

SEQ ID NO: 25528 - RNA, 21 nt, Artificial Sequence
  Marburg virus siRNA sense strand
ucugcauaagaagcauggccu

SEQ ID NO: 25529 - RNA, 21 nt, Artificial Sequence
  Marburg virus siRNA sense strand
cugcauaagaagcauggccua

SEQ ID NO: 25530 - RNA, 21 nt, Artificial Sequence
  Marburg virus siRNA sense strand
ugcauaagaagcauggccuaa

SEQ ID NO: 25531 - RNA, 21 nt, Artificial Sequence
  Marburg virus siRNA sense strand
gcauaagaagcauggccuaaa

SEQ ID NO: 25532 - RNA, 21 nt, Artificial Sequence
  Marburg virus siRNA sense strand
cauaagaagcauggccuaaau

SEQ ID NO: 25533 - RNA, 21 nt, Artificial Sequence
  Marburg virus siRNA sense strand
auaagaagcauggccuaaaug

SEQ ID NO: 25534 - RNA, 21 nt, Artificial Sequence
  Marburg virus siRNA sense strand
uaagaagcauggccuaaaugg

SEQ ID NO: 25535 - RNA, 21 nt, Artificial Sequence
  Marburg virus siRNA sense strand
aagaagcauggccuaaauggg

SEQ ID NO: 25536 - RNA, 21 nt, Artificial Sequence
  Marburg virus siRNA sense strand
agaagcauggccuaaaugggu

SEQ ID NO: 25537 - RNA, 21 nt, Artificial Sequence
  Marburg virus siRNA sense strand
gaagcauggccuaaaugggug

SEQ ID NO: 25538 - RNA, 21 nt, Artificial Sequence
  Marburg virus siRNA sense strand
aagcauggccuaaaugggugu

SEQ ID NO: 25539 - RNA, 21 nt, Artificial Sequence
  Marburg virus siRNA sense strand
agcauggccuaaauggguguc

SEQ ID NO: 25540 - RNA, 21 nt, Artificial Sequence
  Marburg virus siRNA sense strand
gcauggccuaaaugggugucu

SEQ ID NO: 25541 - RNA, 21 nt, Artificial Sequence
  Marburg virus siRNA sense strand
cauggccuaaaugggugucug

SEQ ID NO: 25542 - RNA, 21 nt, Artificial Sequence
  Marburg virus siRNA sense strand
auggccuaaaugggugucugu

SEQ ID NO: 25543 - RNA, 21 nt, Artificial Sequence
  Marburg virus siRNA sense strand
uggccuaaaugggugucuguu

SEQ ID NO: 25544 - RNA, 21 nt, Artificial Sequence
  Marburg virus siRNA sense strand
ggccuaaaugggugucuguua

SEQ ID NO: 25545 - RNA, 21 nt, Artificial Sequence
  Marburg virus siRNA sense strand
gccuaaaugggugucuguuaa

SEQ ID NO: 25546 - RNA, 21 nt, Artificial Sequence
  Marburg virus siRNA sense strand
ccuaaaugggugucuguuaag

SEQ ID NO: 25547 - RNA, 21 nt, Artificial Sequence
  Marburg virus siRNA sense strand
cuaaaugggugucuguuaagu

SEQ ID NO: 25548 - RNA, 21 nt, Artificial Sequence
  Marburg virus siRNA sense strand
uaaaugggugucuguuaaguu

SEQ ID NO: 25549 - RNA, 21 nt, Artificial Sequence
  Marburg virus siRNA sense strand
aaaugggugucuguuaaguuc

SEQ ID NO: 25550 - RNA, 21 nt, Artificial Sequence
  Marburg virus siRNA sense strand
aaugggugucuguuaaguucu

SEQ ID NO: 25551 - RNA, 21 nt, Artificial Sequence
  Marburg virus siRNA sense strand
augggugucuguuaaguucuc

SEQ ID NO: 25552 - RNA, 21 nt, Artificial Sequence
  Marburg virus siRNA sense strand
ugggugucuguuaaguucuca

SEQ ID NO: 25553 - RNA, 21 nt, Artificial Sequence
  Marburg virus siRNA sense strand
gggugucuguuaaguucucac

SEQ ID NO: 25554 - RNA, 21 nt, Artificial Sequence
  Marburg virus siRNA sense strand
ggugucuguuaaguucucaca

SEQ ID NO: 25555 - RNA, 21 nt, Artificial Sequence
  Marburg virus siRNA sense strand
gugucuguuaaguucucacaa

SEQ ID NO: 25556 - RNA, 21 nt, Artificial Sequence
  Marburg virus siRNA sense strand
ugucuguuaaguucucacaag

SEQ ID NO: 25557 - RNA, 21 nt, Artificial Sequence
  Marburg virus siRNA sense strand
gucuguuaaguucucacaaga

SEQ ID NO: 25558 - RNA, 21 nt, Artificial Sequence
  Marburg virus siRNA sense strand
ucuguuaaguucucacaagau

SEQ ID NO: 25559 - RNA, 21 nt, Artificial Sequence
  Marburg virus siRNA sense strand
cuguuaaguucucacaagauu

SEQ ID NO: 25560 - RNA, 21 nt, Artificial Sequence
  Marburg virus siRNA sense strand
uguuaaguucucacaagauua

SEQ ID NO: 25561 - RNA, 21 nt, Artificial Sequence
  Marburg virus siRNA sense strand
guuaaguucucacaagauuag

SEQ ID NO: 25562 - RNA, 21 nt, Artificial Sequence
  Marburg virus siRNA sense strand
uuaaguucucacaagauuagu

SEQ ID NO: 25563 - RNA, 21 nt, Artificial Sequence
  Marburg virus siRNA sense strand
uaaguucucacaagauuaguu

SEQ ID NO: 25564 - RNA, 21 nt, Artificial Sequence
  Marburg virus siRNA sense strand
aaguucucacaagauuaguuu

SEQ ID NO: 25565 - RNA, 21 nt, Artificial Sequence
  Marburg virus siRNA sense strand
aguucucacaagauuaguuug

SEQ ID NO: 25566 - RNA, 21 nt, Artificial Sequence
  Marburg virus siRNA sense strand
guucucacaagauuaguuugu

SEQ ID NO: 25567 - RNA, 21 nt, Artificial Sequence
  Marburg virus siRNA sense strand
uucucacaagauuaguuugua

SEQ ID NO: 25568 - RNA, 21 nt, Artificial Sequence
  Marburg virus siRNA sense strand
ucucacaagauuaguuuguau

SEQ ID NO: 25569 - RNA, 21 nt, Artificial Sequence
  Marburg virus siRNA sense strand
cucacaagauuaguuuguauu

SEQ ID NO: 25570 - RNA, 21 nt, Artificial Sequence
  Marburg virus siRNA sense strand
ucacaagauuaguuuguauug

SEQ ID NO: 25571 - RNA, 21 nt, Artificial Sequence
  Marburg virus siRNA sense strand
cacaagauuaguuuguauuga

SEQ ID NO: 25572 - RNA, 21 nt, Artificial Sequence
  Marburg virus siRNA sense strand
acaagauuaguuuguauugau

SEQ ID NO: 25573 - RNA, 21 nt, Artificial Sequence
  Marburg virus siRNA sense strand
caagauuaguuuguauugauu

SEQ ID NO: 25574 - RNA, 21 nt, Artificial Sequence
  Marburg virus siRNA sense strand
aagauuaguuuguauugauuu

SEQ ID NO: 25575 - RNA, 21 nt, Artificial Sequence
  Marburg virus siRNA sense strand
agauuaguuuguauugauuuc

SEQ ID NO: 25576 - RNA, 21 nt, Artificial Sequence
  Marburg virus siRNA sense strand
gauuaguuuguauugauuuca

SEQ ID NO: 25577 - RNA, 21 nt, Artificial Sequence
  Marburg virus siRNA sense strand
auuaguuuguauugauuucaa

SEQ ID NO: 25578 - RNA, 21 nt, Artificial Sequence
  Marburg virus siRNA sense strand
uuaguuuguauugauuucaau

SEQ ID NO: 25579 - RNA, 21 nt, Artificial Sequence
  Marburg virus siRNA sense strand
uaguuuguauugauuucaaua

SEQ ID NO: 25580 - RNA, 21 nt, Artificial Sequence
  Marburg virus siRNA sense strand
aguuuguauugauuucaauaa

SEQ ID NO: 25581 - RNA, 21 nt, Artificial Sequence
  Marburg virus siRNA sense strand
guuuguauugauuucaauaau

SEQ ID NO: 25582 - RNA, 21 nt, Artificial Sequence
  Marburg virus siRNA sense strand
uuuguauugauuucaauaaug

SEQ ID NO: 25583 - RNA, 21 nt, Artificial Sequence
  Marburg virus siRNA sense strand
uuguauugauuucaauaaugc

SEQ ID NO: 25584 - RNA, 21 nt, Artificial Sequence
  Marburg virus siRNA sense strand
uguauugauuucaauaaugcu

SEQ ID NO: 25585 - RNA, 21 nt, Artificial Sequence
  Marburg virus siRNA sense strand
guauugauuucaauaaugcuu

SEQ ID NO: 25586 - RNA, 21 nt, Artificial Sequence
  Marburg virus siRNA sense strand
uauugauuucaauaaugcuuu

SEQ ID NO: 25587 - RNA, 21 nt, Artificial Sequence
  Marburg virus siRNA sense strand
auugauuucaauaaugcuuua

SEQ ID NO: 25588 - RNA, 21 nt, Artificial Sequence
  Marburg virus siRNA sense strand
uugauuucaauaaugcuuuaa

SEQ ID NO: 25589 - RNA, 21 nt, Artificial Sequence
  Marburg virus siRNA sense strand
ugauuucaauaaugcuuuaac

SEQ ID NO: 25590 - RNA, 21 nt, Artificial Sequence
  Marburg virus siRNA sense strand
gauuucaauaaugcuuuaacc

SEQ ID NO: 25591 - RNA, 21 nt, Artificial Sequence
  Marburg virus siRNA sense strand
auuucaauaaugcuuuaaccu

SEQ ID NO: 25592 - RNA, 21 nt, Artificial Sequence
  Marburg virus siRNA sense strand
uuucaauaaugcuuuaaccuu

SEQ ID NO: 25593 - RNA, 21 nt, Artificial Sequence
  Marburg virus siRNA sense strand
uucaauaaugcuuuaaccuua

SEQ ID NO: 25594 - RNA, 21 nt, Artificial Sequence
  Marburg virus siRNA sense strand
ucaauaaugcuuuaaccuuac

SEQ ID NO: 25595 - RNA, 21 nt, Artificial Sequence
  Marburg virus siRNA sense strand
caauaaugcuuuaaccuuaca

SEQ ID NO: 25596 - RNA, 21 nt, Artificial Sequence
  Marburg virus siRNA sense strand
aauaaugcuuuaaccuuacau

SEQ ID NO: 25597 - RNA, 21 nt, Artificial Sequence
  Marburg virus siRNA sense strand
auaaugcuuuaaccuuacauu

SEQ ID NO: 25598 - RNA, 21 nt, Artificial Sequence
  Marburg virus siRNA sense strand
uaaugcuuuaaccuuacauug

SEQ ID NO: 25599 - RNA, 21 nt, Artificial Sequence
  Marburg virus siRNA sense strand
aaugcuuuaaccuuacauugc

SEQ ID NO: 25600 - RNA, 21 nt, Artificial Sequence
  Marburg virus siRNA sense strand
augcuuuaaccuuacauugcu

SEQ ID NO: 25601 - RNA, 21 nt, Artificial Sequence
  Marburg virus siRNA sense strand
ugcuuuaaccuuacauugcug

SEQ ID NO: 25602 - RNA, 21 nt, Artificial Sequence
  Marburg virus siRNA sense strand
gcuuuaaccuuacauugcugc

SEQ ID NO: 25603 - RNA, 21 nt, Artificial Sequence
  Marburg virus siRNA sense strand
cuuuaaccuuacauugcugcu

SEQ ID NO: 25604 - RNA, 21 nt, Artificial Sequence
  Marburg virus siRNA sense strand
uuuaaccuuacauugcugcuu

SEQ ID NO: 25605 - RNA, 21 nt, Artificial Sequence
  Marburg virus siRNA sense strand
uuaaccuuacauugcugcuuu

SEQ ID NO: 25606 - RNA, 21 nt, Artificial Sequence
  Marburg virus siRNA sense strand
uaaccuuacauugcugcuuua

SEQ ID NO: 25607 - RNA, 21 nt, Artificial Sequence
  Marburg virus siRNA sense strand
aaccuuacauugcugcuuuaa

SEQ ID NO: 25608 - RNA, 21 nt, Artificial Sequence
  Marburg virus siRNA sense strand
accuuacauugcugcuuuaaa

SEQ ID NO: 25609 - RNA, 21 nt, Artificial Sequence
  Marburg virus siRNA sense strand
ccuuacauugcugcuuuaaau

SEQ ID NO: 25610 - RNA, 21 nt, Artificial Sequence
  Marburg virus siRNA sense strand
cuuacauugcugcuuuaaaug

SEQ ID NO: 25611 - RNA, 21 nt, Artificial Sequence
  Marburg virus siRNA sense strand
uuacauugcugcuuuaaaugg

SEQ ID NO: 25612 - RNA, 21 nt, Artificial Sequence
  Marburg virus siRNA sense strand
uacauugcugcuuuaaauggu

SEQ ID NO: 25613 - RNA, 21 nt, Artificial Sequence
  Marburg virus siRNA sense strand
acauugcugcuuuaaaugguu

SEQ ID NO: 25614 - RNA, 21 nt, Artificial Sequence
  Marburg virus siRNA sense strand
cauugcugcuuuaaaugguua

SEQ ID NO: 25615 - RNA, 21 nt, Artificial Sequence
  Marburg virus siRNA sense strand
auugcugcuuuaaaugguuaa

SEQ ID NO: 25616 - RNA, 21 nt, Artificial Sequence
  Marburg virus siRNA sense strand
uugcugcuuuaaaugguuaau

SEQ ID NO: 25617 - RNA, 21 nt, Artificial Sequence
  Marburg virus siRNA sense strand
ugcugcuuuaaaugguuaauu

SEQ ID NO: 25618 - RNA, 21 nt, Artificial Sequence
  Marburg virus siRNA sense strand
gcugcuuuaaaugguuaauua

SEQ ID NO: 25619 - RNA, 21 nt, Artificial Sequence
  Marburg virus siRNA sense strand
cugcuuuaaaugguuaauuaa

SEQ ID NO: 25620 - RNA, 21 nt, Artificial Sequence
  Marburg virus siRNA sense strand
ugcuuuaaaugguuaauuaag

SEQ ID NO: 25621 - RNA, 21 nt, Artificial Sequence
  Marburg virus siRNA sense strand
gcuuuaaaugguuaauuaagc

SEQ ID NO: 25622 - RNA, 21 nt, Artificial Sequence
  Marburg virus siRNA sense strand
cuuuaaaugguuaauuaagcu

SEQ ID NO: 25623 - RNA, 21 nt, Artificial Sequence
  Marburg virus siRNA sense strand
uuuaaaugguuaauuaagcug

SEQ ID NO: 25624 - RNA, 21 nt, Artificial Sequence
  Marburg virus siRNA sense strand
uuaaaugguuaauuaagcuga

SEQ ID NO: 25625 - RNA, 21 nt, Artificial Sequence
  Marburg virus siRNA sense strand
uaaaugguuaauuaagcugau

SEQ ID NO: 25626 - RNA, 21 nt, Artificial Sequence
  Marburg virus siRNA sense strand
aaaugguuaauuaagcugauc

SEQ ID NO: 25627 - RNA, 21 nt, Artificial Sequence
  Marburg virus siRNA sense strand
aaugguuaauuaagcugauca

SEQ ID NO: 25628 - RNA, 21 nt, Artificial Sequence
  Marburg virus siRNA sense strand
augguuaauuaagcugaucag

SEQ ID NO: 25629 - RNA, 21 nt, Artificial Sequence
  Marburg virus siRNA sense strand
ugguuaauuaagcugaucagc

SEQ ID NO: 25630 - RNA, 21 nt, Artificial Sequence
  Marburg virus siRNA sense strand
gguuaauuaagcugaucagcu

SEQ ID NO: 25631 - RNA, 21 nt, Artificial Sequence
  Marburg virus siRNA sense strand
guuaauuaagcugaucagcuu

SEQ ID NO: 25632 - RNA, 21 nt, Artificial Sequence
  Marburg virus siRNA sense strand
uuaauuaagcugaucagcuug

SEQ ID NO: 25633 - RNA, 21 nt, Artificial Sequence
  Marburg virus siRNA sense strand
uaauuaagcugaucagcuugc

SEQ ID NO: 25634 - RNA, 21 nt, Artificial Sequence
  Marburg virus siRNA sense strand
aauuaagcugaucagcuugca

SEQ ID NO: 25635 - RNA, 21 nt, Artificial Sequence
  Marburg virus siRNA sense strand
auuaagcugaucagcuugcaa

SEQ ID NO: 25636 - RNA, 21 nt, Artificial Sequence
  Marburg virus siRNA sense strand
uuaagcugaucagcuugcaag

SEQ ID NO: 25637 - RNA, 21 nt, Artificial Sequence
  Marburg virus siRNA sense strand
uaagcugaucagcuugcaaga

SEQ ID NO: 25638 - RNA, 21 nt, Artificial Sequence
  Marburg virus siRNA sense strand
aagcugaucagcuugcaagau

SEQ ID NO: 25639 - RNA, 21 nt, Artificial Sequence
  Marburg virus siRNA sense strand
agcugaucagcuugcaagaug

SEQ ID NO: 25640 - RNA, 21 nt, Artificial Sequence
  Marburg virus siRNA sense strand
gcugaucagcuugcaagaugu

SEQ ID NO: 25641 - RNA, 21 nt, Artificial Sequence
  Marburg virus siRNA sense strand
cugaucagcuugcaagaugua

SEQ ID NO: 25642 - RNA, 21 nt, Artificial Sequence
  Marburg virus siRNA sense strand
ugaucagcuugcaagauguaa

SEQ ID NO: 25643 - RNA, 21 nt, Artificial Sequence
  Marburg virus siRNA sense strand
gaucagcuugcaagauguaau

SEQ ID NO: 25644 - RNA, 21 nt, Artificial Sequence
  Marburg virus siRNA sense strand
aucagcuugcaagauguaauc

SEQ ID NO: 25645 - RNA, 21 nt, Artificial Sequence
  Marburg virus siRNA sense strand
ucagcuugcaagauguaaucu

SEQ ID NO: 25646 - RNA, 21 nt, Artificial Sequence
  Marburg virus siRNA sense strand
cagcuugcaagauguaaucuc

SEQ ID NO: 25647 - RNA, 21 nt, Artificial Sequence
  Marburg virus siRNA sense strand
agcuugcaagauguaaucucu

SEQ ID NO: 25648 - RNA, 21 nt, Artificial Sequence
  Marburg virus siRNA sense strand
gcuugcaagauguaaucucuu

SEQ ID NO: 25649 - RNA, 21 nt, Artificial Sequence
  Marburg virus siRNA sense strand
cuugcaagauguaaucucuuu

SEQ ID NO: 25650 - RNA, 21 nt, Artificial Sequence
  Marburg virus siRNA sense strand
uugcaagauguaaucucuuuu

SEQ ID NO: 25651 - RNA, 21 nt, Artificial Sequence
  Marburg virus siRNA sense strand
ugcaagauguaaucucuuuug

SEQ ID NO: 25652 - RNA, 21 nt, Artificial Sequence
  Marburg virus siRNA sense strand
gcaagauguaaucucuuuugg

SEQ ID NO: 25653 - RNA, 21 nt, Artificial Sequence
  Marburg virus siRNA sense strand
caagauguaaucucuuuuggg

SEQ ID NO: 25654 - RNA, 21 nt, Artificial Sequence
  Marburg virus siRNA sense strand
aagauguaaucucuuuugggu

SEQ ID NO: 25655 - RNA, 21 nt, Artificial Sequence
  Marburg virus siRNA sense strand
agauguaaucucuuuuggguc

SEQ ID NO: 25656 - RNA, 21 nt, Artificial Sequence
  Marburg virus siRNA sense strand
gauguaaucucuuuuggguca

SEQ ID NO: 25657 - RNA, 21 nt, Artificial Sequence
  Marburg virus siRNA sense strand
auguaaucucuuuugggucau

SEQ ID NO: 25658 - RNA, 21 nt, Artificial Sequence
  Marburg virus siRNA sense strand
uguaaucucuuuugggucauc

SEQ ID NO: 25659 - RNA, 21 nt, Artificial Sequence
  Marburg virus siRNA sense strand
guaaucucuuuugggucauca

SEQ ID NO: 25660 - RNA, 21 nt, Artificial Sequence
  Marburg virus siRNA sense strand
uaaucucuuuugggucaucag

SEQ ID NO: 25661 - RNA, 21 nt, Artificial Sequence
  Marburg virus siRNA sense strand
aaucucuuuugggucaucaga

SEQ ID NO: 25662 - RNA, 21 nt, Artificial Sequence
  Marburg virus siRNA sense strand
aucucuuuugggucaucagau

SEQ ID NO: 25663 - RNA, 21 nt, Artificial Sequence
  Marburg virus siRNA sense strand
ucucuuuugggucaucagauc

SEQ ID NO: 25664 - RNA, 21 nt, Artificial Sequence
  Marburg virus siRNA sense strand
cucuuuugggucaucagaucu

SEQ ID NO: 25665 - RNA, 21 nt, Artificial Sequence
  Marburg virus siRNA sense strand
ucuuuugggucaucagaucua

SEQ ID NO: 25666 - RNA, 21 nt, Artificial Sequence
  Marburg virus siRNA sense strand
cuuuugggucaucagaucuau

SEQ ID NO: 25667 - RNA, 21 nt, Artificial Sequence
  Marburg virus siRNA sense strand
uuuugggucaucagaucuaua

SEQ ID NO: 25668 - RNA, 21 nt, Artificial Sequence
  Marburg virus siRNA sense strand
uuugggucaucagaucuauaa

SEQ ID NO: 25669 - RNA, 21 nt, Artificial Sequence
  Marburg virus siRNA sense strand
uugggucaucagaucuauaau

SEQ ID NO: 25670 - RNA, 21 nt, Artificial Sequence
  Marburg virus siRNA sense strand
ugggucaucagaucuauaaug

SEQ ID NO: 25671 - RNA, 21 nt, Artificial Sequence
  Marburg virus siRNA sense strand
gggucaucagaucuauaaugg

SEQ ID NO: 25672 - RNA, 21 nt, Artificial Sequence
  Marburg virus siRNA sense strand
ggucaucagaucuauaauggg

SEQ ID NO: 25673 - RNA, 21 nt, Artificial Sequence
  Marburg virus siRNA sense strand
gucaucagaucuauaaugggu

SEQ ID NO: 25674 - RNA, 21 nt, Artificial Sequence
  Marburg virus siRNA sense strand
ucaucagaucuauaauggguu

SEQ ID NO: 25675 - RNA, 21 nt, Artificial Sequence
  Marburg virus siRNA sense strand
caucagaucuauaauggguuu

SEQ ID NO: 25676 - RNA, 21 nt, Artificial Sequence
  Marburg virus siRNA sense strand
aucagaucuauaauggguuua

SEQ ID NO: 25677 - RNA, 21 nt, Artificial Sequence
  Marburg virus siRNA sense strand
ucagaucuauaauggguuuac

SEQ ID NO: 25678 - RNA, 21 nt, Artificial Sequence
  Marburg virus siRNA sense strand
cagaucuauaauggguuuacu

SEQ ID NO: 25679 - RNA, 21 nt, Artificial Sequence
  Marburg virus siRNA sense strand
agaucuauaauggguuuacua

SEQ ID NO: 25680 - RNA, 21 nt, Artificial Sequence
  Marburg virus siRNA sense strand
gaucuauaauggguuuacuag

SEQ ID NO: 25681 - RNA, 21 nt, Artificial Sequence
  Marburg virus siRNA sense strand
aucuauaauggguuuacuaga

SEQ ID NO: 25682 - RNA, 21 nt, Artificial Sequence
  Marburg virus siRNA sense strand
ucuauaauggguuuacuagau

SEQ ID NO: 25683 - RNA, 21 nt, Artificial Sequence
  Marburg virus siRNA sense strand
cuauaauggguuuacuagauu

SEQ ID NO: 25684 - RNA, 21 nt, Artificial Sequence
  Marburg virus siRNA sense strand
uauaauggguuuacuagauua

SEQ ID NO: 25685 - RNA, 21 nt, Artificial Sequence
  Marburg virus siRNA sense strand
auaauggguuuacuagauuau

SEQ ID NO: 25686 - RNA, 21 nt, Artificial Sequence
  Marburg virus siRNA sense strand
uaauggguuuacuagauuaua

SEQ ID NO: 25687 - RNA, 21 nt, Artificial Sequence
  Marburg virus siRNA sense strand
aauggguuuacuagauuauau

SEQ ID NO: 25688 - RNA, 21 nt, Artificial Sequence
  Marburg virus siRNA sense strand
auggguuuacuagauuauaua

SEQ ID NO: 25689 - RNA, 21 nt, Artificial Sequence
  Marburg virus siRNA sense strand
uggguuuacuagauuauauaa

SEQ ID NO: 25690 - RNA, 21 nt, Artificial Sequence
  Marburg virus siRNA sense strand
ggguuuacuagauuauauaaa

SEQ ID NO: 25691 - RNA, 21 nt, Artificial Sequence
  Marburg virus siRNA sense strand
gguuuacuagauuauauaaaa

SEQ ID NO: 25692 - RNA, 21 nt, Artificial Sequence
  Marburg virus siRNA sense strand
guuuacuagauuauauaaaag

SEQ ID NO: 25693 - RNA, 21 nt, Artificial Sequence
  Marburg virus siRNA sense strand
uuuacuagauuauauaaaaga

SEQ ID NO: 25694 - RNA, 21 nt, Artificial Sequence
  Marburg virus siRNA sense strand
uuacuagauuauauaaaagaa

SEQ ID NO: 25695 - RNA, 21 nt, Artificial Sequence
  Marburg virus siRNA sense strand
uacuagauuauauaaaagaaa

SEQ ID NO: 25696 - RNA, 21 nt, Artificial Sequence
  Marburg virus siRNA sense strand
acuagauuauauaaaagaaau

SEQ ID NO: 25697 - RNA, 21 nt, Artificial Sequence
  Marburg virus siRNA sense strand
cuagauuauauaaaagaaaua

SEQ ID NO: 25698 - RNA, 21 nt, Artificial Sequence
  Marburg virus siRNA sense strand
uagauuauauaaaagaaauag

SEQ ID NO: 25699 - RNA, 21 nt, Artificial Sequence
  Marburg virus siRNA sense strand
agauuauauaaaagaaauagu

SEQ ID NO: 25700 - RNA, 21 nt, Artificial Sequence
  Marburg virus siRNA sense strand
gauuauauaaaagaaauagua

SEQ ID NO: 25701 - RNA, 21 nt, Artificial Sequence
  Marburg virus siRNA sense strand
auuauauaaaagaaauaguaa

SEQ ID NO: 25702 - RNA, 21 nt, Artificial Sequence
  Marburg virus siRNA sense strand
uuauauaaaagaaauaguaau

SEQ ID NO: 25703 - RNA, 21 nt, Artificial Sequence
  Marburg virus siRNA sense strand
uauauaaaagaaauaguaaug

SEQ ID NO: 25704 - RNA, 21 nt, Artificial Sequence
  Marburg virus siRNA sense strand
auauaaaagaaauaguaaugu

SEQ ID NO: 25705 - RNA, 21 nt, Artificial Sequence
  Marburg virus siRNA sense strand
uauaaaagaaauaguaauguu

SEQ ID NO: 25706 - RNA, 21 nt, Artificial Sequence
  Marburg virus siRNA sense strand
auaaaagaaauaguaauguuu

SEQ ID NO: 25707 - RNA, 21 nt, Artificial Sequence
  Marburg virus siRNA sense strand
uaaaagaaauaguaauguuuu

SEQ ID NO: 25708 - RNA, 21 nt, Artificial Sequence
  Marburg virus siRNA sense strand
aaaagaaauaguaauguuuua

SEQ ID NO: 25709 - RNA, 21 nt, Artificial Sequence
  Marburg virus siRNA sense strand
aaagaaauaguaauguuuuau

SEQ ID NO: 25710 - RNA, 21 nt, Artificial Sequence
  Marburg virus siRNA sense strand
aagaaauaguaauguuuuaua

SEQ ID NO: 25711 - RNA, 21 nt, Artificial Sequence
  Marburg virus siRNA sense strand
agaaauaguaauguuuuauaa

SEQ ID NO: 25712 - RNA, 21 nt, Artificial Sequence
  Marburg virus siRNA sense strand
gaaauaguaauguuuuauaaa

SEQ ID NO: 25713 - RNA, 21 nt, Artificial Sequence
  Marburg virus siRNA sense strand
aaauaguaauguuuuauaaac

SEQ ID NO: 25714 - RNA, 21 nt, Artificial Sequence
  Marburg virus siRNA sense strand
aauaguaauguuuuauaaaca

SEQ ID NO: 25715 - RNA, 21 nt, Artificial Sequence
  Marburg virus siRNA sense strand
auaguaauguuuuauaaacaa

SEQ ID NO: 25716 - RNA, 21 nt, Artificial Sequence
  Marburg virus siRNA sense strand
uaguaauguuuuauaaacaau

SEQ ID NO: 25717 - RNA, 21 nt, Artificial Sequence
  Marburg virus siRNA sense strand
aguaauguuuuauaaacaauu

SEQ ID NO: 25718 - RNA, 21 nt, Artificial Sequence
  Marburg virus siRNA sense strand
guaauguuuuauaaacaauuc

SEQ ID NO: 25719 - RNA, 21 nt, Artificial Sequence
  Marburg virus siRNA sense strand
uaauguuuuauaaacaauucu

SEQ ID NO: 25720 - RNA, 21 nt, Artificial Sequence
  Marburg virus siRNA sense strand
aauguuuuauaaacaauucuu

SEQ ID NO: 25721 - RNA, 21 nt, Artificial Sequence
  Marburg virus siRNA sense strand
auguuuuauaaacaauucuug

SEQ ID NO: 25722 - RNA, 21 nt, Artificial Sequence
  Marburg virus siRNA sense strand
uguuuuauaaacaauucuugc

SEQ ID NO: 25723 - RNA, 21 nt, Artificial Sequence
  Marburg virus siRNA sense strand
guuuuauaaacaauucuugcu

SEQ ID NO: 25724 - RNA, 21 nt, Artificial Sequence
  Marburg virus siRNA sense strand
uuuuauaaacaauucuugcuu

SEQ ID NO: 25725 - RNA, 21 nt, Artificial Sequence
  Marburg virus siRNA sense strand
uuuauaaacaauucuugcuua

SEQ ID NO: 25726 - RNA, 21 nt, Artificial Sequence
  Marburg virus siRNA sense strand
uuauaaacaauucuugcuuag

SEQ ID NO: 25727 - RNA, 21 nt, Artificial Sequence
  Marburg virus siRNA sense strand
uauaaacaauucuugcuuagu

SEQ ID NO: 25728 - RNA, 21 nt, Artificial Sequence
  Marburg virus siRNA sense strand
auaaacaauucuugcuuaguu

SEQ ID NO: 25729 - RNA, 21 nt, Artificial Sequence
  Marburg virus siRNA sense strand
uaaacaauucuugcuuaguuu

SEQ ID NO: 25730 - RNA, 21 nt, Artificial Sequence
  Marburg virus siRNA sense strand
aaacaauucuugcuuaguuuu

SEQ ID NO: 25731 - RNA, 21 nt, Artificial Sequence
  Marburg virus siRNA sense strand
aacaauucuugcuuaguuuua

SEQ ID NO: 25732 - RNA, 21 nt, Artificial Sequence
  Marburg virus siRNA sense strand
acaauucuugcuuaguuuuac

SEQ ID NO: 25733 - RNA, 21 nt, Artificial Sequence
  Marburg virus siRNA sense strand
caauucuugcuuaguuuuacu

SEQ ID NO: 25734 - RNA, 21 nt, Artificial Sequence
  Marburg virus siRNA sense strand
aauucuugcuuaguuuuacuu

SEQ ID NO: 25735 - RNA, 21 nt, Artificial Sequence
  Marburg virus siRNA sense strand
auucuugcuuaguuuuacuuu

SEQ ID NO: 25736 - RNA, 21 nt, Artificial Sequence
  Marburg virus siRNA sense strand
uucuugcuuaguuuuacuuug

SEQ ID NO: 25737 - RNA, 21 nt, Artificial Sequence
  Marburg virus siRNA sense strand
ucuugcuuaguuuuacuuuga

SEQ ID NO: 25738 - RNA, 21 nt, Artificial Sequence
  Marburg virus siRNA sense strand
cuugcuuaguuuuacuuugau

SEQ ID NO: 25739 - RNA, 21 nt, Artificial Sequence
  Marburg virus siRNA sense strand
uugcuuaguuuuacuuugauu

SEQ ID NO: 25740 - RNA, 21 nt, Artificial Sequence
  Marburg virus siRNA sense strand
ugcuuaguuuuacuuugauuu

SEQ ID NO: 25741 - RNA, 21 nt, Artificial Sequence
  Marburg virus siRNA sense strand
gcuuaguuuuacuuugauuua

SEQ ID NO: 25742 - RNA, 21 nt, Artificial Sequence
  Marburg virus siRNA sense strand
cuuaguuuuacuuugauuuac

SEQ ID NO: 25743 - RNA, 21 nt, Artificial Sequence
  Marburg virus siRNA sense strand
uuaguuuuacuuugauuuacu

SEQ ID NO: 25744 - RNA, 21 nt, Artificial Sequence
  Marburg virus siRNA sense strand
uaguuuuacuuugauuuacua

SEQ ID NO: 25745 - RNA, 21 nt, Artificial Sequence
  Marburg virus siRNA sense strand
aguuuuacuuugauuuacuaa

SEQ ID NO: 25746 - RNA, 21 nt, Artificial Sequence
  Marburg virus siRNA sense strand
guuuuacuuugauuuacuaac

SEQ ID NO: 25747 - RNA, 21 nt, Artificial Sequence
  Marburg virus siRNA sense strand
uuuuacuuugauuuacuaaca

SEQ ID NO: 25748 - RNA, 21 nt, Artificial Sequence
  Marburg virus siRNA sense strand
uuuacuuugauuuacuaacau

SEQ ID NO: 25749 - RNA, 21 nt, Artificial Sequence
  Marburg virus siRNA sense strand
uuacuuugauuuacuaacaua

SEQ ID NO: 25750 - RNA, 21 nt, Artificial Sequence
  Marburg virus siRNA sense strand
uacuuugauuuacuaacauau

SEQ ID NO: 25751 - RNA, 21 nt, Artificial Sequence
  Marburg virus siRNA sense strand
acuuugauuuacuaacauaua

SEQ ID NO: 25752 - RNA, 21 nt, Artificial Sequence
  Marburg virus siRNA sense strand
cuuugauuuacuaacauauau

SEQ ID NO: 25753 - RNA, 21 nt, Artificial Sequence
  Marburg virus siRNA sense strand
uuugauuuacuaacauauauc

SEQ ID NO: 25754 - RNA, 21 nt, Artificial Sequence
  Marburg virus siRNA sense strand
uugauuuacuaacauauauca

SEQ ID NO: 25755 - RNA, 21 nt, Artificial Sequence
  Marburg virus siRNA sense strand
ugauuuacuaacauauaucau

SEQ ID NO: 25756 - RNA, 21 nt, Artificial Sequence
  Marburg virus siRNA sense strand
gauuuacuaacauauaucauu

SEQ ID NO: 25757 - RNA, 21 nt, Artificial Sequence
  Marburg virus siRNA sense strand
auuuacuaacauauaucauug

SEQ ID NO: 25758 - RNA, 21 nt, Artificial Sequence
  Marburg virus siRNA sense strand
uuuacuaacauauaucauugu

SEQ ID NO: 25759 - RNA, 21 nt, Artificial Sequence
  Marburg virus siRNA sense strand
uuacuaacauauaucauugug

SEQ ID NO: 25760 - RNA, 21 nt, Artificial Sequence
  Marburg virus siRNA sense strand
uacuaacauauaucauugugc

SEQ ID NO: 25761 - RNA, 21 nt, Artificial Sequence
  Marburg virus siRNA sense strand
acuaacauauaucauugugcc

SEQ ID NO: 25762 - RNA, 21 nt, Artificial Sequence
  Marburg virus siRNA sense strand
cuaacauauaucauugugccc

SEQ ID NO: 25763 - RNA, 21 nt, Artificial Sequence
  Marburg virus siRNA sense strand
uaacauauaucauugugcccu

SEQ ID NO: 25764 - RNA, 21 nt, Artificial Sequence
  Marburg virus siRNA sense strand
aacauauaucauugugcccuu

SEQ ID NO: 25765 - RNA, 21 nt, Artificial Sequence
  Marburg virus siRNA sense strand
acauauaucauugugcccuuc

SEQ ID NO: 25766 - RNA, 21 nt, Artificial Sequence
  Marburg virus siRNA sense strand
cauauaucauugugcccuuca

SEQ ID NO: 25767 - RNA, 21 nt, Artificial Sequence
  Marburg virus siRNA sense strand
auauaucauugugcccuucau

SEQ ID NO: 25768 - RNA, 21 nt, Artificial Sequence
  Marburg virus siRNA sense strand
uauaucauugugcccuucauu

SEQ ID NO: 25769 - RNA, 21 nt, Artificial Sequence
  Marburg virus siRNA sense strand
auaucauugugcccuucauug

SEQ ID NO: 25770 - RNA, 21 nt, Artificial Sequence
  Marburg virus siRNA sense strand
uaucauugugcccuucauugc

SEQ ID NO: 25771 - RNA, 21 nt, Artificial Sequence
  Marburg virus siRNA sense strand
aucauugugcccuucauugcu

SEQ ID NO: 25772 - RNA, 21 nt, Artificial Sequence
  Marburg virus siRNA sense strand
ucauugugcccuucauugcua

SEQ ID NO: 25773 - RNA, 21 nt, Artificial Sequence
  Marburg virus siRNA sense strand
cauugugcccuucauugcuaa

SEQ ID NO: 25774 - RNA, 21 nt, Artificial Sequence
  Marburg virus siRNA sense strand
auugugcccuucauugcuaag

SEQ ID NO: 25775 - RNA, 21 nt, Artificial Sequence
  Marburg virus siRNA sense strand
uugugcccuucauugcuaagu

SEQ ID NO: 25776 - RNA, 21 nt, Artificial Sequence
  Marburg virus siRNA sense strand
ugugcccuucauugcuaagua

SEQ ID NO: 25777 - RNA, 21 nt, Artificial Sequence
  Marburg virus siRNA sense strand
gugcccuucauugcuaaguaa

SEQ ID NO: 25778 - RNA, 21 nt, Artificial Sequence
  Marburg virus siRNA sense strand
ugcccuucauugcuaaguaaa

SEQ ID NO: 25779 - RNA, 21 nt, Artificial Sequence
  Marburg virus siRNA sense strand
gcccuucauugcuaaguaaac

SEQ ID NO: 25780 - RNA, 21 nt, Artificial Sequence
  Marburg virus siRNA sense strand
cccuucauugcuaaguaaacu

SEQ ID NO: 25781 - RNA, 21 nt, Artificial Sequence
  Marburg virus siRNA sense strand
ccuucauugcuaaguaaacuc

SEQ ID NO: 25782 - RNA, 21 nt, Artificial Sequence
  Marburg virus siRNA sense strand
cuucauugcuaaguaaacuca

SEQ ID NO: 25783 - RNA, 21 nt, Artificial Sequence
  Marburg virus siRNA sense strand
uucauugcuaaguaaacucaa

SEQ ID NO: 25784 - RNA, 21 nt, Artificial Sequence
  Marburg virus siRNA sense strand
ucauugcuaaguaaacucaac

SEQ ID NO: 25785 - RNA, 21 nt, Artificial Sequence
  Marburg virus siRNA sense strand
cauugcuaaguaaacucaacu

SEQ ID NO: 25786 - RNA, 21 nt, Artificial Sequence
  Marburg virus siRNA sense strand
auugcuaaguaaacucaacug

SEQ ID NO: 25787 - RNA, 21 nt, Artificial Sequence
  Marburg virus siRNA sense strand
uugcuaaguaaacucaacuga

SEQ ID NO: 25788 - RNA, 21 nt, Artificial Sequence
  Marburg virus siRNA sense strand
ugcuaaguaaacucaacugau

SEQ ID NO: 25789 - RNA, 21 nt, Artificial Sequence
  Marburg virus siRNA sense strand
gcuaaguaaacucaacugaug

SEQ ID NO: 25790 - RNA, 21 nt, Artificial Sequence
  Marburg virus siRNA sense strand
cuaaguaaacucaacugauga

SEQ ID NO: 25791 - RNA, 21 nt, Artificial Sequence
  Marburg virus siRNA sense strand
uaaguaaacucaacugaugau

SEQ ID NO: 25792 - RNA, 21 nt, Artificial Sequence
  Marburg virus siRNA sense strand
aaguaaacucaacugaugaug

SEQ ID NO: 25793 - RNA, 21 nt, Artificial Sequence
  Marburg virus siRNA sense strand
aguaaacucaacugaugauga

SEQ ID NO: 25794 - RNA, 21 nt, Artificial Sequence
  Marburg virus siRNA sense strand
guaaacucaacugaugaugau

SEQ ID NO: 25795 - RNA, 21 nt, Artificial Sequence
  Marburg virus siRNA sense strand
uaaacucaacugaugaugaua

SEQ ID NO: 25796 - RNA, 21 nt, Artificial Sequence
  Marburg virus siRNA sense strand
aaacucaacugaugaugauau

SEQ ID NO: 25797 - RNA, 21 nt, Artificial Sequence
  Marburg virus siRNA sense strand
aacucaacugaugaugauauu

SEQ ID NO: 25798 - RNA, 21 nt, Artificial Sequence
  Marburg virus siRNA sense strand
acucaacugaugaugauauuc

SEQ ID NO: 25799 - RNA, 21 nt, Artificial Sequence
  Marburg virus siRNA sense strand
cucaacugaugaugauauucc

SEQ ID NO: 25800 - RNA, 21 nt, Artificial Sequence
  Marburg virus siRNA sense strand
ucaacugaugaugauauuccu

SEQ ID NO: 25801 - RNA, 21 nt, Artificial Sequence
  Marburg virus siRNA sense strand
caacugaugaugauauuccuu

SEQ ID NO: 25802 - RNA, 21 nt, Artificial Sequence
  Marburg virus siRNA sense strand
aacugaugaugauauuccuuc

SEQ ID NO: 25803 - RNA, 21 nt, Artificial Sequence
  Marburg virus siRNA sense strand
acugaugaugauauuccuucu

SEQ ID NO: 25804 - RNA, 21 nt, Artificial Sequence
  Marburg virus siRNA sense strand
cugaugaugauauuccuucug

SEQ ID NO: 25805 - RNA, 21 nt, Artificial Sequence
  Marburg virus siRNA sense strand
ugaugaugauauuccuucuga

SEQ ID NO: 25806 - RNA, 21 nt, Artificial Sequence
  Marburg virus siRNA sense strand
gaugaugauauuccuucugaa

SEQ ID NO: 25807 - RNA, 21 nt, Artificial Sequence
  Marburg virus siRNA sense strand
augaugauauuccuucugaaa

SEQ ID NO: 25808 - RNA, 21 nt, Artificial Sequence
  Marburg virus siRNA sense strand
ugaugauauuccuucugaaau

SEQ ID NO: 25809 - RNA, 21 nt, Artificial Sequence
  Marburg virus siRNA sense strand
gaugauauuccuucugaaaua

SEQ ID NO: 25810 - RNA, 21 nt, Artificial Sequence
  Marburg virus siRNA sense strand
augauauuccuucugaaauag

SEQ ID NO: 25811 - RNA, 21 nt, Artificial Sequence
  Marburg virus siRNA sense strand
ugauauuccuucugaaauagu

SEQ ID NO: 25812 - RNA, 21 nt, Artificial Sequence
  Marburg virus siRNA sense strand
gauauuccuucugaaauagua

SEQ ID NO: 25813 - RNA, 21 nt, Artificial Sequence
  Marburg virus siRNA sense strand
auauuccuucugaaauaguaa

SEQ ID NO: 25814 - RNA, 21 nt, Artificial Sequence
  Marburg virus siRNA sense strand
uauuccuucugaaauaguaag

SEQ ID NO: 25815 - RNA, 21 nt, Artificial Sequence
  Marburg virus siRNA sense strand
auuccuucugaaauaguaaga

SEQ ID NO: 25816 - RNA, 21 nt, Artificial Sequence
  Marburg virus siRNA sense strand
uuccuucugaaauaguaagaa

SEQ ID NO: 25817 - RNA, 21 nt, Artificial Sequence
  Marburg virus siRNA sense strand
uccuucugaaauaguaagaaa

SEQ ID NO: 25818 - RNA, 21 nt, Artificial Sequence
  Marburg virus siRNA sense strand
ccuucugaaauaguaagaaaa

SEQ ID NO: 25819 - RNA, 21 nt, Artificial Sequence
  Marburg virus siRNA sense strand
cuucugaaauaguaagaaaaa

SEQ ID NO: 25820 - RNA, 21 nt, Artificial Sequence
  Marburg virus siRNA sense strand
uucugaaauaguaagaaaaac

SEQ ID NO: 25821 - RNA, 21 nt, Artificial Sequence
  Marburg virus siRNA sense strand
ucugaaauaguaagaaaaacu

SEQ ID NO: 25822 - RNA, 21 nt, Artificial Sequence
  Marburg virus siRNA sense strand
cugaaauaguaagaaaaacua

SEQ ID NO: 25823 - RNA, 21 nt, Artificial Sequence
  Marburg virus siRNA sense strand
ugaaauaguaagaaaaacuaa

SEQ ID NO: 25824 - RNA, 21 nt, Artificial Sequence
  Marburg virus siRNA sense strand
gaaauaguaagaaaaacuaau

SEQ ID NO: 25825 - RNA, 21 nt, Artificial Sequence
  Marburg virus siRNA sense strand
aaauaguaagaaaaacuaaug

SEQ ID NO: 25826 - RNA, 21 nt, Artificial Sequence
  Marburg virus siRNA sense strand
aauaguaagaaaaacuaauga

SEQ ID NO: 25827 - RNA, 21 nt, Artificial Sequence
  Marburg virus siRNA sense strand
auaguaagaaaaacuaaugaa

SEQ ID NO: 25828 - RNA, 21 nt, Artificial Sequence
  Marburg virus siRNA sense strand
uaguaagaaaaacuaaugaag

SEQ ID NO: 25829 - RNA, 21 nt, Artificial Sequence
  Marburg virus siRNA sense strand
aguaagaaaaacuaaugaaga

SEQ ID NO: 25830 - RNA, 21 nt, Artificial Sequence
  Marburg virus siRNA sense strand
guaagaaaaacuaaugaagaa

SEQ ID NO: 25831 - RNA, 21 nt, Artificial Sequence
  Marburg virus siRNA sense strand
uaagaaaaacuaaugaagaac

SEQ ID NO: 25832 - RNA, 21 nt, Artificial Sequence
  Marburg virus siRNA sense strand
aagaaaaacuaaugaagaaca

SEQ ID NO: 25833 - RNA, 21 nt, Artificial Sequence
  Marburg virus siRNA sense strand
agaaaaacuaaugaagaacau

SEQ ID NO: 25834 - RNA, 21 nt, Artificial Sequence
  Marburg virus siRNA sense strand
gaaaaacuaaugaagaacauu

SEQ ID NO: 25835 - RNA, 21 nt, Artificial Sequence
  Marburg virus siRNA sense strand
aaaaacuaaugaagaacauua

SEQ ID NO: 25836 - RNA, 21 nt, Artificial Sequence
  Marburg virus siRNA sense strand
aaaacuaaugaagaacauuaa

SEQ ID NO: 25837 - RNA, 21 nt, Artificial Sequence
  Marburg virus siRNA sense strand
aaacuaaugaagaacauuaau

SEQ ID NO: 25838 - RNA, 21 nt, Artificial Sequence
  Marburg virus siRNA sense strand
aacuaaugaagaacauuaauu

SEQ ID NO: 25839 - RNA, 21 nt, Artificial Sequence
  Marburg virus siRNA sense strand
acuaaugaagaacauuaauug

SEQ ID NO: 25840 - RNA, 21 nt, Artificial Sequence
  Marburg virus siRNA sense strand
cuaaugaagaacauuaauugc

SEQ ID NO: 25841 - RNA, 21 nt, Artificial Sequence
  Marburg virus siRNA sense strand
uaaugaagaacauuaauugcc

SEQ ID NO: 25842 - RNA, 21 nt, Artificial Sequence
  Marburg virus siRNA sense strand
aaugaagaacauuaauugccg

SEQ ID NO: 25843 - RNA, 21 nt, Artificial Sequence
  Marburg virus siRNA sense strand
augaagaacauuaauugccgg

SEQ ID NO: 25844 - RNA, 21 nt, Artificial Sequence
  Marburg virus siRNA sense strand
ugaagaacauuaauugccggg

SEQ ID NO: 25845 - RNA, 21 nt, Artificial Sequence
  Marburg virus siRNA sense strand
gaagaacauuaauugccgggu

SEQ ID NO: 25846 - RNA, 21 nt, Artificial Sequence
  Marburg virus siRNA sense strand
aagaacauuaauugccgggua

SEQ ID NO: 25847 - RNA, 21 nt, Artificial Sequence
  Marburg virus siRNA sense strand
agaacauuaauugccggguaa

SEQ ID NO: 25848 - RNA, 21 nt, Artificial Sequence
  Marburg virus siRNA sense strand
gaacauuaauugccggguaag

SEQ ID NO: 25849 - RNA, 21 nt, Artificial Sequence
  Marburg virus siRNA sense strand
aacauuaauugccggguaaga

SEQ ID NO: 25850 - RNA, 21 nt, Artificial Sequence
  Marburg virus siRNA sense strand
acauuaauugccggguaagag

SEQ ID NO: 25851 - RNA, 21 nt, Artificial Sequence
  Marburg virus siRNA sense strand
cauuaauugccggguaagagu

SEQ ID NO: 25852 - RNA, 21 nt, Artificial Sequence
  Marburg virus siRNA sense strand
auuaauugccggguaagagug

SEQ ID NO: 25853 - RNA, 21 nt, Artificial Sequence
  Marburg virus siRNA sense strand
uuaauugccggguaagaguga

SEQ ID NO: 25854 - RNA, 21 nt, Artificial Sequence
  Marburg virus siRNA sense strand
uaauugccggguaagagugau

SEQ ID NO: 25855 - RNA, 21 nt, Artificial Sequence
  Marburg virus siRNA sense strand
aauugccggguaagagugauu

SEQ ID NO: 25856 - RNA, 21 nt, Artificial Sequence
  Marburg virus siRNA sense strand
auugccggguaagagugauua

SEQ ID NO: 25857 - RNA, 21 nt, Artificial Sequence
  Marburg virus siRNA sense strand
uugccggguaagagugauuaa

SEQ ID NO: 25858 - RNA, 21 nt, Artificial Sequence
  Marburg virus siRNA sense strand
ugccggguaagagugauuaag

SEQ ID NO: 25859 - RNA, 21 nt, Artificial Sequence
  Marburg virus siRNA sense strand
gccggguaagagugauuaagu

SEQ ID NO: 25860 - RNA, 21 nt, Artificial Sequence
  Marburg virus siRNA sense strand
ccggguaagagugauuaaguu

SEQ ID NO: 25861 - RNA, 21 nt, Artificial Sequence
  Marburg virus siRNA sense strand
cggguaagagugauuaaguuc

SEQ ID NO: 25862 - RNA, 21 nt, Artificial Sequence
  Marburg virus siRNA sense strand
ggguaagagugauuaaguucu

SEQ ID NO: 25863 - RNA, 21 nt, Artificial Sequence
  Marburg virus siRNA sense strand
gguaagagugauuaaguucuu

SEQ ID NO: 25864 - RNA, 21 nt, Artificial Sequence
  Marburg virus siRNA sense strand
guaagagugauuaaguucuuu

SEQ ID NO: 25865 - RNA, 21 nt, Artificial Sequence
  Marburg virus siRNA sense strand
uaagagugauuaaguucuuua

SEQ ID NO: 25866 - RNA, 21 nt, Artificial Sequence
  Marburg virus siRNA sense strand
aagagugauuaaguucuuuaa

SEQ ID NO: 25867 - RNA, 21 nt, Artificial Sequence
  Marburg virus siRNA sense strand
agagugauuaaguucuuuaaa

SEQ ID NO: 25868 - RNA, 21 nt, Artificial Sequence
  Marburg virus siRNA sense strand
gagugauuaaguucuuuaaau

SEQ ID NO: 25869 - RNA, 21 nt, Artificial Sequence
  Marburg virus siRNA sense strand
agugauuaaguucuuuaaauu

SEQ ID NO: 25870 - RNA, 21 nt, Artificial Sequence
  Marburg virus siRNA sense strand
gugauuaaguucuuuaaauuu

SEQ ID NO: 25871 - RNA, 21 nt, Artificial Sequence
  Marburg virus siRNA sense strand
ugauuaaguucuuuaaauuug

SEQ ID NO: 25872 - RNA, 21 nt, Artificial Sequence
  Marburg virus siRNA sense strand
gauuaaguucuuuaaauuuga

SEQ ID NO: 25873 - RNA, 21 nt, Artificial Sequence
  Marburg virus siRNA sense strand
auuaaguucuuuaaauuugac

SEQ ID NO: 25874 - RNA, 21 nt, Artificial Sequence
  Marburg virus siRNA sense strand
uuaaguucuuuaaauuugacc

SEQ ID NO: 25875 - RNA, 21 nt, Artificial Sequence
  Marburg virus siRNA sense strand
uaaguucuuuaaauuugacca

SEQ ID NO: 25876 - RNA, 21 nt, Artificial Sequence
  Marburg virus siRNA sense strand
aaguucuuuaaauuugaccaa

SEQ ID NO: 25877 - RNA, 21 nt, Artificial Sequence
  Marburg virus siRNA sense strand
aguucuuuaaauuugaccaaa

SEQ ID NO: 25878 - RNA, 21 nt, Artificial Sequence
  Marburg virus siRNA sense strand
guucuuuaaauuugaccaaag

SEQ ID NO: 25879 - RNA, 21 nt, Artificial Sequence
  Marburg virus siRNA sense strand
uucuuuaaauuugaccaaagu

SEQ ID NO: 25880 - RNA, 21 nt, Artificial Sequence
  Marburg virus siRNA sense strand
ucuuuaaauuugaccaaagua

SEQ ID NO: 25881 - RNA, 21 nt, Artificial Sequence
  Marburg virus siRNA sense strand
cuuuaaauuugaccaaaguaa

SEQ ID NO: 25882 - RNA, 21 nt, Artificial Sequence
  Marburg virus siRNA sense strand
uuuaaauuugaccaaaguaau

SEQ ID NO: 25883 - RNA, 21 nt, Artificial Sequence
  Marburg virus siRNA sense strand
uuaaauuugaccaaaguaaug

SEQ ID NO: 25884 - RNA, 21 nt, Artificial Sequence
  Marburg virus siRNA sense strand
uaaauuugaccaaaguaaugu

SEQ ID NO: 25885 - RNA, 21 nt, Artificial Sequence
  Marburg virus siRNA sense strand
aaauuugaccaaaguaauguu

SEQ ID NO: 25886 - RNA, 21 nt, Artificial Sequence
  Marburg virus siRNA sense strand
aauuugaccaaaguaauguuu

SEQ ID NO: 25887 - RNA, 21 nt, Artificial Sequence
  Marburg virus siRNA sense strand
auuugaccaaaguaauguuuu

SEQ ID NO: 25888 - RNA, 21 nt, Artificial Sequence
  Marburg virus siRNA sense strand
uuugaccaaaguaauguuuug

SEQ ID NO: 25889 - RNA, 21 nt, Artificial Sequence
  Marburg virus siRNA sense strand
uugaccaaaguaauguuuugu

SEQ ID NO: 25890 - RNA, 21 nt, Artificial Sequence
  Marburg virus siRNA sense strand
ugaccaaaguaauguuuuguu

SEQ ID NO: 25891 - RNA, 21 nt, Artificial Sequence
  Marburg virus siRNA sense strand
gaccaaaguaauguuuuguua

SEQ ID NO: 25892 - RNA, 21 nt, Artificial Sequence
  Marburg virus siRNA sense strand
accaaaguaauguuuuguuag

SEQ ID NO: 25893 - RNA, 21 nt, Artificial Sequence
  Marburg virus siRNA sense strand
ccaaaguaauguuuuguuagu

SEQ ID NO: 25894 - RNA, 21 nt, Artificial Sequence
  Marburg virus siRNA sense strand
caaaguaauguuuuguuagug

SEQ ID NO: 25895 - RNA, 21 nt, Artificial Sequence
  Marburg virus siRNA sense strand
aaaguaauguuuuguuaguga

SEQ ID NO: 25896 - RNA, 21 nt, Artificial Sequence
  Marburg virus siRNA sense strand
aaguaauguuuuguuagugaa

SEQ ID NO: 25897 - RNA, 21 nt, Artificial Sequence
  Marburg virus siRNA sense strand
aguaauguuuuguuagugaau

SEQ ID NO: 25898 - RNA, 21 nt, Artificial Sequence
  Marburg virus siRNA sense strand
guaauguuuuguuagugaaua

SEQ ID NO: 25899 - RNA, 21 nt, Artificial Sequence
  Marburg virus siRNA sense strand
uaauguuuuguuagugaauac

SEQ ID NO: 25900 - RNA, 21 nt, Artificial Sequence
  Marburg virus siRNA sense strand
aauguuuuguuagugaauaca

SEQ ID NO: 25901 - RNA, 21 nt, Artificial Sequence
  Marburg virus siRNA sense strand
auguuuuguuagugaauacau

SEQ ID NO: 25902 - RNA, 21 nt, Artificial Sequence
  Marburg virus siRNA sense strand
uguuuuguuagugaauacauu

SEQ ID NO: 25903 - RNA, 21 nt, Artificial Sequence
  Marburg virus siRNA sense strand
guuuuguuagugaauacauuc

SEQ ID NO: 25904 - RNA, 21 nt, Artificial Sequence
  Marburg virus siRNA sense strand
uuuuguuagugaauacauucu

SEQ ID NO: 25905 - RNA, 21 nt, Artificial Sequence
  Marburg virus siRNA sense strand
uuuguuagugaauacauucuu

SEQ ID NO: 25906 - RNA, 21 nt, Artificial Sequence
  Marburg virus siRNA sense strand
uuguuagugaauacauucuua

SEQ ID NO: 25907 - RNA, 21 nt, Artificial Sequence
  Marburg virus siRNA sense strand
uguuagugaauacauucuuau

SEQ ID NO: 25908 - RNA, 21 nt, Artificial Sequence
  Marburg virus siRNA sense strand
guuagugaauacauucuuaua

SEQ ID NO: 25909 - RNA, 21 nt, Artificial Sequence
  Marburg virus siRNA sense strand
uuagugaauacauucuuauau

SEQ ID NO: 25910 - RNA, 21 nt, Artificial Sequence
  Marburg virus siRNA sense strand
uagugaauacauucuuauauu

SEQ ID NO: 25911 - RNA, 21 nt, Artificial Sequence
  Marburg virus siRNA sense strand
agugaauacauucuuauauug

SEQ ID NO: 25912 - RNA, 21 nt, Artificial Sequence
  Marburg virus siRNA sense strand
gugaauacauucuuauauugc

SEQ ID NO: 25913 - RNA, 21 nt, Artificial Sequence
  Marburg virus siRNA sense strand
ugaauacauucuuauauugcu

SEQ ID NO: 25914 - RNA, 21 nt, Artificial Sequence
  Marburg virus siRNA sense strand
gaauacauucuuauauugcuu

SEQ ID NO: 25915 - RNA, 21 nt, Artificial Sequence
  Marburg virus siRNA sense strand
aauacauucuuauauugcuug

SEQ ID NO: 25916 - RNA, 21 nt, Artificial Sequence
  Marburg virus siRNA sense strand
auacauucuuauauugcuuga

SEQ ID NO: 25917 - RNA, 21 nt, Artificial Sequence
  Marburg virus siRNA sense strand
uacauucuuauauugcuugau

SEQ ID NO: 25918 - RNA, 21 nt, Artificial Sequence
  Marburg virus siRNA sense strand
acauucuuauauugcuugauu

SEQ ID NO: 25919 - RNA, 21 nt, Artificial Sequence
  Marburg virus siRNA sense strand
cauucuuauauugcuugauua

SEQ ID NO: 25920 - RNA, 21 nt, Artificial Sequence
  Marburg virus siRNA sense strand
auucuuauauugcuugauuaa

SEQ ID NO: 25921 - RNA, 21 nt, Artificial Sequence
  Marburg virus siRNA sense strand
uucuuauauugcuugauuaaa

SEQ ID NO: 25922 - RNA, 21 nt, Artificial Sequence
  Marburg virus siRNA sense strand
ucuuauauugcuugauuaaaa

SEQ ID NO: 25923 - RNA, 21 nt, Artificial Sequence
  Marburg virus siRNA sense strand
cuuauauugcuugauuaaaaa

SEQ ID NO: 25924 - RNA, 21 nt, Artificial Sequence
  Marburg virus siRNA sense strand
uuauauugcuugauuaaaaac

SEQ ID NO: 25925 - RNA, 21 nt, Artificial Sequence
  Marburg virus siRNA sense strand
uauauugcuugauuaaaaaca

SEQ ID NO: 25926 - RNA, 21 nt, Artificial Sequence
  Marburg virus siRNA sense strand
auauugcuugauuaaaaacaa

SEQ ID NO: 25927 - RNA, 21 nt, Artificial Sequence
  Marburg virus siRNA sense strand
uauugcuugauuaaaaacaag

SEQ ID NO: 25928 - RNA, 21 nt, Artificial Sequence
  Marburg virus siRNA sense strand
auugcuugauuaaaaacaaga

SEQ ID NO: 25929 - RNA, 21 nt, Artificial Sequence
  Marburg virus siRNA sense strand
uugcuugauuaaaaacaagaa

SEQ ID NO: 25930 - RNA, 21 nt, Artificial Sequence
  Marburg virus siRNA sense strand
ugcuugauuaaaaacaagaaa

SEQ ID NO: 25931 - RNA, 21 nt, Artificial Sequence
  Marburg virus siRNA sense strand
gcuugauuaaaaacaagaaau

SEQ ID NO: 25932 - RNA, 21 nt, Artificial Sequence
  Marburg virus siRNA sense strand
cuugauuaaaaacaagaaauu

SEQ ID NO: 25933 - RNA, 21 nt, Artificial Sequence
  Marburg virus siRNA sense strand
uugauuaaaaacaagaaauua

SEQ ID NO: 25934 - RNA, 21 nt, Artificial Sequence
  Marburg virus siRNA sense strand
ugauuaaaaacaagaaauuau

SEQ ID NO: 25935 - RNA, 21 nt, Artificial Sequence
  Marburg virus siRNA sense strand
gauuaaaaacaagaaauuauc

SEQ ID NO: 25936 - RNA, 21 nt, Artificial Sequence
  Marburg virus siRNA sense strand
auuaaaaacaagaaauuaucc

SEQ ID NO: 25937 - RNA, 21 nt, Artificial Sequence
  Marburg virus siRNA sense strand
uuaaaaacaagaaauuauccu

SEQ ID NO: 25938 - RNA, 21 nt, Artificial Sequence
  Marburg virus siRNA sense strand
uaaaaacaagaaauuauccua

SEQ ID NO: 25939 - RNA, 21 nt, Artificial Sequence
  Marburg virus siRNA sense strand
aaaaacaagaaauuauccuaa

SEQ ID NO: 25940 - RNA, 21 nt, Artificial Sequence
  Marburg virus siRNA sense strand
aaaacaagaaauuauccuaac

SEQ ID NO: 25941 - RNA, 21 nt, Artificial Sequence
  Marburg virus siRNA sense strand
aaacaagaaauuauccuaaca

SEQ ID NO: 25942 - RNA, 21 nt, Artificial Sequence
  Marburg virus siRNA sense strand
aacaagaaauuauccuaacau

SEQ ID NO: 25943 - RNA, 21 nt, Artificial Sequence
  Marburg virus siRNA sense strand
acaagaaauuauccuaacaug

SEQ ID NO: 25944 - RNA, 21 nt, Artificial Sequence
  Marburg virus siRNA sense strand
caagaaauuauccuaacauga

SEQ ID NO: 25945 - RNA, 21 nt, Artificial Sequence
  Marburg virus siRNA sense strand
aagaaauuauccuaacaugaa

SEQ ID NO: 25946 - RNA, 21 nt, Artificial Sequence
  Marburg virus siRNA sense strand
agaaauuauccuaacaugaag

SEQ ID NO: 25947 - RNA, 21 nt, Artificial Sequence
  Marburg virus siRNA sense strand
gaaauuauccuaacaugaaga

SEQ ID NO: 25948 - RNA, 21 nt, Artificial Sequence
  Marburg virus siRNA sense strand
aaauuauccuaacaugaagac

SEQ ID NO: 25949 - RNA, 21 nt, Artificial Sequence
  Marburg virus siRNA sense strand
aauuauccuaacaugaagacc

SEQ ID NO: 25950 - RNA, 21 nt, Artificial Sequence
  Marburg virus siRNA sense strand
auuauccuaacaugaagacca

SEQ ID NO: 25951 - RNA, 21 nt, Artificial Sequence
  Marburg virus siRNA sense strand
uuauccuaacaugaagaccac

SEQ ID NO: 25952 - RNA, 21 nt, Artificial Sequence
  Marburg virus siRNA sense strand
uauccuaacaugaagaccaca

SEQ ID NO: 25953 - RNA, 21 nt, Artificial Sequence
  Marburg virus siRNA sense strand
auccuaacaugaagaccacau

SEQ ID NO: 25954 - RNA, 21 nt, Artificial Sequence
  Marburg virus siRNA sense strand
uccuaacaugaagaccacaug

SEQ ID NO: 25955 - RNA, 21 nt, Artificial Sequence
  Marburg virus siRNA sense strand
ccuaacaugaagaccacaugu

SEQ ID NO: 25956 - RNA, 21 nt, Artificial Sequence
  Marburg virus siRNA sense strand
cuaacaugaagaccacauguc

SEQ ID NO: 25957 - RNA, 21 nt, Artificial Sequence
  Marburg virus siRNA sense strand
uaacaugaagaccacaugucu

SEQ ID NO: 25958 - RNA, 21 nt, Artificial Sequence
  Marburg virus siRNA sense strand
aacaugaagaccacaugucuc

SEQ ID NO: 25959 - RNA, 21 nt, Artificial Sequence
  Marburg virus siRNA sense strand
acaugaagaccacaugucucu

SEQ ID NO: 25960 - RNA, 21 nt, Artificial Sequence
  Marburg virus siRNA sense strand
caugaagaccacaugucucuu

SEQ ID NO: 25961 - RNA, 21 nt, Artificial Sequence
  Marburg virus siRNA sense strand
augaagaccacaugucucuuu

SEQ ID NO: 25962 - RNA, 21 nt, Artificial Sequence
  Marburg virus siRNA sense strand
ugaagaccacaugucucuuua

SEQ ID NO: 25963 - RNA, 21 nt, Artificial Sequence
  Marburg virus siRNA sense strand
gaagaccacaugucucuuuau

SEQ ID NO: 25964 - RNA, 21 nt, Artificial Sequence
  Marburg virus siRNA sense strand
aagaccacaugucucuuuauc

SEQ ID NO: 25965 - RNA, 21 nt, Artificial Sequence
  Marburg virus siRNA sense strand
agaccacaugucucuuuauca

SEQ ID NO: 25966 - RNA, 21 nt, Artificial Sequence
  Marburg virus siRNA sense strand
gaccacaugucucuuuaucag

SEQ ID NO: 25967 - RNA, 21 nt, Artificial Sequence
  Marburg virus siRNA sense strand
accacaugucucuuuaucagu

SEQ ID NO: 25968 - RNA, 21 nt, Artificial Sequence
  Marburg virus siRNA sense strand
ccacaugucucuuuaucaguc

SEQ ID NO: 25969 - RNA, 21 nt, Artificial Sequence
  Marburg virus siRNA sense strand
cacaugucucuuuaucagucu

SEQ ID NO: 25970 - RNA, 21 nt, Artificial Sequence
  Marburg virus siRNA sense strand
acaugucucuuuaucagucuu

SEQ ID NO: 25971 - RNA, 21 nt, Artificial Sequence
  Marburg virus siRNA sense strand
caugucucuuuaucagucuua

SEQ ID NO: 25972 - RNA, 21 nt, Artificial Sequence
  Marburg virus siRNA sense strand
augucucuuuaucagucuuau

SEQ ID NO: 25973 - RNA, 21 nt, Artificial Sequence
  Marburg virus siRNA sense strand
ugucucuuuaucagucuuauc

SEQ ID NO: 25974 - RNA, 21 nt, Artificial Sequence
  Marburg virus siRNA sense strand
gucucuuuaucagucuuaucu

SEQ ID NO: 25975 - RNA, 21 nt, Artificial Sequence
  Marburg virus siRNA sense strand
ucucuuuaucagucuuaucuu

SEQ ID NO: 25976 - RNA, 21 nt, Artificial Sequence
  Marburg virus siRNA sense strand
cucuuuaucagucuuaucuua

SEQ ID NO: 25977 - RNA, 21 nt, Artificial Sequence
  Marburg virus siRNA sense strand
ucuuuaucagucuuaucuuaa

SEQ ID NO: 25978 - RNA, 21 nt, Artificial Sequence
  Marburg virus siRNA sense strand
cuuuaucagucuuaucuuaau

SEQ ID NO: 25979 - RNA, 21 nt, Artificial Sequence
  Marburg virus siRNA sense strand
uuuaucagucuuaucuuaauc

SEQ ID NO: 25980 - RNA, 21 nt, Artificial Sequence
  Marburg virus siRNA sense strand
uuaucagucuuaucuuaaucc

SEQ ID NO: 25981 - RNA, 21 nt, Artificial Sequence
  Marburg virus siRNA sense strand
uaucagucuuaucuuaaucca

SEQ ID NO: 25982 - RNA, 21 nt, Artificial Sequence
  Marburg virus siRNA sense strand
aucagucuuaucuuaauccaa

SEQ ID NO: 25983 - RNA, 21 nt, Artificial Sequence
  Marburg virus siRNA sense strand
ucagucuuaucuuaauccaag

SEQ ID NO: 25984 - RNA, 21 nt, Artificial Sequence
  Marburg virus siRNA sense strand
cagucuuaucuuaauccaagg

SEQ ID NO: 25985 - RNA, 21 nt, Artificial Sequence
  Marburg virus siRNA sense strand
agucuuaucuuaauccaaggg

SEQ ID NO: 25986 - RNA, 21 nt, Artificial Sequence
  Marburg virus siRNA sense strand
gucuuaucuuaauccaaggga

SEQ ID NO: 25987 - RNA, 21 nt, Artificial Sequence
  Marburg virus siRNA sense strand
ucuuaucuuaauccaagggau

SEQ ID NO: 25988 - RNA, 21 nt, Artificial Sequence
  Marburg virus siRNA sense strand
cuuaucuuaauccaagggaua

SEQ ID NO: 25989 - RNA, 21 nt, Artificial Sequence
  Marburg virus siRNA sense strand
uuaucuuaauccaagggauaa

SEQ ID NO: 25990 - RNA, 21 nt, Artificial Sequence
  Marburg virus siRNA sense strand
uaucuuaauccaagggauaaa

SEQ ID NO: 25991 - RNA, 21 nt, Artificial Sequence
  Marburg virus siRNA sense strand
aucuuaauccaagggauaaaa

SEQ ID NO: 25992 - RNA, 21 nt, Artificial Sequence
  Marburg virus siRNA sense strand
ucuuaauccaagggauaaaaa

SEQ ID NO: 25993 - RNA, 21 nt, Artificial Sequence
  Marburg virus siRNA sense strand
cuuaauccaagggauaaaaac

SEQ ID NO: 25994 - RNA, 21 nt, Artificial Sequence
  Marburg virus siRNA sense strand
uuaauccaagggauaaaaacu

SEQ ID NO: 25995 - RNA, 21 nt, Artificial Sequence
  Marburg virus siRNA sense strand
uaauccaagggauaaaaacuc

SEQ ID NO: 25996 - RNA, 21 nt, Artificial Sequence
  Marburg virus siRNA sense strand
aauccaagggauaaaaacucu

SEQ ID NO: 25997 - RNA, 21 nt, Artificial Sequence
  Marburg virus siRNA sense strand
auccaagggauaaaaacucuc

SEQ ID NO: 25998 - RNA, 21 nt, Artificial Sequence
  Marburg virus siRNA sense strand
uccaagggauaaaaacucucc

SEQ ID NO: 25999 - RNA, 21 nt, Artificial Sequence
  Marburg virus siRNA sense strand
ccaagggauaaaaacucuccc

SEQ ID NO: 26000 - RNA, 21 nt, Artificial Sequence
  Marburg virus siRNA sense strand
caagggauaaaaacucucccu

SEQ ID NO: 26001 - RNA, 21 nt, Artificial Sequence
  Marburg virus siRNA sense strand
aagggauaaaaacucucccua

SEQ ID NO: 26002 - RNA, 21 nt, Artificial Sequence
  Marburg virus siRNA sense strand
agggauaaaaacucucccuau

SEQ ID NO: 26003 - RNA, 21 nt, Artificial Sequence
  Marburg virus siRNA sense strand
gggauaaaaacucucccuauu

SEQ ID NO: 26004 - RNA, 21 nt, Artificial Sequence
  Marburg virus siRNA sense strand
ggauaaaaacucucccuauuu

SEQ ID NO: 26005 - RNA, 21 nt, Artificial Sequence
  Marburg virus siRNA sense strand
gauaaaaacucucccuauuuu

SEQ ID NO: 26006 - RNA, 21 nt, Artificial Sequence
  Marburg virus siRNA sense strand
auaaaaacucucccuauuuua

SEQ ID NO: 26007 - RNA, 21 nt, Artificial Sequence
  Marburg virus siRNA sense strand
uaaaaacucucccuauuuuag

SEQ ID NO: 26008 - RNA, 21 nt, Artificial Sequence
  Marburg virus siRNA sense strand
aaaaacucucccuauuuuaga

SEQ ID NO: 26009 - RNA, 21 nt, Artificial Sequence
  Marburg virus siRNA sense strand
aaaacucucccuauuuuagag

SEQ ID NO: 26010 - RNA, 21 nt, Artificial Sequence
  Marburg virus siRNA sense strand
aaacucucccuauuuuagaga

SEQ ID NO: 26011 - RNA, 21 nt, Artificial Sequence
  Marburg virus siRNA sense strand
aacucucccuauuuuagagau

SEQ ID NO: 26012 - RNA, 21 nt, Artificial Sequence
  Marburg virus siRNA sense strand
acucucccuauuuuagagaua

SEQ ID NO: 26013 - RNA, 21 nt, Artificial Sequence
  Marburg virus siRNA sense strand
cucucccuauuuuagagauag

SEQ ID NO: 26014 - RNA, 21 nt, Artificial Sequence
  Marburg virus siRNA sense strand
ucucccuauuuuagagauagc

SEQ ID NO: 26015 - RNA, 21 nt, Artificial Sequence
  Marburg virus siRNA sense strand
cucccuauuuuagagauagcu

SEQ ID NO: 26016 - RNA, 21 nt, Artificial Sequence
  Marburg virus siRNA sense strand
ucccuauuuuagagauagcua

SEQ ID NO: 26017 - RNA, 21 nt, Artificial Sequence
  Marburg virus siRNA sense strand
cccuauuuuagagauagcuag

SEQ ID NO: 26018 - RNA, 21 nt, Artificial Sequence
  Marburg virus siRNA sense strand
ccuauuuuagagauagcuagu

SEQ ID NO: 26019 - RNA, 21 nt, Artificial Sequence
  Marburg virus siRNA sense strand
cuauuuuagagauagcuagua

SEQ ID NO: 26020 - RNA, 21 nt, Artificial Sequence
  Marburg virus siRNA sense strand
uauuuuagagauagcuaguaa

SEQ ID NO: 26021 - RNA, 21 nt, Artificial Sequence
  Marburg virus siRNA sense strand
auuuuagagauagcuaguaac

SEQ ID NO: 26022 - RNA, 21 nt, Artificial Sequence
  Marburg virus siRNA sense strand
uuuuagagauagcuaguaaca

SEQ ID NO: 26023 - RNA, 21 nt, Artificial Sequence
  Marburg virus siRNA sense strand
uuuagagauagcuaguaacaa

SEQ ID NO: 26024 - RNA, 21 nt, Artificial Sequence
  Marburg virus siRNA sense strand
uuagagauagcuaguaacaau

SEQ ID NO: 26025 - RNA, 21 nt, Artificial Sequence
  Marburg virus siRNA sense strand
uagagauagcuaguaacaauc

SEQ ID NO: 26026 - RNA, 21 nt, Artificial Sequence
  Marburg virus siRNA sense strand
agagauagcuaguaacaauca

SEQ ID NO: 26027 - RNA, 21 nt, Artificial Sequence
  Marburg virus siRNA sense strand
gagauagcuaguaacaaucaa

SEQ ID NO: 26028 - RNA, 21 nt, Artificial Sequence
  Marburg virus siRNA sense strand
agauagcuaguaacaaucaac

SEQ ID NO: 26029 - RNA, 21 nt, Artificial Sequence
  Marburg virus siRNA sense strand
gauagcuaguaacaaucaacc

SEQ ID NO: 26030 - RNA, 21 nt, Artificial Sequence
  Marburg virus siRNA sense strand
auagcuaguaacaaucaaccc

SEQ ID NO: 26031 - RNA, 21 nt, Artificial Sequence
  Marburg virus siRNA sense strand
uagcuaguaacaaucaacccc

SEQ ID NO: 26032 - RNA, 21 nt, Artificial Sequence
  Marburg virus siRNA sense strand
agcuaguaacaaucaacccca

SEQ ID NO: 26033 - RNA, 21 nt, Artificial Sequence
  Marburg virus siRNA sense strand
gcuaguaacaaucaaccccaa

SEQ ID NO: 26034 - RNA, 21 nt, Artificial Sequence
  Marburg virus siRNA sense strand
cuaguaacaaucaaccccaaa

SEQ ID NO: 26035 - RNA, 21 nt, Artificial Sequence
  Marburg virus siRNA sense strand
uaguaacaaucaaccccaaaa

SEQ ID NO: 26036 - RNA, 21 nt, Artificial Sequence
  Marburg virus siRNA sense strand
aguaacaaucaaccccaaaau

SEQ ID NO: 26037 - RNA, 21 nt, Artificial Sequence
  Marburg virus siRNA sense strand
guaacaaucaaccccaaaaug

SEQ ID NO: 26038 - RNA, 21 nt, Artificial Sequence
  Marburg virus siRNA sense strand
uaacaaucaaccccaaaaugu

SEQ ID NO: 26039 - RNA, 21 nt, Artificial Sequence
  Marburg virus siRNA sense strand
aacaaucaaccccaaaaugug

SEQ ID NO: 26040 - RNA, 21 nt, Artificial Sequence
  Marburg virus siRNA sense strand
acaaucaaccccaaaaugugg

SEQ ID NO: 26041 - RNA, 21 nt, Artificial Sequence
  Marburg virus siRNA sense strand
caaucaaccccaaaaugugga

SEQ ID NO: 26042 - RNA, 21 nt, Artificial Sequence
  Marburg virus siRNA sense strand
aaucaaccccaaaauguggau

SEQ ID NO: 26043 - RNA, 21 nt, Artificial Sequence
  Marburg virus siRNA sense strand
aucaaccccaaaauguggauu

SEQ ID NO: 26044 - RNA, 21 nt, Artificial Sequence
  Marburg virus siRNA sense strand
ucaaccccaaaauguggauuc

SEQ ID NO: 26045 - RNA, 21 nt, Artificial Sequence
  Marburg virus siRNA sense strand
caaccccaaaauguggauucg

SEQ ID NO: 26046 - RNA, 21 nt, Artificial Sequence
  Marburg virus siRNA sense strand
aaccccaaaauguggauucgg

SEQ ID NO: 26047 - RNA, 21 nt, Artificial Sequence
  Marburg virus siRNA sense strand
accccaaaauguggauucggu

SEQ ID NO: 26048 - RNA, 21 nt, Artificial Sequence
  Marburg virus siRNA sense strand
ccccaaaauguggauucggua

SEQ ID NO: 26049 - RNA, 21 nt, Artificial Sequence
  Marburg virus siRNA sense strand
cccaaaauguggauucgguau

SEQ ID NO: 26050 - RNA, 21 nt, Artificial Sequence
  Marburg virus siRNA sense strand
ccaaaauguggauucgguaug

SEQ ID NO: 26051 - RNA, 21 nt, Artificial Sequence
  Marburg virus siRNA sense strand
caaaauguggauucgguaugc

SEQ ID NO: 26052 - RNA, 21 nt, Artificial Sequence
  Marburg virus siRNA sense strand
aaaauguggauucgguaugcu

SEQ ID NO: 26053 - RNA, 21 nt, Artificial Sequence
  Marburg virus siRNA sense strand
aaauguggauucgguaugcuc

SEQ ID NO: 26054 - RNA, 21 nt, Artificial Sequence
  Marburg virus siRNA sense strand
aauguggauucgguaugcucc

SEQ ID NO: 26055 - RNA, 21 nt, Artificial Sequence
  Marburg virus siRNA sense strand
auguggauucgguaugcuccg

SEQ ID NO: 26056 - RNA, 21 nt, Artificial Sequence
  Marburg virus siRNA sense strand
uguggauucgguaugcuccgg

SEQ ID NO: 26057 - RNA, 21 nt, Artificial Sequence
  Marburg virus siRNA sense strand
guggauucgguaugcuccgga

SEQ ID NO: 26058 - RNA, 21 nt, Artificial Sequence
  Marburg virus siRNA sense strand
uggauucgguaugcuccggaa

SEQ ID NO: 26059 - RNA, 21 nt, Artificial Sequence
  Marburg virus siRNA sense strand
ggauucgguaugcuccggaac

SEQ ID NO: 26060 - RNA, 21 nt, Artificial Sequence
  Marburg virus siRNA sense strand
gauucgguaugcuccggaacu

SEQ ID NO: 26061 - RNA, 21 nt, Artificial Sequence
  Marburg virus siRNA sense strand
auucgguaugcuccggaacuc

SEQ ID NO: 26062 - RNA, 21 nt, Artificial Sequence
  Marburg virus siRNA sense strand
uucgguaugcuccggaacucu

SEQ ID NO: 26063 - RNA, 21 nt, Artificial Sequence
  Marburg virus siRNA sense strand
ucgguaugcuccggaacucuc

SEQ ID NO: 26064 - RNA, 21 nt, Artificial Sequence
  Marburg virus siRNA sense strand
cgguaugcuccggaacucucc

SEQ ID NO: 26065 - RNA, 21 nt, Artificial Sequence
  Marburg virus siRNA sense strand
gguaugcuccggaacucucca

SEQ ID NO: 26066 - RNA, 21 nt, Artificial Sequence
  Marburg virus siRNA sense strand
guaugcuccggaacucuccag

SEQ ID NO: 26067 - RNA, 21 nt, Artificial Sequence
  Marburg virus siRNA sense strand
uaugcuccggaacucuccaga

SEQ ID NO: 26068 - RNA, 21 nt, Artificial Sequence
  Marburg virus siRNA sense strand
augcuccggaacucuccagaa

SEQ ID NO: 26069 - RNA, 21 nt, Artificial Sequence
  Marburg virus siRNA sense strand
ugcuccggaacucuccagaag

SEQ ID NO: 26070 - RNA, 21 nt, Artificial Sequence
  Marburg virus siRNA sense strand
gcuccggaacucuccagaaga

SEQ ID NO: 26071 - RNA, 21 nt, Artificial Sequence
  Marburg virus siRNA sense strand
cuccggaacucuccagaagac

SEQ ID NO: 26072 - RNA, 21 nt, Artificial Sequence
  Marburg virus siRNA sense strand
uccggaacucuccagaagaca

SEQ ID NO: 26073 - RNA, 21 nt, Artificial Sequence
  Marburg virus siRNA sense strand
ccggaacucuccagaagacag

SEQ ID NO: 26074 - RNA, 21 nt, Artificial Sequence
  Marburg virus siRNA sense strand
cggaacucuccagaagacaga

SEQ ID NO: 26075 - RNA, 21 nt, Artificial Sequence
  Marburg virus siRNA sense strand
ggaacucuccagaagacagaa

SEQ ID NO: 26076 - RNA, 21 nt, Artificial Sequence
  Marburg virus siRNA sense strand
gaacucuccagaagacagaag

SEQ ID NO: 26077 - RNA, 21 nt, Artificial Sequence
  Marburg virus siRNA sense strand
aacucuccagaagacagaaga

SEQ ID NO: 26078 - RNA, 21 nt, Artificial Sequence
  Marburg virus siRNA sense strand
acucuccagaagacagaagau

SEQ ID NO: 26079 - RNA, 21 nt, Artificial Sequence
  Marburg virus siRNA sense strand
cucuccagaagacagaagaug

SEQ ID NO: 26080 - RNA, 21 nt, Artificial Sequence
  Marburg virus siRNA sense strand
ucuccagaagacagaagaugu

SEQ ID NO: 26081 - RNA, 21 nt, Artificial Sequence
  Marburg virus siRNA sense strand
cuccagaagacagaagauguc

SEQ ID NO: 26082 - RNA, 21 nt, Artificial Sequence
  Marburg virus siRNA sense strand
uccagaagacagaagaugucc

SEQ ID NO: 26083 - RNA, 21 nt, Artificial Sequence
  Marburg virus siRNA sense strand
ccagaagacagaagaugucca

SEQ ID NO: 26084 - RNA, 21 nt, Artificial Sequence
  Marburg virus siRNA sense strand
cagaagacagaagauguccau

SEQ ID NO: 26085 - RNA, 21 nt, Artificial Sequence
  Marburg virus siRNA sense strand
agaagacagaagauguccauc

SEQ ID NO: 26086 - RNA, 21 nt, Artificial Sequence
  Marburg virus siRNA sense strand
gaagacagaagauguccaucu

SEQ ID NO: 26087 - RNA, 21 nt, Artificial Sequence
  Marburg virus siRNA sense strand
aagacagaagauguccaucug

SEQ ID NO: 26088 - RNA, 21 nt, Artificial Sequence
  Marburg virus siRNA sense strand
agacagaagauguccaucuga

SEQ ID NO: 26089 - RNA, 21 nt, Artificial Sequence
  Marburg virus siRNA sense strand
gacagaagauguccaucugau

SEQ ID NO: 26090 - RNA, 21 nt, Artificial Sequence
  Marburg virus siRNA sense strand
acagaagauguccaucugaug

SEQ ID NO: 26091 - RNA, 21 nt, Artificial Sequence
  Marburg virus siRNA sense strand
cagaagauguccaucugaugg

SEQ ID NO: 26092 - RNA, 21 nt, Artificial Sequence
  Marburg virus siRNA sense strand
agaagauguccaucugauggg

SEQ ID NO: 26093 - RNA, 21 nt, Artificial Sequence
  Marburg virus siRNA sense strand
gaagauguccaucugauggga

SEQ ID NO: 26094 - RNA, 21 nt, Artificial Sequence
  Marburg virus siRNA sense strand
aagauguccaucugaugggau

SEQ ID NO: 26095 - RNA, 21 nt, Artificial Sequence
  Marburg virus siRNA sense strand
agauguccaucugaugggauu

SEQ ID NO: 26096 - RNA, 21 nt, Artificial Sequence
  Marburg virus siRNA sense strand
gauguccaucugaugggauuc

SEQ ID NO: 26097 - RNA, 21 nt, Artificial Sequence
  Marburg virus siRNA sense strand
auguccaucugaugggauuca

SEQ ID NO: 26098 - RNA, 21 nt, Artificial Sequence
  Marburg virus siRNA sense strand
uguccaucugaugggauucac

SEQ ID NO: 26099 - RNA, 21 nt, Artificial Sequence
  Marburg virus siRNA sense strand
guccaucugaugggauucaca

SEQ ID NO: 26100 - RNA, 21 nt, Artificial Sequence
  Marburg virus siRNA sense strand
uccaucugaugggauucacac

SEQ ID NO: 26101 - RNA, 21 nt, Artificial Sequence
  Marburg virus siRNA sense strand
ccaucugaugggauucacacu

SEQ ID NO: 26102 - RNA, 21 nt, Artificial Sequence
  Marburg virus siRNA sense strand
caucugaugggauucacacug

SEQ ID NO: 26103 - RNA, 21 nt, Artificial Sequence
  Marburg virus siRNA sense strand
aucugaugggauucacacuga

SEQ ID NO: 26104 - RNA, 21 nt, Artificial Sequence
  Marburg virus siRNA sense strand
ucugaugggauucacacugag

SEQ ID NO: 26105 - RNA, 21 nt, Artificial Sequence
  Marburg virus siRNA sense strand
cugaugggauucacacugagu

SEQ ID NO: 26106 - RNA, 21 nt, Artificial Sequence
  Marburg virus siRNA sense strand
ugaugggauucacacugagug

SEQ ID NO: 26107 - RNA, 21 nt, Artificial Sequence
  Marburg virus siRNA sense strand
gaugggauucacacugagugg

SEQ ID NO: 26108 - RNA, 21 nt, Artificial Sequence
  Marburg virus siRNA sense strand
augggauucacacugaguggg

SEQ ID NO: 26109 - RNA, 21 nt, Artificial Sequence
  Marburg virus siRNA sense strand
ugggauucacacugagugggc

SEQ ID NO: 26110 - RNA, 21 nt, Artificial Sequence
  Marburg virus siRNA sense strand
gggauucacacugagugggca

SEQ ID NO: 26111 - RNA, 21 nt, Artificial Sequence
  Marburg virus siRNA sense strand
ggauucacacugagugggcaa

SEQ ID NO: 26112 - RNA, 21 nt, Artificial Sequence
  Marburg virus siRNA sense strand
gauucacacugagugggcaaa

SEQ ID NO: 26113 - RNA, 21 nt, Artificial Sequence
  Marburg virus siRNA sense strand
auucacacugagugggcaaaa

SEQ ID NO: 26114 - RNA, 21 nt, Artificial Sequence
  Marburg virus siRNA sense strand
uucacacugagugggcaaaaa

SEQ ID NO: 26115 - RNA, 21 nt, Artificial Sequence
  Marburg virus siRNA sense strand
ucacacugagugggcaaaaag

SEQ ID NO: 26116 - RNA, 21 nt, Artificial Sequence
  Marburg virus siRNA sense strand
cacacugagugggcaaaaagu

SEQ ID NO: 26117 - RNA, 21 nt, Artificial Sequence
  Marburg virus siRNA sense strand
acacugagugggcaaaaaguu

SEQ ID NO: 26118 - RNA, 21 nt, Artificial Sequence
  Marburg virus siRNA sense strand
cacugagugggcaaaaaguug

SEQ ID NO: 26119 - RNA, 21 nt, Artificial Sequence
  Marburg virus siRNA sense strand
acugagugggcaaaaaguugc

SEQ ID NO: 26120 - RNA, 21 nt, Artificial Sequence
  Marburg virus siRNA sense strand
cugagugggcaaaaaguugcu

SEQ ID NO: 26121 - RNA, 21 nt, Artificial Sequence
  Marburg virus siRNA sense strand
ugagugggcaaaaaguugcug

SEQ ID NO: 26122 - RNA, 21 nt, Artificial Sequence
  Marburg virus siRNA sense strand
gagugggcaaaaaguugcuga

SEQ ID NO: 26123 - RNA, 21 nt, Artificial Sequence
  Marburg virus siRNA sense strand
agugggcaaaaaguugcugau

SEQ ID NO: 26124 - RNA, 21 nt, Artificial Sequence
  Marburg virus siRNA sense strand
gugggcaaaaaguugcugauu

SEQ ID NO: 26125 - RNA, 21 nt, Artificial Sequence
  Marburg virus siRNA sense strand
ugggcaaaaaguugcugauuc

SEQ ID NO: 26126 - RNA, 21 nt, Artificial Sequence
  Marburg virus siRNA sense strand
gggcaaaaaguugcugauucc

SEQ ID NO: 26127 - RNA, 21 nt, Artificial Sequence
  Marburg virus siRNA sense strand
ggcaaaaaguugcugauuccc

SEQ ID NO: 26128 - RNA, 21 nt, Artificial Sequence
  Marburg virus siRNA sense strand
gcaaaaaguugcugauucccc

SEQ ID NO: 26129 - RNA, 21 nt, Artificial Sequence
  Marburg virus siRNA sense strand
caaaaaguugcugauuccccu

SEQ ID NO: 26130 - RNA, 21 nt, Artificial Sequence
  Marburg virus siRNA sense strand
aaaaaguugcugauuccccuu

SEQ ID NO: 26131 - RNA, 21 nt, Artificial Sequence
  Marburg virus siRNA sense strand
aaaaguugcugauuccccuuu

SEQ ID NO: 26132 - RNA, 21 nt, Artificial Sequence
  Marburg virus siRNA sense strand
aaaguugcugauuccccuuug

SEQ ID NO: 26133 - RNA, 21 nt, Artificial Sequence
  Marburg virus siRNA sense strand
aaguugcugauuccccuuugg

SEQ ID NO: 26134 - RNA, 21 nt, Artificial Sequence
  Marburg virus siRNA sense strand
aguugcugauuccccuuugga

SEQ ID NO: 26135 - RNA, 21 nt, Artificial Sequence
  Marburg virus siRNA sense strand
guugcugauuccccuuuggag

SEQ ID NO: 26136 - RNA, 21 nt, Artificial Sequence
  Marburg virus siRNA sense strand
uugcugauuccccuuuggagg

SEQ ID NO: 26137 - RNA, 21 nt, Artificial Sequence
  Marburg virus siRNA sense strand
ugcugauuccccuuuggaggc

SEQ ID NO: 26138 - RNA, 21 nt, Artificial Sequence
  Marburg virus siRNA sense strand
gcugauuccccuuuggaggca

SEQ ID NO: 26139 - RNA, 21 nt, Artificial Sequence
  Marburg virus siRNA sense strand
cugauuccccuuuggaggcau

SEQ ID NO: 26140 - RNA, 21 nt, Artificial Sequence
  Marburg virus siRNA sense strand
ugauuccccuuuggaggcauc

SEQ ID NO: 26141 - RNA, 21 nt, Artificial Sequence
  Marburg virus siRNA sense strand
gauuccccuuuggaggcaucc

SEQ ID NO: 26142 - RNA, 21 nt, Artificial Sequence
  Marburg virus siRNA sense strand
auuccccuuuggaggcaucca

SEQ ID NO: 26143 - RNA, 21 nt, Artificial Sequence
  Marburg virus siRNA sense strand
uuccccuuuggaggcauccaa

SEQ ID NO: 26144 - RNA, 21 nt, Artificial Sequence
  Marburg virus siRNA sense strand
uccccuuuggaggcauccaag

SEQ ID NO: 26145 - RNA, 21 nt, Artificial Sequence
  Marburg virus siRNA sense strand
ccccuuuggaggcauccaagc

SEQ ID NO: 26146 - RNA, 21 nt, Artificial Sequence
  Marburg virus siRNA sense strand
cccuuuggaggcauccaagcg

SEQ ID NO: 26147 - RNA, 21 nt, Artificial Sequence
  Marburg virus siRNA sense strand
ccuuuggaggcauccaagcga

SEQ ID NO: 26148 - RNA, 21 nt, Artificial Sequence
  Marburg virus siRNA sense strand
cuuuggaggcauccaagcgau

SEQ ID NO: 26149 - RNA, 21 nt, Artificial Sequence
  Marburg virus siRNA sense strand
uuuggaggcauccaagcgaug

SEQ ID NO: 26150 - RNA, 21 nt, Artificial Sequence
  Marburg virus siRNA sense strand
uuggaggcauccaagcgaugg

SEQ ID NO: 26151 - RNA, 21 nt, Artificial Sequence
  Marburg virus siRNA sense strand
uggaggcauccaagcgauggg

SEQ ID NO: 26152 - RNA, 21 nt, Artificial Sequence
  Marburg virus siRNA sense strand
ggaggcauccaagcgaugggc

SEQ ID NO: 26153 - RNA, 21 nt, Artificial Sequence
  Marburg virus siRNA sense strand
gaggcauccaagcgaugggcu

SEQ ID NO: 26154 - RNA, 21 nt, Artificial Sequence
  Marburg virus siRNA sense strand
aggcauccaagcgaugggcuu

SEQ ID NO: 26155 - RNA, 21 nt, Artificial Sequence
  Marburg virus siRNA sense strand
ggcauccaagcgaugggcuuu

SEQ ID NO: 26156 - RNA, 21 nt, Artificial Sequence
  Marburg virus siRNA sense strand
gcauccaagcgaugggcuuuc

SEQ ID NO: 26157 - RNA, 21 nt, Artificial Sequence
  Marburg virus siRNA sense strand
cauccaagcgaugggcuuuca

SEQ ID NO: 26158 - RNA, 21 nt, Artificial Sequence
  Marburg virus siRNA sense strand
auccaagcgaugggcuuucag

SEQ ID NO: 26159 - RNA, 21 nt, Artificial Sequence
  Marburg virus siRNA sense strand
uccaagcgaugggcuuucagg

SEQ ID NO: 26160 - RNA, 21 nt, Artificial Sequence
  Marburg virus siRNA sense strand
ccaagcgaugggcuuucagga

SEQ ID NO: 26161 - RNA, 21 nt, Artificial Sequence
  Marburg virus siRNA sense strand
caagcgaugggcuuucaggac

SEQ ID NO: 26162 - RNA, 21 nt, Artificial Sequence
  Marburg virus siRNA sense strand
aagcgaugggcuuucaggaca

SEQ ID NO: 26163 - RNA, 21 nt, Artificial Sequence
  Marburg virus siRNA sense strand
agcgaugggcuuucaggacag

SEQ ID NO: 26164 - RNA, 21 nt, Artificial Sequence
  Marburg virus siRNA sense strand
gcgaugggcuuucaggacagg

SEQ ID NO: 26165 - RNA, 21 nt, Artificial Sequence
  Marburg virus siRNA sense strand
cgaugggcuuucaggacaggu

SEQ ID NO: 26166 - RNA, 21 nt, Artificial Sequence
  Marburg virus siRNA sense strand
gaugggcuuucaggacaggug

SEQ ID NO: 26167 - RNA, 21 nt, Artificial Sequence
  Marburg virus siRNA sense strand
augggcuuucaggacaggugu

SEQ ID NO: 26168 - RNA, 21 nt, Artificial Sequence
  Marburg virus siRNA sense strand
ugggcuuucaggacaggugua

SEQ ID NO: 26169 - RNA, 21 nt, Artificial Sequence
  Marburg virus siRNA sense strand
gggcuuucaggacagguguac

SEQ ID NO: 26170 - RNA, 21 nt, Artificial Sequence
  Marburg virus siRNA sense strand
ggcuuucaggacagguguacc

SEQ ID NO: 26171 - RNA, 21 nt, Artificial Sequence
  Marburg virus siRNA sense strand
gcuuucaggacagguguaccu

SEQ ID NO: 26172 - RNA, 21 nt, Artificial Sequence
  Marburg virus siRNA sense strand
cuuucaggacagguguaccuc

SEQ ID NO: 26173 - RNA, 21 nt, Artificial Sequence
  Marburg virus siRNA sense strand
uuucaggacagguguaccucc

SEQ ID NO: 26174 - RNA, 21 nt, Artificial Sequence
  Marburg virus siRNA sense strand
uucaggacagguguaccuccc

SEQ ID NO: 26175 - RNA, 21 nt, Artificial Sequence
  Marburg virus siRNA sense strand
ucaggacagguguaccuccca

SEQ ID NO: 26176 - RNA, 21 nt, Artificial Sequence
  Marburg virus siRNA sense strand
caggacagguguaccucccaa

SEQ ID NO: 26177 - RNA, 21 nt, Artificial Sequence
  Marburg virus siRNA sense strand
aggacagguguaccucccaag

SEQ ID NO: 26178 - RNA, 21 nt, Artificial Sequence
  Marburg virus siRNA sense strand
ggacagguguaccucccaaga

SEQ ID NO: 26179 - RNA, 21 nt, Artificial Sequence
  Marburg virus siRNA sense strand
gacagguguaccucccaagaa

SEQ ID NO: 26180 - RNA, 21 nt, Artificial Sequence
  Marburg virus siRNA sense strand
acagguguaccucccaagaau

SEQ ID NO: 26181 - RNA, 21 nt, Artificial Sequence
  Marburg virus siRNA sense strand
cagguguaccucccaagaaug

SEQ ID NO: 26182 - RNA, 21 nt, Artificial Sequence
  Marburg virus siRNA sense strand
agguguaccucccaagaaugu

SEQ ID NO: 26183 - RNA, 21 nt, Artificial Sequence
  Marburg virus siRNA sense strand
gguguaccucccaagaauguu

SEQ ID NO: 26184 - RNA, 21 nt, Artificial Sequence
  Marburg virus siRNA sense strand
guguaccucccaagaauguug

SEQ ID NO: 26185 - RNA, 21 nt, Artificial Sequence
  Marburg virus siRNA sense strand
uguaccucccaagaauguuga

SEQ ID NO: 26186 - RNA, 21 nt, Artificial Sequence
  Marburg virus siRNA sense strand
guaccucccaagaauguugag

SEQ ID NO: 26187 - RNA, 21 nt, Artificial Sequence
  Marburg virus siRNA sense strand
uaccucccaagaauguugagu

SEQ ID NO: 26188 - RNA, 21 nt, Artificial Sequence
  Marburg virus siRNA sense strand
accucccaagaauguugagua

SEQ ID NO: 26189 - RNA, 21 nt, Artificial Sequence
  Marburg virus siRNA sense strand
ccucccaagaauguugaguau

SEQ ID NO: 26190 - RNA, 21 nt, Artificial Sequence
  Marburg virus siRNA sense strand
cucccaagaauguugaguaua

SEQ ID NO: 26191 - RNA, 21 nt, Artificial Sequence
  Marburg virus siRNA sense strand
ucccaagaauguugaguauac

SEQ ID NO: 26192 - RNA, 21 nt, Artificial Sequence
  Marburg virus siRNA sense strand
cccaagaauguugaguauaca

SEQ ID NO: 26193 - RNA, 21 nt, Artificial Sequence
  Marburg virus siRNA sense strand
ccaagaauguugaguauacag

SEQ ID NO: 26194 - RNA, 21 nt, Artificial Sequence
  Marburg virus siRNA sense strand
caagaauguugaguauacaga

SEQ ID NO: 26195 - RNA, 21 nt, Artificial Sequence
  Marburg virus siRNA sense strand
aagaauguugaguauacagaa

SEQ ID NO: 26196 - RNA, 21 nt, Artificial Sequence
  Marburg virus siRNA sense strand
agaauguugaguauacagaag

SEQ ID NO: 26197 - RNA, 21 nt, Artificial Sequence
  Marburg virus siRNA sense strand
gaauguugaguauacagaagg

SEQ ID NO: 26198 - RNA, 21 nt, Artificial Sequence
  Marburg virus siRNA sense strand
aauguugaguauacagaaggg

SEQ ID NO: 26199 - RNA, 21 nt, Artificial Sequence
  Marburg virus siRNA sense strand
auguugaguauacagaagggg

SEQ ID NO: 26200 - RNA, 21 nt, Artificial Sequence
  Marburg virus siRNA sense strand
uguugaguauacagaagggga

SEQ ID NO: 26201 - RNA, 21 nt, Artificial Sequence
  Marburg virus siRNA sense strand
guugaguauacagaaggggag

SEQ ID NO: 26202 - RNA, 21 nt, Artificial Sequence
  Marburg virus siRNA sense strand
uugaguauacagaaggggagg

SEQ ID NO: 26203 - RNA, 21 nt, Artificial Sequence
  Marburg virus siRNA sense strand
ugaguauacagaaggggagga

SEQ ID NO: 26204 - RNA, 21 nt, Artificial Sequence
  Marburg virus siRNA sense strand
gaguauacagaaggggaggaa

SEQ ID NO: 26205 - RNA, 21 nt, Artificial Sequence
  Marburg virus siRNA sense strand
aguauacagaaggggaggaag

SEQ ID NO: 26206 - RNA, 21 nt, Artificial Sequence
  Marburg virus siRNA sense strand
guauacagaaggggaggaagc

SEQ ID NO: 26207 - RNA, 21 nt, Artificial Sequence
  Marburg virus siRNA sense strand
uauacagaaggggaggaagcc

SEQ ID NO: 26208 - RNA, 21 nt, Artificial Sequence
  Marburg virus siRNA sense strand
auacagaaggggaggaagcca

SEQ ID NO: 26209 - RNA, 21 nt, Artificial Sequence
  Marburg virus siRNA sense strand
uacagaaggggaggaagccaa

SEQ ID NO: 26210 - RNA, 21 nt, Artificial Sequence
  Marburg virus siRNA sense strand
acagaaggggaggaagccaaa

SEQ ID NO: 26211 - RNA, 21 nt, Artificial Sequence
  Marburg virus siRNA sense strand
cagaaggggaggaagccaaaa

SEQ ID NO: 26212 - RNA, 21 nt, Artificial Sequence
  Marburg virus siRNA sense strand
agaaggggaggaagccaaaac

SEQ ID NO: 26213 - RNA, 21 nt, Artificial Sequence
  Marburg virus siRNA sense strand
gaaggggaggaagccaaaaca

SEQ ID NO: 26214 - RNA, 21 nt, Artificial Sequence
  Marburg virus siRNA sense strand
aaggggaggaagccaaaacau

SEQ ID NO: 26215 - RNA, 21 nt, Artificial Sequence
  Marburg virus siRNA sense strand
aggggaggaagccaaaacaug

SEQ ID NO: 26216 - RNA, 21 nt, Artificial Sequence
  Marburg virus siRNA sense strand
ggggaggaagccaaaacaugc

SEQ ID NO: 26217 - RNA, 21 nt, Artificial Sequence
  Marburg virus siRNA sense strand
gggaggaagccaaaacaugcu

SEQ ID NO: 26218 - RNA, 21 nt, Artificial Sequence
  Marburg virus siRNA sense strand
ggaggaagccaaaacaugcua

SEQ ID NO: 26219 - RNA, 21 nt, Artificial Sequence
  Marburg virus siRNA sense strand
gaggaagccaaaacaugcuac

SEQ ID NO: 26220 - RNA, 21 nt, Artificial Sequence
  Marburg virus siRNA sense strand
aggaagccaaaacaugcuaca

SEQ ID NO: 26221 - RNA, 21 nt, Artificial Sequence
  Marburg virus siRNA sense strand
ggaagccaaaacaugcuacaa

SEQ ID NO: 26222 - RNA, 21 nt, Artificial Sequence
  Marburg virus siRNA sense strand
gaagccaaaacaugcuacaau

SEQ ID NO: 26223 - RNA, 21 nt, Artificial Sequence
  Marburg virus siRNA sense strand
aagccaaaacaugcuacaaua

SEQ ID NO: 26224 - RNA, 21 nt, Artificial Sequence
  Marburg virus siRNA sense strand
agccaaaacaugcuacaauau

SEQ ID NO: 26225 - RNA, 21 nt, Artificial Sequence
  Marburg virus siRNA sense strand
gccaaaacaugcuacaauaua

SEQ ID NO: 26226 - RNA, 21 nt, Artificial Sequence
  Marburg virus siRNA sense strand
ccaaaacaugcuacaauauaa

SEQ ID NO: 26227 - RNA, 21 nt, Artificial Sequence
  Marburg virus siRNA sense strand
caaaacaugcuacaauauaag

SEQ ID NO: 26228 - RNA, 21 nt, Artificial Sequence
  Marburg virus siRNA sense strand
aaaacaugcuacaauauaagu

SEQ ID NO: 26229 - RNA, 21 nt, Artificial Sequence
  Marburg virus siRNA sense strand
aaacaugcuacaauauaagug

SEQ ID NO: 26230 - RNA, 21 nt, Artificial Sequence
  Marburg virus siRNA sense strand
aacaugcuacaauauaagugu

SEQ ID NO: 26231 - RNA, 21 nt, Artificial Sequence
  Marburg virus siRNA sense strand
acaugcuacaauauaagugua

SEQ ID NO: 26232 - RNA, 21 nt, Artificial Sequence
  Marburg virus siRNA sense strand
caugcuacaauauaaguguaa

SEQ ID NO: 26233 - RNA, 21 nt, Artificial Sequence
  Marburg virus siRNA sense strand
augcuacaauauaaguguaac

SEQ ID NO: 26234 - RNA, 21 nt, Artificial Sequence
  Marburg virus siRNA sense strand
ugcuacaauauaaguguaacg

SEQ ID NO: 26235 - RNA, 21 nt, Artificial Sequence
  Marburg virus siRNA sense strand
gcuacaauauaaguguaacgg

SEQ ID NO: 26236 - RNA, 21 nt, Artificial Sequence
  Marburg virus siRNA sense strand
cuacaauauaaguguaacgga

SEQ ID NO: 26237 - RNA, 21 nt, Artificial Sequence
  Marburg virus siRNA sense strand
uacaauauaaguguaacggau

SEQ ID NO: 26238 - RNA, 21 nt, Artificial Sequence
  Marburg virus siRNA sense strand
acaauauaaguguaacggauc

SEQ ID NO: 26239 - RNA, 21 nt, Artificial Sequence
  Marburg virus siRNA sense strand
caauauaaguguaacggaucc

SEQ ID NO: 26240 - RNA, 21 nt, Artificial Sequence
  Marburg virus siRNA sense strand
aauauaaguguaacggauccc

SEQ ID NO: 26241 - RNA, 21 nt, Artificial Sequence
  Marburg virus siRNA sense strand
auauaaguguaacggaucccu

SEQ ID NO: 26242 - RNA, 21 nt, Artificial Sequence
  Marburg virus siRNA sense strand
uauaaguguaacggaucccuc

SEQ ID NO: 26243 - RNA, 21 nt, Artificial Sequence
  Marburg virus siRNA sense strand
auaaguguaacggaucccucu

SEQ ID NO: 26244 - RNA, 21 nt, Artificial Sequence
  Marburg virus siRNA sense strand
uaaguguaacggaucccucug

SEQ ID NO: 26245 - RNA, 21 nt, Artificial Sequence
  Marburg virus siRNA sense strand
aaguguaacggaucccucugg

SEQ ID NO: 26246 - RNA, 21 nt, Artificial Sequence
  Marburg virus siRNA sense strand
aguguaacggaucccucugga

SEQ ID NO: 26247 - RNA, 21 nt, Artificial Sequence
  Marburg virus siRNA sense strand
guguaacggaucccucuggaa

SEQ ID NO: 26248 - RNA, 21 nt, Artificial Sequence
  Marburg virus siRNA sense strand
uguaacggaucccucuggaaa

SEQ ID NO: 26249 - RNA, 21 nt, Artificial Sequence
  Marburg virus siRNA sense strand
guaacggaucccucuggaaaa

SEQ ID NO: 26250 - RNA, 21 nt, Artificial Sequence
  Marburg virus siRNA sense strand
uaacggaucccucuggaaaau

SEQ ID NO: 26251 - RNA, 21 nt, Artificial Sequence
  Marburg virus siRNA sense strand
aacggaucccucuggaaaauc

SEQ ID NO: 26252 - RNA, 21 nt, Artificial Sequence
  Marburg virus siRNA sense strand
acggaucccucuggaaaaucc

SEQ ID NO: 26253 - RNA, 21 nt, Artificial Sequence
  Marburg virus siRNA sense strand
cggaucccucuggaaaauccu

SEQ ID NO: 26254 - RNA, 21 nt, Artificial Sequence
  Marburg virus siRNA sense strand
ggaucccucuggaaaauccuu

SEQ ID NO: 26255 - RNA, 21 nt, Artificial Sequence
  Marburg virus siRNA sense strand
gaucccucuggaaaauccuug

SEQ ID NO: 26256 - RNA, 21 nt, Artificial Sequence
  Marburg virus siRNA sense strand
aucccucuggaaaauccuugc

SEQ ID NO: 26257 - RNA, 21 nt, Artificial Sequence
  Marburg virus siRNA sense strand
ucccucuggaaaauccuugcu

SEQ ID NO: 26258 - RNA, 21 nt, Artificial Sequence
  Marburg virus siRNA sense strand
cccucuggaaaauccuugcug

SEQ ID NO: 26259 - RNA, 21 nt, Artificial Sequence
  Marburg virus siRNA sense strand
ccucuggaaaauccuugcugu

SEQ ID NO: 26260 - RNA, 21 nt, Artificial Sequence
  Marburg virus siRNA sense strand
cucuggaaaauccuugcuguu

SEQ ID NO: 26261 - RNA, 21 nt, Artificial Sequence
  Marburg virus siRNA sense strand
ucuggaaaauccuugcuguug

SEQ ID NO: 26262 - RNA, 21 nt, Artificial Sequence
  Marburg virus siRNA sense strand
cuggaaaauccuugcuguugg

SEQ ID NO: 26263 - RNA, 21 nt, Artificial Sequence
  Marburg virus siRNA sense strand
uggaaaauccuugcuguugga

SEQ ID NO: 26264 - RNA, 21 nt, Artificial Sequence
  Marburg virus siRNA sense strand
ggaaaauccuugcuguuggau

SEQ ID NO: 26265 - RNA, 21 nt, Artificial Sequence
  Marburg virus siRNA sense strand
gaaaauccuugcuguuggauc

SEQ ID NO: 26266 - RNA, 21 nt, Artificial Sequence
  Marburg virus siRNA sense strand
aaaauccuugcuguuggaucc

SEQ ID NO: 26267 - RNA, 21 nt, Artificial Sequence
  Marburg virus siRNA sense strand
aaauccuugcuguuggauccu

SEQ ID NO: 26268 - RNA, 21 nt, Artificial Sequence
  Marburg virus siRNA sense strand
aauccuugcuguuggauccuc

SEQ ID NO: 26269 - RNA, 21 nt, Artificial Sequence
  Marburg virus siRNA sense strand
auccuugcuguuggauccucc

SEQ ID NO: 26270 - RNA, 21 nt, Artificial Sequence
  Marburg virus siRNA sense strand
uccuugcuguuggauccuccu

SEQ ID NO: 26271 - RNA, 21 nt, Artificial Sequence
  Marburg virus siRNA sense strand
ccuugcuguuggauccuccua

SEQ ID NO: 26272 - RNA, 21 nt, Artificial Sequence
  Marburg virus siRNA sense strand
cuugcuguuggauccuccuac

SEQ ID NO: 26273 - RNA, 21 nt, Artificial Sequence
  Marburg virus siRNA sense strand
uugcuguuggauccuccuacc

SEQ ID NO: 26274 - RNA, 21 nt, Artificial Sequence
  Marburg virus siRNA sense strand
ugcuguuggauccuccuacca

SEQ ID NO: 26275 - RNA, 21 nt, Artificial Sequence
  Marburg virus siRNA sense strand
gcuguuggauccuccuaccaa

SEQ ID NO: 26276 - RNA, 21 nt, Artificial Sequence
  Marburg virus siRNA sense strand
cuguuggauccuccuaccaac

SEQ ID NO: 26277 - RNA, 21 nt, Artificial Sequence
  Marburg virus siRNA sense strand
uguuggauccuccuaccaaca

SEQ ID NO: 26278 - RNA, 21 nt, Artificial Sequence
  Marburg virus siRNA sense strand
guuggauccuccuaccaacau

SEQ ID NO: 26279 - RNA, 21 nt, Artificial Sequence
  Marburg virus siRNA sense strand
uuggauccuccuaccaacauc

SEQ ID NO: 26280 - RNA, 21 nt, Artificial Sequence
  Marburg virus siRNA sense strand
uggauccuccuaccaacaucc

SEQ ID NO: 26281 - RNA, 21 nt, Artificial Sequence
  Marburg virus siRNA sense strand
ggauccuccuaccaacauccg

SEQ ID NO: 26282 - RNA, 21 nt, Artificial Sequence
  Marburg virus siRNA sense strand
gauccuccuaccaacauccgu

SEQ ID NO: 26283 - RNA, 21 nt, Artificial Sequence
  Marburg virus siRNA sense strand
auccuccuaccaacauccgug

SEQ ID NO: 26284 - RNA, 21 nt, Artificial Sequence
  Marburg virus siRNA sense strand
uccuccuaccaacauccguga

SEQ ID NO: 26285 - RNA, 21 nt, Artificial Sequence
  Marburg virus siRNA sense strand
ccuccuaccaacauccgugac

SEQ ID NO: 26286 - RNA, 21 nt, Artificial Sequence
  Marburg virus siRNA sense strand
cuccuaccaacauccgugacu

SEQ ID NO: 26287 - RNA, 21 nt, Artificial Sequence
  Marburg virus siRNA sense strand
uccuaccaacauccgugacua

SEQ ID NO: 26288 - RNA, 21 nt, Artificial Sequence
  Marburg virus siRNA sense strand
ccuaccaacauccgugacuau

SEQ ID NO: 26289 - RNA, 21 nt, Artificial Sequence
  Marburg virus siRNA sense strand
cuaccaacauccgugacuauc

SEQ ID NO: 26290 - RNA, 21 nt, Artificial Sequence
  Marburg virus siRNA sense strand
uaccaacauccgugacuaucc

SEQ ID NO: 26291 - RNA, 21 nt, Artificial Sequence
  Marburg virus siRNA sense strand
accaacauccgugacuauccu

SEQ ID NO: 26292 - RNA, 21 nt, Artificial Sequence
  Marburg virus siRNA sense strand
ccaacauccgugacuauccua

SEQ ID NO: 26293 - RNA, 21 nt, Artificial Sequence
  Marburg virus siRNA sense strand
caacauccgugacuauccuaa

SEQ ID NO: 26294 - RNA, 21 nt, Artificial Sequence
  Marburg virus siRNA sense strand
aacauccgugacuauccuaaa

SEQ ID NO: 26295 - RNA, 21 nt, Artificial Sequence
  Marburg virus siRNA sense strand
acauccgugacuauccuaaau

SEQ ID NO: 26296 - RNA, 21 nt, Artificial Sequence
  Marburg virus siRNA sense strand
cauccgugacuauccuaaaug

SEQ ID NO: 26297 - RNA, 21 nt, Artificial Sequence
  Marburg virus siRNA sense strand
auccgugacuauccuaaaugc

SEQ ID NO: 26298 - RNA, 21 nt, Artificial Sequence
  Marburg virus siRNA sense strand
uccgugacuauccuaaaugca

SEQ ID NO: 26299 - RNA, 21 nt, Artificial Sequence
  Marburg virus siRNA sense strand
ccgugacuauccuaaaugcaa

SEQ ID NO: 26300 - RNA, 21 nt, Artificial Sequence
  Marburg virus siRNA sense strand
cgugacuauccuaaaugcaaa

SEQ ID NO: 26301 - RNA, 21 nt, Artificial Sequence
  Marburg virus siRNA sense strand
gugacuauccuaaaugcaaaa

SEQ ID NO: 26302 - RNA, 21 nt, Artificial Sequence
  Marburg virus siRNA sense strand
ugacuauccuaaaugcaaaac

SEQ ID NO: 26303 - RNA, 21 nt, Artificial Sequence
  Marburg virus siRNA sense strand
gacuauccuaaaugcaaaacu

SEQ ID NO: 26304 - RNA, 21 nt, Artificial Sequence
  Marburg virus siRNA sense strand
acuauccuaaaugcaaaacua

SEQ ID NO: 26305 - RNA, 21 nt, Artificial Sequence
  Marburg virus siRNA sense strand
cuauccuaaaugcaaaacuau

SEQ ID NO: 26306 - RNA, 21 nt, Artificial Sequence
  Marburg virus siRNA sense strand
uauccuaaaugcaaaacuauc

SEQ ID NO: 26307 - RNA, 21 nt, Artificial Sequence
  Marburg virus siRNA sense strand
auccuaaaugcaaaacuaucc

SEQ ID NO: 26308 - RNA, 21 nt, Artificial Sequence
  Marburg virus siRNA sense strand
uccuaaaugcaaaacuaucca

SEQ ID NO: 26309 - RNA, 21 nt, Artificial Sequence
  Marburg virus siRNA sense strand
ccuaaaugcaaaacuauccau

SEQ ID NO: 26310 - RNA, 21 nt, Artificial Sequence
  Marburg virus siRNA sense strand
cuaaaugcaaaacuauccauc

SEQ ID NO: 26311 - RNA, 21 nt, Artificial Sequence
  Marburg virus siRNA sense strand
uaaaugcaaaacuauccauca

SEQ ID NO: 26312 - RNA, 21 nt, Artificial Sequence
  Marburg virus siRNA sense strand
aaaugcaaaacuauccaucau

SEQ ID NO: 26313 - RNA, 21 nt, Artificial Sequence
  Marburg virus siRNA sense strand
aaugcaaaacuauccaucaua

SEQ ID NO: 26314 - RNA, 21 nt, Artificial Sequence
  Marburg virus siRNA sense strand
augcaaaacuauccaucauau

SEQ ID NO: 26315 - RNA, 21 nt, Artificial Sequence
  Marburg virus siRNA sense strand
ugcaaaacuauccaucauauu

SEQ ID NO: 26316 - RNA, 21 nt, Artificial Sequence
  Marburg virus siRNA sense strand
gcaaaacuauccaucauauuc

SEQ ID NO: 26317 - RNA, 21 nt, Artificial Sequence
  Marburg virus siRNA sense strand
caaaacuauccaucauauuca

SEQ ID NO: 26318 - RNA, 21 nt, Artificial Sequence
  Marburg virus siRNA sense strand
aaaacuauccaucauauucaa

SEQ ID NO: 26319 - RNA, 21 nt, Artificial Sequence
  Marburg virus siRNA sense strand
aaacuauccaucauauucaag

SEQ ID NO: 26320 - RNA, 21 nt, Artificial Sequence
  Marburg virus siRNA sense strand
aacuauccaucauauucaagg

SEQ ID NO: 26321 - RNA, 21 nt, Artificial Sequence
  Marburg virus siRNA sense strand
acuauccaucauauucaaggu

SEQ ID NO: 26322 - RNA, 21 nt, Artificial Sequence
  Marburg virus siRNA sense strand
cuauccaucauauucaagguc

SEQ ID NO: 26323 - RNA, 21 nt, Artificial Sequence
  Marburg virus siRNA sense strand
uauccaucauauucaagguca

SEQ ID NO: 26324 - RNA, 21 nt, Artificial Sequence
  Marburg virus siRNA sense strand
auccaucauauucaaggucaa

SEQ ID NO: 26325 - RNA, 21 nt, Artificial Sequence
  Marburg virus siRNA sense strand
uccaucauauucaaggucaaa

SEQ ID NO: 26326 - RNA, 21 nt, Artificial Sequence
  Marburg virus siRNA sense strand
ccaucauauucaaggucaaaa

SEQ ID NO: 26327 - RNA, 21 nt, Artificial Sequence
  Marburg virus siRNA sense strand
caucauauucaaggucaaaac

SEQ ID NO: 26328 - RNA, 21 nt, Artificial Sequence
  Marburg virus siRNA sense strand
aucauauucaaggucaaaacc

SEQ ID NO: 26329 - RNA, 21 nt, Artificial Sequence
  Marburg virus siRNA sense strand
ucauauucaaggucaaaaccc

SEQ ID NO: 26330 - RNA, 21 nt, Artificial Sequence
  Marburg virus siRNA sense strand
cauauucaaggucaaaacccu

SEQ ID NO: 26331 - RNA, 21 nt, Artificial Sequence
  Marburg virus siRNA sense strand
auauucaaggucaaaacccuc

SEQ ID NO: 26332 - RNA, 21 nt, Artificial Sequence
  Marburg virus siRNA sense strand
uauucaaggucaaaacccuca

SEQ ID NO: 26333 - RNA, 21 nt, Artificial Sequence
  Marburg virus siRNA sense strand
auucaaggucaaaacccucau

SEQ ID NO: 26334 - RNA, 21 nt, Artificial Sequence
  Marburg virus siRNA sense strand
uucaaggucaaaacccucaug

SEQ ID NO: 26335 - RNA, 21 nt, Artificial Sequence
  Marburg virus siRNA sense strand
ucaaggucaaaacccucaugc

SEQ ID NO: 26336 - RNA, 21 nt, Artificial Sequence
  Marburg virus siRNA sense strand
caaggucaaaacccucaugcg

SEQ ID NO: 26337 - RNA, 21 nt, Artificial Sequence
  Marburg virus siRNA sense strand
aaggucaaaacccucaugcgc

SEQ ID NO: 26338 - RNA, 21 nt, Artificial Sequence
  Marburg virus siRNA sense strand
aggucaaaacccucaugcgca

SEQ ID NO: 26339 - RNA, 21 nt, Artificial Sequence
  Marburg virus siRNA sense strand
ggucaaaacccucaugcgcaa

SEQ ID NO: 26340 - RNA, 21 nt, Artificial Sequence
  Marburg virus siRNA sense strand
gucaaaacccucaugcgcaag

SEQ ID NO: 26341 - RNA, 21 nt, Artificial Sequence
  Marburg virus siRNA sense strand
ucaaaacccucaugcgcaagg

SEQ ID NO: 26342 - RNA, 21 nt, Artificial Sequence
  Marburg virus siRNA sense strand
caaaacccucaugcgcaaggg

SEQ ID NO: 26343 - RNA, 21 nt, Artificial Sequence
  Marburg virus siRNA sense strand
aaaacccucaugcgcaaggga

SEQ ID NO: 26344 - RNA, 21 nt, Artificial Sequence
  Marburg virus siRNA sense strand
aaacccucaugcgcaagggau

SEQ ID NO: 26345 - RNA, 21 nt, Artificial Sequence
  Marburg virus siRNA sense strand
aacccucaugcgcaagggauc

SEQ ID NO: 26346 - RNA, 21 nt, Artificial Sequence
  Marburg virus siRNA sense strand
acccucaugcgcaagggaucg

SEQ ID NO: 26347 - RNA, 21 nt, Artificial Sequence
  Marburg virus siRNA sense strand
cccucaugcgcaagggaucgc

SEQ ID NO: 26348 - RNA, 21 nt, Artificial Sequence
  Marburg virus siRNA sense strand
ccucaugcgcaagggaucgcc

SEQ ID NO: 26349 - RNA, 21 nt, Artificial Sequence
  Marburg virus siRNA sense strand
cucaugcgcaagggaucgccc

SEQ ID NO: 26350 - RNA, 21 nt, Artificial Sequence
  Marburg virus siRNA sense strand
ucaugcgcaagggaucgcccu

SEQ ID NO: 26351 - RNA, 21 nt, Artificial Sequence
  Marburg virus siRNA sense strand
caugcgcaagggaucgcccuc

SEQ ID NO: 26352 - RNA, 21 nt, Artificial Sequence
  Marburg virus siRNA sense strand
augcgcaagggaucgcccucc

SEQ ID NO: 26353 - RNA, 21 nt, Artificial Sequence
  Marburg virus siRNA sense strand
ugcgcaagggaucgcccucca

SEQ ID NO: 26354 - RNA, 21 nt, Artificial Sequence
  Marburg virus siRNA sense strand
gcgcaagggaucgcccuccau

SEQ ID NO: 26355 - RNA, 21 nt, Artificial Sequence
  Marburg virus siRNA sense strand
cgcaagggaucgcccuccauu

SEQ ID NO: 26356 - RNA, 21 nt, Artificial Sequence
  Marburg virus siRNA sense strand
gcaagggaucgcccuccauuu

SEQ ID NO: 26357 - RNA, 21 nt, Artificial Sequence
  Marburg virus siRNA sense strand
caagggaucgcccuccauuug

SEQ ID NO: 26358 - RNA, 21 nt, Artificial Sequence
  Marburg virus siRNA sense strand
aagggaucgcccuccauuugu

SEQ ID NO: 26359 - RNA, 21 nt, Artificial Sequence
  Marburg virus siRNA sense strand
agggaucgcccuccauuugug

SEQ ID NO: 26360 - RNA, 21 nt, Artificial Sequence
  Marburg virus siRNA sense strand
gggaucgcccuccauuugugg

SEQ ID NO: 26361 - RNA, 21 nt, Artificial Sequence
  Marburg virus siRNA sense strand
ggaucgcccuccauuuguggg

SEQ ID NO: 26362 - RNA, 21 nt, Artificial Sequence
  Marburg virus siRNA sense strand
gaucgcccuccauuugugggg

SEQ ID NO: 26363 - RNA, 21 nt, Artificial Sequence
  Marburg virus siRNA sense strand
aucgcccuccauuugugggga

SEQ ID NO: 26364 - RNA, 21 nt, Artificial Sequence
  Marburg virus siRNA sense strand
ucgcccuccauuuguggggag

SEQ ID NO: 26365 - RNA, 21 nt, Artificial Sequence
  Marburg virus siRNA sense strand
cgcccuccauuuguggggagc

SEQ ID NO: 26366 - RNA, 21 nt, Artificial Sequence
  Marburg virus siRNA sense strand
gcccuccauuuguggggagca

SEQ ID NO: 26367 - RNA, 21 nt, Artificial Sequence
  Marburg virus siRNA sense strand
cccuccauuuguggggagcau

SEQ ID NO: 26368 - RNA, 21 nt, Artificial Sequence
  Marburg virus siRNA sense strand
ccuccauuuguggggagcauu

SEQ ID NO: 26369 - RNA, 21 nt, Artificial Sequence
  Marburg virus siRNA sense strand
cuccauuuguggggagcauuu

SEQ ID NO: 26370 - RNA, 21 nt, Artificial Sequence
  Marburg virus siRNA sense strand
uccauuuguggggagcauuuu

SEQ ID NO: 26371 - RNA, 21 nt, Artificial Sequence
  Marburg virus siRNA sense strand
ccauuuguggggagcauuuuu

SEQ ID NO: 26372 - RNA, 21 nt, Artificial Sequence
  Marburg virus siRNA sense strand
cauuuguggggagcauuuuuc

SEQ ID NO: 26373 - RNA, 21 nt, Artificial Sequence
  Marburg virus siRNA sense strand
auuuguggggagcauuuuucc

SEQ ID NO: 26374 - RNA, 21 nt, Artificial Sequence
  Marburg virus siRNA sense strand
uuuguggggagcauuuuuccu

SEQ ID NO: 26375 - RNA, 21 nt, Artificial Sequence
  Marburg virus siRNA sense strand
uuguggggagcauuuuuccug

SEQ ID NO: 26376 - RNA, 21 nt, Artificial Sequence
  Marburg virus siRNA sense strand
uguggggagcauuuuuccugu

SEQ ID NO: 26377 - RNA, 21 nt, Artificial Sequence
  Marburg virus siRNA sense strand
guggggagcauuuuuccugua

SEQ ID NO: 26378 - RNA, 21 nt, Artificial Sequence
  Marburg virus siRNA sense strand
uggggagcauuuuuccuguau

SEQ ID NO: 26379 - RNA, 21 nt, Artificial Sequence
  Marburg virus siRNA sense strand
ggggagcauuuuuccuguaug

SEQ ID NO: 26380 - RNA, 21 nt, Artificial Sequence
  Marburg virus siRNA sense strand
gggagcauuuuuccuguauga

SEQ ID NO: 26381 - RNA, 21 nt, Artificial Sequence
  Marburg virus siRNA sense strand
ggagcauuuuuccuguaugau

SEQ ID NO: 26382 - RNA, 21 nt, Artificial Sequence
  Marburg virus siRNA sense strand
gagcauuuuuccuguaugauc

SEQ ID NO: 26383 - RNA, 21 nt, Artificial Sequence
  Marburg virus siRNA sense strand
agcauuuuuccuguaugaucg

SEQ ID NO: 26384 - RNA, 21 nt, Artificial Sequence
  Marburg virus siRNA sense strand
gcauuuuuccuguaugaucgc

SEQ ID NO: 26385 - RNA, 21 nt, Artificial Sequence
  Marburg virus siRNA sense strand
cauuuuuccuguaugaucgca

SEQ ID NO: 26386 - RNA, 21 nt, Artificial Sequence
  Marburg virus siRNA sense strand
auuuuuccuguaugaucgcau

SEQ ID NO: 26387 - RNA, 21 nt, Artificial Sequence
  Marburg virus siRNA sense strand
uuuuuccuguaugaucgcauu

SEQ ID NO: 26388 - RNA, 21 nt, Artificial Sequence
  Marburg virus siRNA sense strand
uuuuccuguaugaucgcauug

SEQ ID NO: 26389 - RNA, 21 nt, Artificial Sequence
  Marburg virus siRNA sense strand
uuuccuguaugaucgcauugc

SEQ ID NO: 26390 - RNA, 21 nt, Artificial Sequence
  Marburg virus siRNA sense strand
uuccuguaugaucgcauugcc

SEQ ID NO: 26391 - RNA, 21 nt, Artificial Sequence
  Marburg virus siRNA sense strand
uccuguaugaucgcauugccu

SEQ ID NO: 26392 - RNA, 21 nt, Artificial Sequence
  Marburg virus siRNA sense strand
ccuguaugaucgcauugccuc

SEQ ID NO: 26393 - RNA, 21 nt, Artificial Sequence
  Marburg virus siRNA sense strand
cuguaugaucgcauugccucc

SEQ ID NO: 26394 - RNA, 21 nt, Artificial Sequence
  Marburg virus siRNA sense strand
uguaugaucgcauugccucca

SEQ ID NO: 26395 - RNA, 21 nt, Artificial Sequence
  Marburg virus siRNA sense strand
guaugaucgcauugccuccac

SEQ ID NO: 26396 - RNA, 21 nt, Artificial Sequence
  Marburg virus siRNA sense strand
uaugaucgcauugccuccaca

SEQ ID NO: 26397 - RNA, 21 nt, Artificial Sequence
  Marburg virus siRNA sense strand
augaucgcauugccuccacaa

SEQ ID NO: 26398 - RNA, 21 nt, Artificial Sequence
  Marburg virus siRNA sense strand
ugaucgcauugccuccacaac

SEQ ID NO: 26399 - RNA, 21 nt, Artificial Sequence
  Marburg virus siRNA sense strand
gaucgcauugccuccacaaca

SEQ ID NO: 26400 - RNA, 21 nt, Artificial Sequence
  Marburg virus siRNA sense strand
aucgcauugccuccacaacaa

SEQ ID NO: 26401 - RNA, 21 nt, Artificial Sequence
  Marburg virus siRNA sense strand
ucgcauugccuccacaacaau

SEQ ID NO: 26402 - RNA, 21 nt, Artificial Sequence
  Marburg virus siRNA sense strand
cgcauugccuccacaacaaug

SEQ ID NO: 26403 - RNA, 21 nt, Artificial Sequence
  Marburg virus siRNA sense strand
gcauugccuccacaacaaugu

SEQ ID NO: 26404 - RNA, 21 nt, Artificial Sequence
  Marburg virus siRNA sense strand
cauugccuccacaacaaugua

SEQ ID NO: 26405 - RNA, 21 nt, Artificial Sequence
  Marburg virus siRNA sense strand
auugccuccacaacaauguac

SEQ ID NO: 26406 - RNA, 21 nt, Artificial Sequence
  Marburg virus siRNA sense strand
uugccuccacaacaauguacc

SEQ ID NO: 26407 - RNA, 21 nt, Artificial Sequence
  Marburg virus siRNA sense strand
ugccuccacaacaauguaccg

SEQ ID NO: 26408 - RNA, 21 nt, Artificial Sequence
  Marburg virus siRNA sense strand
gccuccacaacaauguaccga

SEQ ID NO: 26409 - RNA, 21 nt, Artificial Sequence
  Marburg virus siRNA sense strand
ccuccacaacaauguaccgag

SEQ ID NO: 26410 - RNA, 21 nt, Artificial Sequence
  Marburg virus siRNA sense strand
cuccacaacaauguaccgagg

SEQ ID NO: 26411 - RNA, 21 nt, Artificial Sequence
  Marburg virus siRNA sense strand
uccacaacaauguaccgaggc

SEQ ID NO: 26412 - RNA, 21 nt, Artificial Sequence
  Marburg virus siRNA sense strand
ccacaacaauguaccgaggca

SEQ ID NO: 26413 - RNA, 21 nt, Artificial Sequence
  Marburg virus siRNA sense strand
cacaacaauguaccgaggcag

SEQ ID NO: 26414 - RNA, 21 nt, Artificial Sequence
  Marburg virus siRNA sense strand
acaacaauguaccgaggcaga

SEQ ID NO: 26415 - RNA, 21 nt, Artificial Sequence
  Marburg virus siRNA sense strand
caacaauguaccgaggcagag

SEQ ID NO: 26416 - RNA, 21 nt, Artificial Sequence
  Marburg virus siRNA sense strand
aacaauguaccgaggcagagu

SEQ ID NO: 26417 - RNA, 21 nt, Artificial Sequence
  Marburg virus siRNA sense strand
acaauguaccgaggcagaguc

SEQ ID NO: 26418 - RNA, 21 nt, Artificial Sequence
  Marburg virus siRNA sense strand
caauguaccgaggcagagucu

SEQ ID NO: 26419 - RNA, 21 nt, Artificial Sequence
  Marburg virus siRNA sense strand
aauguaccgaggcagagucuu

SEQ ID NO: 26420 - RNA, 21 nt, Artificial Sequence
  Marburg virus siRNA sense strand
auguaccgaggcagagucuuc

SEQ ID NO: 26421 - RNA, 21 nt, Artificial Sequence
  Marburg virus siRNA sense strand
uguaccgaggcagagucuuca

SEQ ID NO: 26422 - RNA, 21 nt, Artificial Sequence
  Marburg virus siRNA sense strand
guaccgaggcagagucuucac

SEQ ID NO: 26423 - RNA, 21 nt, Artificial Sequence
  Marburg virus siRNA sense strand
uaccgaggcagagucuucacu

SEQ ID NO: 26424 - RNA, 21 nt, Artificial Sequence
  Marburg virus siRNA sense strand
accgaggcagagucuucacug

SEQ ID NO: 26425 - RNA, 21 nt, Artificial Sequence
  Marburg virus siRNA sense strand
ccgaggcagagucuucacuga

SEQ ID NO: 26426 - RNA, 21 nt, Artificial Sequence
  Marburg virus siRNA sense strand
cgaggcagagucuucacugaa

SEQ ID NO: 26427 - RNA, 21 nt, Artificial Sequence
  Marburg virus siRNA sense strand
gaggcagagucuucacugaag

SEQ ID NO: 26428 - RNA, 21 nt, Artificial Sequence
  Marburg virus siRNA sense strand
aggcagagucuucacugaagg

SEQ ID NO: 26429 - RNA, 21 nt, Artificial Sequence
  Marburg virus siRNA sense strand
ggcagagucuucacugaaggg

SEQ ID NO: 26430 - RNA, 21 nt, Artificial Sequence
  Marburg virus siRNA sense strand
gcagagucuucacugaaggga

SEQ ID NO: 26431 - RNA, 21 nt, Artificial Sequence
  Marburg virus siRNA sense strand
cagagucuucacugaagggaa

SEQ ID NO: 26432 - RNA, 21 nt, Artificial Sequence
  Marburg virus siRNA sense strand
agagucuucacugaagggaac

SEQ ID NO: 26433 - RNA, 21 nt, Artificial Sequence
  Marburg virus siRNA sense strand
gagucuucacugaagggaaca

SEQ ID NO: 26434 - RNA, 21 nt, Artificial Sequence
  Marburg virus siRNA sense strand
agucuucacugaagggaacau

SEQ ID NO: 26435 - RNA, 21 nt, Artificial Sequence
  Marburg virus siRNA sense strand
gucuucacugaagggaacaua

SEQ ID NO: 26436 - RNA, 21 nt, Artificial Sequence
  Marburg virus siRNA sense strand
ucuucacugaagggaacauag

SEQ ID NO: 26437 - RNA, 21 nt, Artificial Sequence
  Marburg virus siRNA sense strand
cuucacugaagggaacauagc

SEQ ID NO: 26438 - RNA, 21 nt, Artificial Sequence
  Marburg virus siRNA sense strand
uucacugaagggaacauagca

SEQ ID NO: 26439 - RNA, 21 nt, Artificial Sequence
  Marburg virus siRNA sense strand
ucacugaagggaacauagcag

SEQ ID NO: 26440 - RNA, 21 nt, Artificial Sequence
  Marburg virus siRNA sense strand
cacugaagggaacauagcagc

SEQ ID NO: 26441 - RNA, 21 nt, Artificial Sequence
  Marburg virus siRNA sense strand
acugaagggaacauagcagcu

SEQ ID NO: 26442 - RNA, 21 nt, Artificial Sequence
  Marburg virus siRNA sense strand
cugaagggaacauagcagcua

SEQ ID NO: 26443 - RNA, 21 nt, Artificial Sequence
  Marburg virus siRNA sense strand
ugaagggaacauagcagcuau

SEQ ID NO: 26444 - RNA, 21 nt, Artificial Sequence
  Marburg virus siRNA sense strand
gaagggaacauagcagcuaug

SEQ ID NO: 26445 - RNA, 21 nt, Artificial Sequence
  Marburg virus siRNA sense strand
aagggaacauagcagcuauga

SEQ ID NO: 26446 - RNA, 21 nt, Artificial Sequence
  Marburg virus siRNA sense strand
agggaacauagcagcuaugau

SEQ ID NO: 26447 - RNA, 21 nt, Artificial Sequence
  Marburg virus siRNA sense strand
gggaacauagcagcuaugauu

SEQ ID NO: 26448 - RNA, 21 nt, Artificial Sequence
  Marburg virus siRNA sense strand
ggaacauagcagcuaugauug

SEQ ID NO: 26449 - RNA, 21 nt, Artificial Sequence
  Marburg virus siRNA sense strand
gaacauagcagcuaugauugu

SEQ ID NO: 26450 - RNA, 21 nt, Artificial Sequence
  Marburg virus siRNA sense strand
aacauagcagcuaugauuguc

SEQ ID NO: 26451 - RNA, 21 nt, Artificial Sequence
  Marburg virus siRNA sense strand
acauagcagcuaugauuguca

SEQ ID NO: 26452 - RNA, 21 nt, Artificial Sequence
  Marburg virus siRNA sense strand
cauagcagcuaugauugucaa

SEQ ID NO: 26453 - RNA, 21 nt, Artificial Sequence
  Marburg virus siRNA sense strand
auagcagcuaugauugucaau

SEQ ID NO: 26454 - RNA, 21 nt, Artificial Sequence
  Marburg virus siRNA sense strand
uagcagcuaugauugucaaua

SEQ ID NO: 26455 - RNA, 21 nt, Artificial Sequence
  Marburg virus siRNA sense strand
agcagcuaugauugucaauaa

SEQ ID NO: 26456 - RNA, 21 nt, Artificial Sequence
  Marburg virus siRNA sense strand
gcagcuaugauugucaauaag

SEQ ID NO: 26457 - RNA, 21 nt, Artificial Sequence
  Marburg virus siRNA sense strand
cagcuaugauugucaauaaga

SEQ ID NO: 26458 - RNA, 21 nt, Artificial Sequence
  Marburg virus siRNA sense strand
agcuaugauugucaauaagac

SEQ ID NO: 26459 - RNA, 21 nt, Artificial Sequence
  Marburg virus siRNA sense strand
gcuaugauugucaauaagaca

SEQ ID NO: 26460 - RNA, 21 nt, Artificial Sequence
  Marburg virus siRNA sense strand
cuaugauugucaauaagacag

SEQ ID NO: 26461 - RNA, 21 nt, Artificial Sequence
  Marburg virus siRNA sense strand
uaugauugucaauaagacagu

SEQ ID NO: 26462 - RNA, 21 nt, Artificial Sequence
  Marburg virus siRNA sense strand
augauugucaauaagacagug

SEQ ID NO: 26463 - RNA, 21 nt, Artificial Sequence
  Marburg virus siRNA sense strand
ugauugucaauaagacagugc

SEQ ID NO: 26464 - RNA, 21 nt, Artificial Sequence
  Marburg virus siRNA sense strand
gauugucaauaagacagugca

SEQ ID NO: 26465 - RNA, 21 nt, Artificial Sequence
  Marburg virus siRNA sense strand
auugucaauaagacagugcac

SEQ ID NO: 26466 - RNA, 21 nt, Artificial Sequence
  Marburg virus siRNA sense strand
uugucaauaagacagugcaca

SEQ ID NO: 26467 - RNA, 21 nt, Artificial Sequence
  Marburg virus siRNA sense strand
ugucaauaagacagugcacaa

SEQ ID NO: 26468 - RNA, 21 nt, Artificial Sequence
  Marburg virus siRNA sense strand
gucaauaagacagugcacaaa

SEQ ID NO: 26469 - RNA, 21 nt, Artificial Sequence
  Marburg virus siRNA sense strand
ucaauaagacagugcacaaaa

SEQ ID NO: 26470 - RNA, 21 nt, Artificial Sequence
  Marburg virus siRNA sense strand
caauaagacagugcacaaaau

SEQ ID NO: 26471 - RNA, 21 nt, Artificial Sequence
  Marburg virus siRNA sense strand
aauaagacagugcacaaaaug

SEQ ID NO: 26472 - RNA, 21 nt, Artificial Sequence
  Marburg virus siRNA sense strand
auaagacagugcacaaaauga

SEQ ID NO: 26473 - RNA, 21 nt, Artificial Sequence
  Marburg virus siRNA sense strand
uaagacagugcacaaaaugau

SEQ ID NO: 26474 - RNA, 21 nt, Artificial Sequence
  Marburg virus siRNA sense strand
aagacagugcacaaaaugauu

SEQ ID NO: 26475 - RNA, 21 nt, Artificial Sequence
  Marburg virus siRNA sense strand
agacagugcacaaaaugauuu

SEQ ID NO: 26476 - RNA, 21 nt, Artificial Sequence
  Marburg virus siRNA sense strand
gacagugcacaaaaugauuuu

SEQ ID NO: 26477 - RNA, 21 nt, Artificial Sequence
  Marburg virus siRNA sense strand
acagugcacaaaaugauuuuc

SEQ ID NO: 26478 - RNA, 21 nt, Artificial Sequence
  Marburg virus siRNA sense strand
cagugcacaaaaugauuuucu

SEQ ID NO: 26479 - RNA, 21 nt, Artificial Sequence
  Marburg virus siRNA sense strand
agugcacaaaaugauuuucuc

SEQ ID NO: 26480 - RNA, 21 nt, Artificial Sequence
  Marburg virus siRNA sense strand
gugcacaaaaugauuuucucg

SEQ ID NO: 26481 - RNA, 21 nt, Artificial Sequence
  Marburg virus siRNA sense strand
ugcacaaaaugauuuucucga

SEQ ID NO: 26482 - RNA, 21 nt, Artificial Sequence
  Marburg virus siRNA sense strand
gcacaaaaugauuuucucgag

SEQ ID NO: 26483 - RNA, 21 nt, Artificial Sequence
  Marburg virus siRNA sense strand
cacaaaaugauuuucucgagg

SEQ ID NO: 26484 - RNA, 21 nt, Artificial Sequence
  Marburg virus siRNA sense strand
acaaaaugauuuucucgaggc

SEQ ID NO: 26485 - RNA, 21 nt, Artificial Sequence
  Marburg virus siRNA sense strand
caaaaugauuuucucgaggca

SEQ ID NO: 26486 - RNA, 21 nt, Artificial Sequence
  Marburg virus siRNA sense strand
aaaaugauuuucucgaggcaa

SEQ ID NO: 26487 - RNA, 21 nt, Artificial Sequence
  Marburg virus siRNA sense strand
aaaugauuuucucgaggcaag

SEQ ID NO: 26488 - RNA, 21 nt, Artificial Sequence
  Marburg virus siRNA sense strand
aaugauuuucucgaggcaagg

SEQ ID NO: 26489 - RNA, 21 nt, Artificial Sequence
  Marburg virus siRNA sense strand
augauuuucucgaggcaagga

SEQ ID NO: 26490 - RNA, 21 nt, Artificial Sequence
  Marburg virus siRNA sense strand
ugauuuucucgaggcaaggac

SEQ ID NO: 26491 - RNA, 21 nt, Artificial Sequence
  Marburg virus siRNA sense strand
gauuuucucgaggcaaggaca

SEQ ID NO: 26492 - RNA, 21 nt, Artificial Sequence
  Marburg virus siRNA sense strand
auuuucucgaggcaaggacag

SEQ ID NO: 26493 - RNA, 21 nt, Artificial Sequence
  Marburg virus siRNA sense strand
uuuucucgaggcaaggacagg

SEQ ID NO: 26494 - RNA, 21 nt, Artificial Sequence
  Marburg virus siRNA sense strand
uuucucgaggcaaggacaggg

SEQ ID NO: 26495 - RNA, 21 nt, Artificial Sequence
  Marburg virus siRNA sense strand
uucucgaggcaaggacagggg

SEQ ID NO: 26496 - RNA, 21 nt, Artificial Sequence
  Marburg virus siRNA sense strand
ucucgaggcaaggacaggggu

SEQ ID NO: 26497 - RNA, 21 nt, Artificial Sequence
  Marburg virus siRNA sense strand
cucgaggcaaggacaggggua

SEQ ID NO: 26498 - RNA, 21 nt, Artificial Sequence
  Marburg virus siRNA sense strand
ucgaggcaaggacagggguac

SEQ ID NO: 26499 - RNA, 21 nt, Artificial Sequence
  Marburg virus siRNA sense strand
cgaggcaaggacagggguacc

SEQ ID NO: 26500 - RNA, 21 nt, Artificial Sequence
  Marburg virus siRNA sense strand
gaggcaaggacagggguaccg

SEQ ID NO: 26501 - RNA, 21 nt, Artificial Sequence
  Marburg virus siRNA sense strand
aggcaaggacagggguaccgu

SEQ ID NO: 26502 - RNA, 21 nt, Artificial Sequence
  Marburg virus siRNA sense strand
ggcaaggacagggguaccguc

SEQ ID NO: 26503 - RNA, 21 nt, Artificial Sequence
  Marburg virus siRNA sense strand
gcaaggacagggguaccguca

SEQ ID NO: 26504 - RNA, 21 nt, Artificial Sequence
  Marburg virus siRNA sense strand
caaggacagggguaccgucac

SEQ ID NO: 26505 - RNA, 21 nt, Artificial Sequence
  Marburg virus siRNA sense strand
aaggacagggguaccgucaca

SEQ ID NO: 26506 - RNA, 21 nt, Artificial Sequence
  Marburg virus siRNA sense strand
aggacagggguaccgucacau

SEQ ID NO: 26507 - RNA, 21 nt, Artificial Sequence
  Marburg virus siRNA sense strand
ggacagggguaccgucacaug

SEQ ID NO: 26508 - RNA, 21 nt, Artificial Sequence
  Marburg virus siRNA sense strand
gacagggguaccgucacauga

SEQ ID NO: 26509 - RNA, 21 nt, Artificial Sequence
  Marburg virus siRNA sense strand
acagggguaccgucacaugaa

SEQ ID NO: 26510 - RNA, 21 nt, Artificial Sequence
  Marburg virus siRNA sense strand
cagggguaccgucacaugaau

SEQ ID NO: 26511 - RNA, 21 nt, Artificial Sequence
  Marburg virus siRNA sense strand
agggguaccgucacaugaauc

SEQ ID NO: 26512 - RNA, 21 nt, Artificial Sequence
  Marburg virus siRNA sense strand
gggguaccgucacaugaaucu

SEQ ID NO: 26513 - RNA, 21 nt, Artificial Sequence
  Marburg virus siRNA sense strand
ggguaccgucacaugaaucug

SEQ ID NO: 26514 - RNA, 21 nt, Artificial Sequence
  Marburg virus siRNA sense strand
gguaccgucacaugaaucuga

SEQ ID NO: 26515 - RNA, 21 nt, Artificial Sequence
  Marburg virus siRNA sense strand
guaccgucacaugaaucugac

SEQ ID NO: 26516 - RNA, 21 nt, Artificial Sequence
  Marburg virus siRNA sense strand
uaccgucacaugaaucugacu

SEQ ID NO: 26517 - RNA, 21 nt, Artificial Sequence
  Marburg virus siRNA sense strand
accgucacaugaaucugacuu

SEQ ID NO: 26518 - RNA, 21 nt, Artificial Sequence
  Marburg virus siRNA sense strand
ccgucacaugaaucugacuuc

SEQ ID NO: 26519 - RNA, 21 nt, Artificial Sequence
  Marburg virus siRNA sense strand
cgucacaugaaucugacuucu

SEQ ID NO: 26520 - RNA, 21 nt, Artificial Sequence
  Marburg virus siRNA sense strand
gucacaugaaucugacuucua

SEQ ID NO: 26521 - RNA, 21 nt, Artificial Sequence
  Marburg virus siRNA sense strand
ucacaugaaucugacuucuac

SEQ ID NO: 26522 - RNA, 21 nt, Artificial Sequence
  Marburg virus siRNA sense strand
cacaugaaucugacuucuacu

SEQ ID NO: 26523 - RNA, 21 nt, Artificial Sequence
  Marburg virus siRNA sense strand
acaugaaucugacuucuacua

SEQ ID NO: 26524 - RNA, 21 nt, Artificial Sequence
  Marburg virus siRNA sense strand
caugaaucugacuucuacuaa

SEQ ID NO: 26525 - RNA, 21 nt, Artificial Sequence
  Marburg virus siRNA sense strand
augaaucugacuucuacuaau

SEQ ID NO: 26526 - RNA, 21 nt, Artificial Sequence
  Marburg virus siRNA sense strand
ugaaucugacuucuacuaaua

SEQ ID NO: 26527 - RNA, 21 nt, Artificial Sequence
  Marburg virus siRNA sense strand
gaaucugacuucuacuaauaa

SEQ ID NO: 26528 - RNA, 21 nt, Artificial Sequence
  Marburg virus siRNA sense strand
aaucugacuucuacuaauaaa

SEQ ID NO: 26529 - RNA, 21 nt, Artificial Sequence
  Marburg virus siRNA sense strand
aucugacuucuacuaauaaau

SEQ ID NO: 26530 - RNA, 21 nt, Artificial Sequence
  Marburg virus siRNA sense strand
ucugacuucuacuaauaaaua

SEQ ID NO: 26531 - RNA, 21 nt, Artificial Sequence
  Marburg virus siRNA sense strand
cugacuucuacuaauaaauau

SEQ ID NO: 26532 - RNA, 21 nt, Artificial Sequence
  Marburg virus siRNA sense strand
ugacuucuacuaauaaauauu

SEQ ID NO: 26533 - RNA, 21 nt, Artificial Sequence
  Marburg virus siRNA sense strand
gacuucuacuaauaaauauug

SEQ ID NO: 26534 - RNA, 21 nt, Artificial Sequence
  Marburg virus siRNA sense strand
acuucuacuaauaaauauugg

SEQ ID NO: 26535 - RNA, 21 nt, Artificial Sequence
  Marburg virus siRNA sense strand
cuucuacuaauaaauauugga

SEQ ID NO: 26536 - RNA, 21 nt, Artificial Sequence
  Marburg virus siRNA sense strand
uucuacuaauaaauauuggac

SEQ ID NO: 26537 - RNA, 21 nt, Artificial Sequence
  Marburg virus siRNA sense strand
ucuacuaauaaauauuggaca

SEQ ID NO: 26538 - RNA, 21 nt, Artificial Sequence
  Marburg virus siRNA sense strand
cuacuaauaaauauuggacaa

SEQ ID NO: 26539 - RNA, 21 nt, Artificial Sequence
  Marburg virus siRNA sense strand
uacuaauaaauauuggacaag

SEQ ID NO: 26540 - RNA, 21 nt, Artificial Sequence
  Marburg virus siRNA sense strand
acuaauaaauauuggacaagu

SEQ ID NO: 26541 - RNA, 21 nt, Artificial Sequence
  Marburg virus siRNA sense strand
cuaauaaauauuggacaagua

SEQ ID NO: 26542 - RNA, 21 nt, Artificial Sequence
  Marburg virus siRNA sense strand
uaauaaauauuggacaaguaa

SEQ ID NO: 26543 - RNA, 21 nt, Artificial Sequence
  Marburg virus siRNA sense strand
aauaaauauuggacaaguaac

SEQ ID NO: 26544 - RNA, 21 nt, Artificial Sequence
  Marburg virus siRNA sense strand
auaaauauuggacaaguaaca

SEQ ID NO: 26545 - RNA, 21 nt, Artificial Sequence
  Marburg virus siRNA sense strand
uaaauauuggacaaguaacaa

SEQ ID NO: 26546 - RNA, 21 nt, Artificial Sequence
  Marburg virus siRNA sense strand
aaauauuggacaaguaacaau

SEQ ID NO: 26547 - RNA, 21 nt, Artificial Sequence
  Marburg virus siRNA sense strand
aauauuggacaaguaacaaug

SEQ ID NO: 26548 - RNA, 21 nt, Artificial Sequence
  Marburg virus siRNA sense strand
auauuggacaaguaacaaugg

SEQ ID NO: 26549 - RNA, 21 nt, Artificial Sequence
  Marburg virus siRNA sense strand
uauuggacaaguaacaaugga

SEQ ID NO: 26550 - RNA, 21 nt, Artificial Sequence
  Marburg virus siRNA sense strand
auuggacaaguaacaauggaa

SEQ ID NO: 26551 - RNA, 21 nt, Artificial Sequence
  Marburg virus siRNA sense strand
uuggacaaguaacaauggaac

SEQ ID NO: 26552 - RNA, 21 nt, Artificial Sequence
  Marburg virus siRNA sense strand
uggacaaguaacaauggaaca

SEQ ID NO: 26553 - RNA, 21 nt, Artificial Sequence
  Marburg virus siRNA sense strand
ggacaaguaacaauggaacac

SEQ ID NO: 26554 - RNA, 21 nt, Artificial Sequence
  Marburg virus siRNA sense strand
gacaaguaacaauggaacaca

SEQ ID NO: 26555 - RNA, 21 nt, Artificial Sequence
  Marburg virus siRNA sense strand
acaaguaacaauggaacacaa

SEQ ID NO: 26556 - RNA, 21 nt, Artificial Sequence
  Marburg virus siRNA sense strand
caaguaacaauggaacacaaa

SEQ ID NO: 26557 - RNA, 21 nt, Artificial Sequence
  Marburg virus siRNA sense strand
aaguaacaauggaacacaaac

SEQ ID NO: 26558 - RNA, 21 nt, Artificial Sequence
  Marburg virus siRNA sense strand
aguaacaauggaacacaaacg

SEQ ID NO: 26559 - RNA, 21 nt, Artificial Sequence
  Marburg virus siRNA sense strand
guaacaauggaacacaaacga

SEQ ID NO: 26560 - RNA, 21 nt, Artificial Sequence
  Marburg virus siRNA sense strand
uaacaauggaacacaaacgaa

SEQ ID NO: 26561 - RNA, 21 nt, Artificial Sequence
  Marburg virus siRNA sense strand
aacaauggaacacaaacgaau

SEQ ID NO: 26562 - RNA, 21 nt, Artificial Sequence
  Marburg virus siRNA sense strand
acaauggaacacaaacgaaug

SEQ ID NO: 26563 - RNA, 21 nt, Artificial Sequence
  Marburg virus siRNA sense strand
caauggaacacaaacgaauga

SEQ ID NO: 26564 - RNA, 21 nt, Artificial Sequence
  Marburg virus siRNA sense strand
aauggaacacaaacgaaugac

SEQ ID NO: 26565 - RNA, 21 nt, Artificial Sequence
  Marburg virus siRNA sense strand
auggaacacaaacgaaugaca

SEQ ID NO: 26566 - RNA, 21 nt, Artificial Sequence
  Marburg virus siRNA sense strand
uggaacacaaacgaaugacac

SEQ ID NO: 26567 - RNA, 21 nt, Artificial Sequence
  Marburg virus siRNA sense strand
ggaacacaaacgaaugacacu

SEQ ID NO: 26568 - RNA, 21 nt, Artificial Sequence
  Marburg virus siRNA sense strand
gaacacaaacgaaugacacug

SEQ ID NO: 26569 - RNA, 21 nt, Artificial Sequence
  Marburg virus siRNA sense strand
aacacaaacgaaugacacugg

SEQ ID NO: 26570 - RNA, 21 nt, Artificial Sequence
  Marburg virus siRNA sense strand
acacaaacgaaugacacugga

SEQ ID NO: 26571 - RNA, 21 nt, Artificial Sequence
  Marburg virus siRNA sense strand
cacaaacgaaugacacuggau

SEQ ID NO: 26572 - RNA, 21 nt, Artificial Sequence
  Marburg virus siRNA sense strand
acaaacgaaugacacuggaug

SEQ ID NO: 26573 - RNA, 21 nt, Artificial Sequence
  Marburg virus siRNA sense strand
caaacgaaugacacuggaugc

SEQ ID NO: 26574 - RNA, 21 nt, Artificial Sequence
  Marburg virus siRNA sense strand
aaacgaaugacacuggaugcu

SEQ ID NO: 26575 - RNA, 21 nt, Artificial Sequence
  Marburg virus siRNA sense strand
aacgaaugacacuggaugcuu

SEQ ID NO: 26576 - RNA, 21 nt, Artificial Sequence
  Marburg virus siRNA sense strand
acgaaugacacuggaugcuuc

SEQ ID NO: 26577 - RNA, 21 nt, Artificial Sequence
  Marburg virus siRNA sense strand
cgaaugacacuggaugcuucg

SEQ ID NO: 26578 - RNA, 21 nt, Artificial Sequence
  Marburg virus siRNA sense strand
gaaugacacuggaugcuucgg

SEQ ID NO: 26579 - RNA, 21 nt, Artificial Sequence
  Marburg virus siRNA sense strand
aaugacacuggaugcuucggu

SEQ ID NO: 26580 - RNA, 21 nt, Artificial Sequence
  Marburg virus siRNA sense strand
augacacuggaugcuucggug

SEQ ID NO: 26581 - RNA, 21 nt, Artificial Sequence
  Marburg virus siRNA sense strand
ugacacuggaugcuucggugc

SEQ ID NO: 26582 - RNA, 21 nt, Artificial Sequence
  Marburg virus siRNA sense strand
gacacuggaugcuucggugcu

SEQ ID NO: 26583 - RNA, 21 nt, Artificial Sequence
  Marburg virus siRNA sense strand
acacuggaugcuucggugcuc

SEQ ID NO: 26584 - RNA, 21 nt, Artificial Sequence
  Marburg virus siRNA sense strand
cacuggaugcuucggugcucu

SEQ ID NO: 26585 - RNA, 21 nt, Artificial Sequence
  Marburg virus siRNA sense strand
acuggaugcuucggugcucuu

SEQ ID NO: 26586 - RNA, 21 nt, Artificial Sequence
  Marburg virus siRNA sense strand
cuggaugcuucggugcucuuc

SEQ ID NO: 26587 - RNA, 21 nt, Artificial Sequence
  Marburg virus siRNA sense strand
uggaugcuucggugcucuuca

SEQ ID NO: 26588 - RNA, 21 nt, Artificial Sequence
  Marburg virus siRNA sense strand
ggaugcuucggugcucuucaa

SEQ ID NO: 26589 - RNA, 21 nt, Artificial Sequence
  Marburg virus siRNA sense strand
gaugcuucggugcucuucaag

SEQ ID NO: 26590 - RNA, 21 nt, Artificial Sequence
  Marburg virus siRNA sense strand
augcuucggugcucuucaaga

SEQ ID NO: 26591 - RNA, 21 nt, Artificial Sequence
  Marburg virus siRNA sense strand
ugcuucggugcucuucaagaa

SEQ ID NO: 26592 - RNA, 21 nt, Artificial Sequence
  Marburg virus siRNA sense strand
gcuucggugcucuucaagaau

SEQ ID NO: 26593 - RNA, 21 nt, Artificial Sequence
  Marburg virus siRNA sense strand
cuucggugcucuucaagaaua

SEQ ID NO: 26594 - RNA, 21 nt, Artificial Sequence
  Marburg virus siRNA sense strand
uucggugcucuucaagaauac

SEQ ID NO: 26595 - RNA, 21 nt, Artificial Sequence
  Marburg virus siRNA sense strand
ucggugcucuucaagaauaca

SEQ ID NO: 26596 - RNA, 21 nt, Artificial Sequence
  Marburg virus siRNA sense strand
cggugcucuucaagaauacaa

SEQ ID NO: 26597 - RNA, 21 nt, Artificial Sequence
  Marburg virus siRNA sense strand
ggugcucuucaagaauacaac

SEQ ID NO: 26598 - RNA, 21 nt, Artificial Sequence
  Marburg virus siRNA sense strand
gugcucuucaagaauacaacu

SEQ ID NO: 26599 - RNA, 21 nt, Artificial Sequence
  Marburg virus siRNA sense strand
ugcucuucaagaauacaacuc

SEQ ID NO: 26600 - RNA, 21 nt, Artificial Sequence
  Marburg virus siRNA sense strand
gcucuucaagaauacaacucc

SEQ ID NO: 26601 - RNA, 21 nt, Artificial Sequence
  Marburg virus siRNA sense strand
cucuucaagaauacaacucca

SEQ ID NO: 26602 - RNA, 21 nt, Artificial Sequence
  Marburg virus siRNA sense strand
ucuucaagaauacaacuccac

SEQ ID NO: 26603 - RNA, 21 nt, Artificial Sequence
  Marburg virus siRNA sense strand
cuucaagaauacaacuccacg

SEQ ID NO: 26604 - RNA, 21 nt, Artificial Sequence
  Marburg virus siRNA sense strand
uucaagaauacaacuccacga

SEQ ID NO: 26605 - RNA, 21 nt, Artificial Sequence
  Marburg virus siRNA sense strand
ucaagaauacaacuccacgaa

SEQ ID NO: 26606 - RNA, 21 nt, Artificial Sequence
  Marburg virus siRNA sense strand
caagaauacaacuccacgaag

SEQ ID NO: 26607 - RNA, 21 nt, Artificial Sequence
  Marburg virus siRNA sense strand
aagaauacaacuccacgaaga

SEQ ID NO: 26608 - RNA, 21 nt, Artificial Sequence
  Marburg virus siRNA sense strand
agaauacaacuccacgaagaa

SEQ ID NO: 26609 - RNA, 21 nt, Artificial Sequence
  Marburg virus siRNA sense strand
gaauacaacuccacgaagaau

SEQ ID NO: 26610 - RNA, 21 nt, Artificial Sequence
  Marburg virus siRNA sense strand
aauacaacuccacgaagaauc

SEQ ID NO: 26611 - RNA, 21 nt, Artificial Sequence
  Marburg virus siRNA sense strand
auacaacuccacgaagaauca

SEQ ID NO: 26612 - RNA, 21 nt, Artificial Sequence
  Marburg virus siRNA sense strand
uacaacuccacgaagaaucaa

SEQ ID NO: 26613 - RNA, 21 nt, Artificial Sequence
  Marburg virus siRNA sense strand
acaacuccacgaagaaucaaa

SEQ ID NO: 26614 - RNA, 21 nt, Artificial Sequence
  Marburg virus siRNA sense strand
caacuccacgaagaaucaaac

SEQ ID NO: 26615 - RNA, 21 nt, Artificial Sequence
  Marburg virus siRNA sense strand
aacuccacgaagaaucaaaca

SEQ ID NO: 26616 - RNA, 21 nt, Artificial Sequence
  Marburg virus siRNA sense strand
acuccacgaagaaucaaacau

SEQ ID NO: 26617 - RNA, 21 nt, Artificial Sequence
  Marburg virus siRNA sense strand
cuccacgaagaaucaaacaug

SEQ ID NO: 26618 - RNA, 21 nt, Artificial Sequence
  Marburg virus siRNA sense strand
uccacgaagaaucaaacaugu

SEQ ID NO: 26619 - RNA, 21 nt, Artificial Sequence
  Marburg virus siRNA sense strand
ccacgaagaaucaaacaugug

SEQ ID NO: 26620 - RNA, 21 nt, Artificial Sequence
  Marburg virus siRNA sense strand
cacgaagaaucaaacaugugc

SEQ ID NO: 26621 - RNA, 21 nt, Artificial Sequence
  Marburg virus siRNA sense strand
acgaagaaucaaacaugugcu

SEQ ID NO: 26622 - RNA, 21 nt, Artificial Sequence
  Marburg virus siRNA sense strand
cgaagaaucaaacaugugcuc

SEQ ID NO: 26623 - RNA, 21 nt, Artificial Sequence
  Marburg virus siRNA sense strand
gaagaaucaaacaugugcucc

SEQ ID NO: 26624 - RNA, 21 nt, Artificial Sequence
  Marburg virus siRNA sense strand
aagaaucaaacaugugcuccg

SEQ ID NO: 26625 - RNA, 21 nt, Artificial Sequence
  Marburg virus siRNA sense strand
agaaucaaacaugugcuccgu

SEQ ID NO: 26626 - RNA, 21 nt, Artificial Sequence
  Marburg virus siRNA sense strand
gaaucaaacaugugcuccguc

SEQ ID NO: 26627 - RNA, 21 nt, Artificial Sequence
  Marburg virus siRNA sense strand
aaucaaacaugugcuccgucc

SEQ ID NO: 26628 - RNA, 21 nt, Artificial Sequence
  Marburg virus siRNA sense strand
aucaaacaugugcuccgucca

SEQ ID NO: 26629 - RNA, 21 nt, Artificial Sequence
  Marburg virus siRNA sense strand
ucaaacaugugcuccguccaa

SEQ ID NO: 26630 - RNA, 21 nt, Artificial Sequence
  Marburg virus siRNA sense strand
caaacaugugcuccguccaaa

SEQ ID NO: 26631 - RNA, 21 nt, Artificial Sequence
  Marburg virus siRNA sense strand
aaacaugugcuccguccaaaa

SEQ ID NO: 26632 - RNA, 21 nt, Artificial Sequence
  Marburg virus siRNA sense strand
aacaugugcuccguccaaaau

SEQ ID NO: 26633 - RNA, 21 nt, Artificial Sequence
  Marburg virus siRNA sense strand
acaugugcuccguccaaaaua

SEQ ID NO: 26634 - RNA, 21 nt, Artificial Sequence
  Marburg virus siRNA sense strand
caugugcuccguccaaaauac

SEQ ID NO: 26635 - RNA, 21 nt, Artificial Sequence
  Marburg virus siRNA sense strand
augugcuccguccaaaauacc

SEQ ID NO: 26636 - RNA, 21 nt, Artificial Sequence
  Marburg virus siRNA sense strand
ugugcuccguccaaaauaccc

SEQ ID NO: 26637 - RNA, 21 nt, Artificial Sequence
  Marburg virus siRNA sense strand
gugcuccguccaaaauacccu

SEQ ID NO: 26638 - RNA, 21 nt, Artificial Sequence
  Marburg virus siRNA sense strand
ugcuccguccaaaauacccuc

SEQ ID NO: 26639 - RNA, 21 nt, Artificial Sequence
  Marburg virus siRNA sense strand
gcuccguccaaaauacccuca

SEQ ID NO: 26640 - RNA, 21 nt, Artificial Sequence
  Marburg virus siRNA sense strand
cuccguccaaaauacccucac

SEQ ID NO: 26641 - RNA, 21 nt, Artificial Sequence
  Marburg virus siRNA sense strand
uccguccaaaauacccucacc

SEQ ID NO: 26642 - RNA, 21 nt, Artificial Sequence
  Marburg virus siRNA sense strand
ccguccaaaauacccucacca

SEQ ID NO: 26643 - RNA, 21 nt, Artificial Sequence
  Marburg virus siRNA sense strand
cguccaaaauacccucaccac

SEQ ID NO: 26644 - RNA, 21 nt, Artificial Sequence
  Marburg virus siRNA sense strand
guccaaaauacccucaccacu

SEQ ID NO: 26645 - RNA, 21 nt, Artificial Sequence
  Marburg virus siRNA sense strand
uccaaaauacccucaccacug

SEQ ID NO: 26646 - RNA, 21 nt, Artificial Sequence
  Marburg virus siRNA sense strand
ccaaaauacccucaccacugc

SEQ ID NO: 26647 - RNA, 21 nt, Artificial Sequence
  Marburg virus siRNA sense strand
caaaauacccucaccacugcc

SEQ ID NO: 26648 - RNA, 21 nt, Artificial Sequence
  Marburg virus siRNA sense strand
aaaauacccucaccacugccc

SEQ ID NO: 26649 - RNA, 21 nt, Artificial Sequence
  Marburg virus siRNA sense strand
aaauacccucaccacugccca

SEQ ID NO: 26650 - RNA, 21 nt, Artificial Sequence
  Marburg virus siRNA sense strand
aauacccucaccacugcccac

SEQ ID NO: 26651 - RNA, 21 nt, Artificial Sequence
  Marburg virus siRNA sense strand
auacccucaccacugcccaca

SEQ ID NO: 26652 - RNA, 21 nt, Artificial Sequence
  Marburg virus siRNA sense strand
uacccucaccacugcccacag

SEQ ID NO: 26653 - RNA, 21 nt, Artificial Sequence
  Marburg virus siRNA sense strand
acccucaccacugcccacagc

SEQ ID NO: 26654 - RNA, 21 nt, Artificial Sequence
  Marburg virus siRNA sense strand
cccucaccacugcccacagcc

SEQ ID NO: 26655 - RNA, 21 nt, Artificial Sequence
  Marburg virus siRNA sense strand
ccucaccacugcccacagccc

SEQ ID NO: 26656 - RNA, 21 nt, Artificial Sequence
  Marburg virus siRNA sense strand
cucaccacugcccacagcccg

SEQ ID NO: 26657 - RNA, 21 nt, Artificial Sequence
  Marburg virus siRNA sense strand
ucaccacugcccacagcccgu

SEQ ID NO: 26658 - RNA, 21 nt, Artificial Sequence
  Marburg virus siRNA sense strand
caccacugcccacagcccguc

SEQ ID NO: 26659 - RNA, 21 nt, Artificial Sequence
  Marburg virus siRNA sense strand
accacugcccacagcccgucc

SEQ ID NO: 26660 - RNA, 21 nt, Artificial Sequence
  Marburg virus siRNA sense strand
ccacugcccacagcccgucca

SEQ ID NO: 26661 - RNA, 21 nt, Artificial Sequence
  Marburg virus siRNA sense strand
cacugcccacagcccguccag

SEQ ID NO: 26662 - RNA, 21 nt, Artificial Sequence
  Marburg virus siRNA sense strand
acugcccacagcccguccaga

SEQ ID NO: 26663 - RNA, 21 nt, Artificial Sequence
  Marburg virus siRNA sense strand
cugcccacagcccguccagag

SEQ ID NO: 26664 - RNA, 21 nt, Artificial Sequence
  Marburg virus siRNA sense strand
ugcccacagcccguccagaga

SEQ ID NO: 26665 - RNA, 21 nt, Artificial Sequence
  Marburg virus siRNA sense strand
gcccacagcccguccagagau

SEQ ID NO: 26666 - RNA, 21 nt, Artificial Sequence
  Marburg virus siRNA sense strand
cccacagcccguccagagauc

SEQ ID NO: 26667 - RNA, 21 nt, Artificial Sequence
  Marburg virus siRNA sense strand
ccacagcccguccagagauca

SEQ ID NO: 26668 - RNA, 21 nt, Artificial Sequence
  Marburg virus siRNA sense strand
cacagcccguccagagaucaa

SEQ ID NO: 26669 - RNA, 21 nt, Artificial Sequence
  Marburg virus siRNA sense strand
acagcccguccagagaucaaa

SEQ ID NO: 26670 - RNA, 21 nt, Artificial Sequence
  Marburg virus siRNA sense strand
cagcccguccagagaucaaac

SEQ ID NO: 26671 - RNA, 21 nt, Artificial Sequence
  Marburg virus siRNA sense strand
agcccguccagagaucaaacc

SEQ ID NO: 26672 - RNA, 21 nt, Artificial Sequence
  Marburg virus siRNA sense strand
gcccguccagagaucaaaccc

SEQ ID NO: 26673 - RNA, 21 nt, Artificial Sequence
  Marburg virus siRNA sense strand
cccguccagagaucaaaccca

SEQ ID NO: 26674 - RNA, 21 nt, Artificial Sequence
  Marburg virus siRNA sense strand
ccguccagagaucaaacccac

SEQ ID NO: 26675 - RNA, 21 nt, Artificial Sequence
  Marburg virus siRNA sense strand
cguccagagaucaaacccaca

SEQ ID NO: 26676 - RNA, 21 nt, Artificial Sequence
  Marburg virus siRNA sense strand
guccagagaucaaacccacaa

SEQ ID NO: 26677 - RNA, 21 nt, Artificial Sequence
  Marburg virus siRNA sense strand
uccagagaucaaacccacaag

SEQ ID NO: 26678 - RNA, 21 nt, Artificial Sequence
  Marburg virus siRNA sense strand
ccagagaucaaacccacaagc

SEQ ID NO: 26679 - RNA, 21 nt, Artificial Sequence
  Marburg virus siRNA sense strand
cagagaucaaacccacaagca

SEQ ID NO: 26680 - RNA, 21 nt, Artificial Sequence
  Marburg virus siRNA sense strand
agagaucaaacccacaagcac

SEQ ID NO: 26681 - RNA, 21 nt, Artificial Sequence
  Marburg virus siRNA sense strand
gagaucaaacccacaagcacc

SEQ ID NO: 26682 - RNA, 21 nt, Artificial Sequence
  Marburg virus siRNA sense strand
agaucaaacccacaagcaccc

SEQ ID NO: 26683 - RNA, 21 nt, Artificial Sequence
  Marburg virus siRNA sense strand
gaucaaacccacaagcacccc

SEQ ID NO: 26684 - RNA, 21 nt, Artificial Sequence
  Marburg virus siRNA sense strand
aucaaacccacaagcacccca

SEQ ID NO: 26685 - RNA, 21 nt, Artificial Sequence
  Marburg virus siRNA sense strand
ucaaacccacaagcaccccaa

SEQ ID NO: 26686 - RNA, 21 nt, Artificial Sequence
  Marburg virus siRNA sense strand
caaacccacaagcaccccaac

SEQ ID NO: 26687 - RNA, 21 nt, Artificial Sequence
  Marburg virus siRNA sense strand
aaacccacaagcaccccaacu

SEQ ID NO: 26688 - RNA, 21 nt, Artificial Sequence
  Marburg virus siRNA sense strand
aacccacaagcaccccaacug

SEQ ID NO: 26689 - RNA, 21 nt, Artificial Sequence
  Marburg virus siRNA sense strand
acccacaagcaccccaacuga

SEQ ID NO: 26690 - RNA, 21 nt, Artificial Sequence
  Marburg virus siRNA sense strand
cccacaagcaccccaacugau

SEQ ID NO: 26691 - RNA, 21 nt, Artificial Sequence
  Marburg virus siRNA sense strand
ccacaagcaccccaacugaug

SEQ ID NO: 26692 - RNA, 21 nt, Artificial Sequence
  Marburg virus siRNA sense strand
cacaagcaccccaacugaugc

SEQ ID NO: 26693 - RNA, 21 nt, Artificial Sequence
  Marburg virus siRNA sense strand
acaagcaccccaacugaugcc

SEQ ID NO: 26694 - RNA, 21 nt, Artificial Sequence
  Marburg virus siRNA sense strand
caagcaccccaacugaugcca

SEQ ID NO: 26695 - RNA, 21 nt, Artificial Sequence
  Marburg virus siRNA sense strand
aagcaccccaacugaugccac

SEQ ID NO: 26696 - RNA, 21 nt, Artificial Sequence
  Marburg virus siRNA sense strand
agcaccccaacugaugccacc

SEQ ID NO: 26697 - RNA, 21 nt, Artificial Sequence
  Marburg virus siRNA sense strand
gcaccccaacugaugccacca

SEQ ID NO: 26698 - RNA, 21 nt, Artificial Sequence
  Marburg virus siRNA sense strand
caccccaacugaugccaccac

SEQ ID NO: 26699 - RNA, 21 nt, Artificial Sequence
  Marburg virus siRNA sense strand
accccaacugaugccaccaca

SEQ ID NO: 26700 - RNA, 21 nt, Artificial Sequence
  Marburg virus siRNA sense strand
ccccaacugaugccaccacac

SEQ ID NO: 26701 - RNA, 21 nt, Artificial Sequence
  Marburg virus siRNA sense strand
cccaacugaugccaccacacu

SEQ ID NO: 26702 - RNA, 21 nt, Artificial Sequence
  Marburg virus siRNA sense strand
ccaacugaugccaccacacuc

SEQ ID NO: 26703 - RNA, 21 nt, Artificial Sequence
  Marburg virus siRNA sense strand
caacugaugccaccacacuca

SEQ ID NO: 26704 - RNA, 21 nt, Artificial Sequence
  Marburg virus siRNA sense strand
aacugaugccaccacacucaa

SEQ ID NO: 26705 - RNA, 21 nt, Artificial Sequence
  Marburg virus siRNA sense strand
acugaugccaccacacucaac

SEQ ID NO: 26706 - RNA, 21 nt, Artificial Sequence
  Marburg virus siRNA sense strand
cugaugccaccacacucaaca

SEQ ID NO: 26707 - RNA, 21 nt, Artificial Sequence
  Marburg virus siRNA sense strand
ugaugccaccacacucaacac

SEQ ID NO: 26708 - RNA, 21 nt, Artificial Sequence
  Marburg virus siRNA sense strand
gaugccaccacacucaacacc

SEQ ID NO: 26709 - RNA, 21 nt, Artificial Sequence
  Marburg virus siRNA sense strand
augccaccacacucaacacca

SEQ ID NO: 26710 - RNA, 21 nt, Artificial Sequence
  Marburg virus siRNA sense strand
ugccaccacacucaacaccac

SEQ ID NO: 26711 - RNA, 21 nt, Artificial Sequence
  Marburg virus siRNA sense strand
gccaccacacucaacaccaca

SEQ ID NO: 26712 - RNA, 21 nt, Artificial Sequence
  Marburg virus siRNA sense strand
ccaccacacucaacaccacag

SEQ ID NO: 26713 - RNA, 21 nt, Artificial Sequence
  Marburg virus siRNA sense strand
caccacacucaacaccacaga

SEQ ID NO: 26714 - RNA, 21 nt, Artificial Sequence
  Marburg virus siRNA sense strand
accacacucaacaccacagac

SEQ ID NO: 26715 - RNA, 21 nt, Artificial Sequence
  Marburg virus siRNA sense strand
ccacacucaacaccacagacc

SEQ ID NO: 26716 - RNA, 21 nt, Artificial Sequence
  Marburg virus siRNA sense strand
cacacucaacaccacagaccc

SEQ ID NO: 26717 - RNA, 21 nt, Artificial Sequence
  Marburg virus siRNA sense strand
acacucaacaccacagaccca

SEQ ID NO: 26718 - RNA, 21 nt, Artificial Sequence
  Marburg virus siRNA sense strand
cacucaacaccacagacccaa

SEQ ID NO: 26719 - RNA, 21 nt, Artificial Sequence
  Marburg virus siRNA sense strand
acucaacaccacagacccaaa

SEQ ID NO: 26720 - RNA, 21 nt, Artificial Sequence
  Marburg virus siRNA sense strand
cucaacaccacagacccaaac

SEQ ID NO: 26721 - RNA, 21 nt, Artificial Sequence
  Marburg virus siRNA sense strand
ucaacaccacagacccaaaca

SEQ ID NO: 26722 - RNA, 21 nt, Artificial Sequence
  Marburg virus siRNA sense strand
caacaccacagacccaaacaa

SEQ ID NO: 26723 - RNA, 21 nt, Artificial Sequence
  Marburg virus siRNA sense strand
aacaccacagacccaaacaau

SEQ ID NO: 26724 - RNA, 21 nt, Artificial Sequence
  Marburg virus siRNA sense strand
acaccacagacccaaacaaug

SEQ ID NO: 26725 - RNA, 21 nt, Artificial Sequence
  Marburg virus siRNA sense strand
caccacagacccaaacaauga

SEQ ID NO: 26726 - RNA, 21 nt, Artificial Sequence
  Marburg virus siRNA sense strand
accacagacccaaacaaugau

SEQ ID NO: 26727 - RNA, 21 nt, Artificial Sequence
  Marburg virus siRNA sense strand
ccacagacccaaacaaugaug

SEQ ID NO: 26728 - RNA, 21 nt, Artificial Sequence
  Marburg virus siRNA sense strand
cacagacccaaacaaugauga

SEQ ID NO: 26729 - RNA, 21 nt, Artificial Sequence
  Marburg virus siRNA sense strand
acagacccaaacaaugaugau

SEQ ID NO: 26730 - RNA, 21 nt, Artificial Sequence
  Marburg virus siRNA sense strand
cagacccaaacaaugaugaug

SEQ ID NO: 26731 - RNA, 21 nt, Artificial Sequence
  Marburg virus siRNA sense strand
agacccaaacaaugaugauga

SEQ ID NO: 26732 - RNA, 21 nt, Artificial Sequence
  Marburg virus siRNA sense strand
gacccaaacaaugaugaugag

SEQ ID NO: 26733 - RNA, 21 nt, Artificial Sequence
  Marburg virus siRNA sense strand
acccaaacaaugaugaugagg

SEQ ID NO: 26734 - RNA, 21 nt, Artificial Sequence
  Marburg virus siRNA sense strand
cccaaacaaugaugaugagga

SEQ ID NO: 26735 - RNA, 21 nt, Artificial Sequence
  Marburg virus siRNA sense strand
ccaaacaaugaugaugaggac

SEQ ID NO: 26736 - RNA, 21 nt, Artificial Sequence
  Marburg virus siRNA sense strand
caaacaaugaugaugaggacc

SEQ ID NO: 26737 - RNA, 21 nt, Artificial Sequence
  Marburg virus siRNA sense strand
aaacaaugaugaugaggaccu

SEQ ID NO: 26738 - RNA, 21 nt, Artificial Sequence
  Marburg virus siRNA sense strand
aacaaugaugaugaggaccuc

SEQ ID NO: 26739 - RNA, 21 nt, Artificial Sequence
  Marburg virus siRNA sense strand
acaaugaugaugaggaccuca

SEQ ID NO: 26740 - RNA, 21 nt, Artificial Sequence
  Marburg virus siRNA sense strand
caaugaugaugaggaccucau

SEQ ID NO: 26741 - RNA, 21 nt, Artificial Sequence
  Marburg virus siRNA sense strand
aaugaugaugaggaccucaua

SEQ ID NO: 26742 - RNA, 21 nt, Artificial Sequence
  Marburg virus siRNA sense strand
augaugaugaggaccucauaa

SEQ ID NO: 26743 - RNA, 21 nt, Artificial Sequence
  Marburg virus siRNA sense strand
ugaugaugaggaccucauaac

SEQ ID NO: 26744 - RNA, 21 nt, Artificial Sequence
  Marburg virus siRNA sense strand
gaugaugaggaccucauaaca

SEQ ID NO: 26745 - RNA, 21 nt, Artificial Sequence
  Marburg virus siRNA sense strand
augaugaggaccucauaacau

SEQ ID NO: 26746 - RNA, 21 nt, Artificial Sequence
  Marburg virus siRNA sense strand
ugaugaggaccucauaacauc

SEQ ID NO: 26747 - RNA, 21 nt, Artificial Sequence
  Marburg virus siRNA sense strand
gaugaggaccucauaacaucc

SEQ ID NO: 26748 - RNA, 21 nt, Artificial Sequence
  Marburg virus siRNA sense strand
augaggaccucauaacauccg

SEQ ID NO: 26749 - RNA, 21 nt, Artificial Sequence
  Marburg virus siRNA sense strand
ugaggaccucauaacauccgg

SEQ ID NO: 26750 - RNA, 21 nt, Artificial Sequence
  Marburg virus siRNA sense strand
gaggaccucauaacauccggu

SEQ ID NO: 26751 - RNA, 21 nt, Artificial Sequence
  Marburg virus siRNA sense strand
aggaccucauaacauccgguu

SEQ ID NO: 26752 - RNA, 21 nt, Artificial Sequence
  Marburg virus siRNA sense strand
ggaccucauaacauccgguuc

SEQ ID NO: 26753 - RNA, 21 nt, Artificial Sequence
  Marburg virus siRNA sense strand
gaccucauaacauccgguuca

SEQ ID NO: 26754 - RNA, 21 nt, Artificial Sequence
  Marburg virus siRNA sense strand
accucauaacauccgguucag

SEQ ID NO: 26755 - RNA, 21 nt, Artificial Sequence
  Marburg virus siRNA sense strand
ccucauaacauccgguucagg

SEQ ID NO: 26756 - RNA, 21 nt, Artificial Sequence
  Marburg virus siRNA sense strand
cucauaacauccgguucaggg

SEQ ID NO: 26757 - RNA, 21 nt, Artificial Sequence
  Marburg virus siRNA sense strand
ucauaacauccgguucagggu

SEQ ID NO: 26758 - RNA, 21 nt, Artificial Sequence
  Marburg virus siRNA sense strand
cauaacauccgguucaggguc

SEQ ID NO: 26759 - RNA, 21 nt, Artificial Sequence
  Marburg virus siRNA sense strand
auaacauccgguucagggucc

SEQ ID NO: 26760 - RNA, 21 nt, Artificial Sequence
  Marburg virus siRNA sense strand
uaacauccgguucaggguccg

SEQ ID NO: 26761 - RNA, 21 nt, Artificial Sequence
  Marburg virus siRNA sense strand
aacauccgguucaggguccgg

SEQ ID NO: 26762 - RNA, 21 nt, Artificial Sequence
  Marburg virus siRNA sense strand
acauccgguucaggguccgga

SEQ ID NO: 26763 - RNA, 21 nt, Artificial Sequence
  Marburg virus siRNA sense strand
cauccgguucaggguccggag

SEQ ID NO: 26764 - RNA, 21 nt, Artificial Sequence
  Marburg virus siRNA sense strand
auccgguucaggguccggaga

SEQ ID NO: 26765 - RNA, 21 nt, Artificial Sequence
  Marburg virus siRNA sense strand
uccgguucaggguccggagaa

SEQ ID NO: 26766 - RNA, 21 nt, Artificial Sequence
  Marburg virus siRNA sense strand
ccgguucaggguccggagaac

SEQ ID NO: 26767 - RNA, 21 nt, Artificial Sequence
  Marburg virus siRNA sense strand
cgguucaggguccggagaaca

SEQ ID NO: 26768 - RNA, 21 nt, Artificial Sequence
  Marburg virus siRNA sense strand
gguucaggguccggagaacag

SEQ ID NO: 26769 - RNA, 21 nt, Artificial Sequence
  Marburg virus siRNA sense strand
guucaggguccggagaacagg

SEQ ID NO: 26770 - RNA, 21 nt, Artificial Sequence
  Marburg virus siRNA sense strand
uucaggguccggagaacagga

SEQ ID NO: 26771 - RNA, 21 nt, Artificial Sequence
  Marburg virus siRNA sense strand
ucaggguccggagaacaggaa

SEQ ID NO: 26772 - RNA, 21 nt, Artificial Sequence
  Marburg virus siRNA sense strand
caggguccggagaacaggaac

SEQ ID NO: 26773 - RNA, 21 nt, Artificial Sequence
  Marburg virus siRNA sense strand
aggguccggagaacaggaacc

SEQ ID NO: 26774 - RNA, 21 nt, Artificial Sequence
  Marburg virus siRNA sense strand
ggguccggagaacaggaaccc

SEQ ID NO: 26775 - RNA, 21 nt, Artificial Sequence
  Marburg virus siRNA sense strand
gguccggagaacaggaacccu

SEQ ID NO: 26776 - RNA, 21 nt, Artificial Sequence
  Marburg virus siRNA sense strand
guccggagaacaggaacccua

SEQ ID NO: 26777 - RNA, 21 nt, Artificial Sequence
  Marburg virus siRNA sense strand
uccggagaacaggaacccuau

SEQ ID NO: 26778 - RNA, 21 nt, Artificial Sequence
  Marburg virus siRNA sense strand
ccggagaacaggaacccuaua

SEQ ID NO: 26779 - RNA, 21 nt, Artificial Sequence
  Marburg virus siRNA sense strand
cggagaacaggaacccuauac

SEQ ID NO: 26780 - RNA, 21 nt, Artificial Sequence
  Marburg virus siRNA sense strand
ggagaacaggaacccuauaca

SEQ ID NO: 26781 - RNA, 21 nt, Artificial Sequence
  Marburg virus siRNA sense strand
gagaacaggaacccuauacaa

SEQ ID NO: 26782 - RNA, 21 nt, Artificial Sequence
  Marburg virus siRNA sense strand
agaacaggaacccuauacaac

SEQ ID NO: 26783 - RNA, 21 nt, Artificial Sequence
  Marburg virus siRNA sense strand
gaacaggaacccuauacaacu

SEQ ID NO: 26784 - RNA, 21 nt, Artificial Sequence
  Marburg virus siRNA sense strand
aacaggaacccuauacaacuu

SEQ ID NO: 26785 - RNA, 21 nt, Artificial Sequence
  Marburg virus siRNA sense strand
acaggaacccuauacaacuuc

SEQ ID NO: 26786 - RNA, 21 nt, Artificial Sequence
  Marburg virus siRNA sense strand
caggaacccuauacaacuuca

SEQ ID NO: 26787 - RNA, 21 nt, Artificial Sequence
  Marburg virus siRNA sense strand
aggaacccuauacaacuucag

SEQ ID NO: 26788 - RNA, 21 nt, Artificial Sequence
  Marburg virus siRNA sense strand
ggaacccuauacaacuucaga

SEQ ID NO: 26789 - RNA, 21 nt, Artificial Sequence
  Marburg virus siRNA sense strand
gaacccuauacaacuucagau

SEQ ID NO: 26790 - RNA, 21 nt, Artificial Sequence
  Marburg virus siRNA sense strand
aacccuauacaacuucagaug

SEQ ID NO: 26791 - RNA, 21 nt, Artificial Sequence
  Marburg virus siRNA sense strand
acccuauacaacuucagaugc

SEQ ID NO: 26792 - RNA, 21 nt, Artificial Sequence
  Marburg virus siRNA sense strand
cccuauacaacuucagaugcg

SEQ ID NO: 26793 - RNA, 21 nt, Artificial Sequence
  Marburg virus siRNA sense strand
ccuauacaacuucagaugcgg

SEQ ID NO: 26794 - RNA, 21 nt, Artificial Sequence
  Marburg virus siRNA sense strand
cuauacaacuucagaugcggu

SEQ ID NO: 26795 - RNA, 21 nt, Artificial Sequence
  Marburg virus siRNA sense strand
uauacaacuucagaugcgguc

SEQ ID NO: 26796 - RNA, 21 nt, Artificial Sequence
  Marburg virus siRNA sense strand
auacaacuucagaugcgguca

SEQ ID NO: 26797 - RNA, 21 nt, Artificial Sequence
  Marburg virus siRNA sense strand
uacaacuucagaugcggucac

SEQ ID NO: 26798 - RNA, 21 nt, Artificial Sequence
  Marburg virus siRNA sense strand
acaacuucagaugcggucacu

SEQ ID NO: 26799 - RNA, 21 nt, Artificial Sequence
  Marburg virus siRNA sense strand
caacuucagaugcggucacua

SEQ ID NO: 26800 - RNA, 21 nt, Artificial Sequence
  Marburg virus siRNA sense strand
aacuucagaugcggucacuaa

SEQ ID NO: 26801 - RNA, 21 nt, Artificial Sequence
  Marburg virus siRNA sense strand
acuucagaugcggucacuaag

SEQ ID NO: 26802 - RNA, 21 nt, Artificial Sequence
  Marburg virus siRNA sense strand
cuucagaugcggucacuaagc

SEQ ID NO: 26803 - RNA, 21 nt, Artificial Sequence
  Marburg virus siRNA sense strand
uucagaugcggucacuaagca

SEQ ID NO: 26804 - RNA, 21 nt, Artificial Sequence
  Marburg virus siRNA sense strand
ucagaugcggucacuaagcaa

SEQ ID NO: 26805 - RNA, 21 nt, Artificial Sequence
  Marburg virus siRNA sense strand
cagaugcggucacuaagcaag

SEQ ID NO: 26806 - RNA, 21 nt, Artificial Sequence
  Marburg virus siRNA sense strand
agaugcggucacuaagcaagg

SEQ ID NO: 26807 - RNA, 21 nt, Artificial Sequence
  Marburg virus siRNA sense strand
gaugcggucacuaagcaaggg

SEQ ID NO: 26808 - RNA, 21 nt, Artificial Sequence
  Marburg virus siRNA sense strand
augcggucacuaagcaagggc

SEQ ID NO: 26809 - RNA, 21 nt, Artificial Sequence
  Marburg virus siRNA sense strand
ugcggucacuaagcaagggcu

SEQ ID NO: 26810 - RNA, 21 nt, Artificial Sequence
  Marburg virus siRNA sense strand
gcggucacuaagcaagggcuu

SEQ ID NO: 26811 - RNA, 21 nt, Artificial Sequence
  Marburg virus siRNA sense strand
cggucacuaagcaagggcuuu

SEQ ID NO: 26812 - RNA, 21 nt, Artificial Sequence
  Marburg virus siRNA sense strand
ggucacuaagcaagggcuuuc

SEQ ID NO: 26813 - RNA, 21 nt, Artificial Sequence
  Marburg virus siRNA sense strand
gucacuaagcaagggcuuuca

SEQ ID NO: 26814 - RNA, 21 nt, Artificial Sequence
  Marburg virus siRNA sense strand
ucacuaagcaagggcuuucau

SEQ ID NO: 26815 - RNA, 21 nt, Artificial Sequence
  Marburg virus siRNA sense strand
cacuaagcaagggcuuucauc

SEQ ID NO: 26816 - RNA, 21 nt, Artificial Sequence
  Marburg virus siRNA sense strand
acuaagcaagggcuuucauca

SEQ ID NO: 26817 - RNA, 21 nt, Artificial Sequence
  Marburg virus siRNA sense strand
cuaagcaagggcuuucaucaa

SEQ ID NO: 26818 - RNA, 21 nt, Artificial Sequence
  Marburg virus siRNA sense strand
uaagcaagggcuuucaucaac

SEQ ID NO: 26819 - RNA, 21 nt, Artificial Sequence
  Marburg virus siRNA sense strand
aagcaagggcuuucaucaaca

SEQ ID NO: 26820 - RNA, 21 nt, Artificial Sequence
  Marburg virus siRNA sense strand
agcaagggcuuucaucaacaa

SEQ ID NO: 26821 - RNA, 21 nt, Artificial Sequence
  Marburg virus siRNA sense strand
gcaagggcuuucaucaacaau

SEQ ID NO: 26822 - RNA, 21 nt, Artificial Sequence
  Marburg virus siRNA sense strand
caagggcuuucaucaacaaug

SEQ ID NO: 26823 - RNA, 21 nt, Artificial Sequence
  Marburg virus siRNA sense strand
aagggcuuucaucaacaaugc

SEQ ID NO: 26824 - RNA, 21 nt, Artificial Sequence
  Marburg virus siRNA sense strand
agggcuuucaucaacaaugcc

SEQ ID NO: 26825 - RNA, 21 nt, Artificial Sequence
  Marburg virus siRNA sense strand
gggcuuucaucaacaaugcca

SEQ ID NO: 26826 - RNA, 21 nt, Artificial Sequence
  Marburg virus siRNA sense strand
ggcuuucaucaacaaugccac

SEQ ID NO: 26827 - RNA, 21 nt, Artificial Sequence
  Marburg virus siRNA sense strand
gcuuucaucaacaaugccacc

SEQ ID NO: 26828 - RNA, 21 nt, Artificial Sequence
  Marburg virus siRNA sense strand
cuuucaucaacaaugccaccc

SEQ ID NO: 26829 - RNA, 21 nt, Artificial Sequence
  Marburg virus siRNA sense strand
uuucaucaacaaugccaccca

SEQ ID NO: 26830 - RNA, 21 nt, Artificial Sequence
  Marburg virus siRNA sense strand
uucaucaacaaugccacccac

SEQ ID NO: 26831 - RNA, 21 nt, Artificial Sequence
  Marburg virus siRNA sense strand
ucaucaacaaugccacccacu

SEQ ID NO: 26832 - RNA, 21 nt, Artificial Sequence
  Marburg virus siRNA sense strand
caucaacaaugccacccacuc

SEQ ID NO: 26833 - RNA, 21 nt, Artificial Sequence
  Marburg virus siRNA sense strand
aucaacaaugccacccacucc

SEQ ID NO: 26834 - RNA, 21 nt, Artificial Sequence
  Marburg virus siRNA sense strand
ucaacaaugccacccacuccc

SEQ ID NO: 26835 - RNA, 21 nt, Artificial Sequence
  Marburg virus siRNA sense strand
caacaaugccacccacucccu

SEQ ID NO: 26836 - RNA, 21 nt, Artificial Sequence
  Marburg virus siRNA sense strand
aacaaugccacccacucccuc

SEQ ID NO: 26837 - RNA, 21 nt, Artificial Sequence
  Marburg virus siRNA sense strand
acaaugccacccacucccuca

SEQ ID NO: 26838 - RNA, 21 nt, Artificial Sequence
  Marburg virus siRNA sense strand
caaugccacccacucccucac

SEQ ID NO: 26839 - RNA, 21 nt, Artificial Sequence
  Marburg virus siRNA sense strand
aaugccacccacucccucacc

SEQ ID NO: 26840 - RNA, 21 nt, Artificial Sequence
  Marburg virus siRNA sense strand
augccacccacucccucacca

SEQ ID NO: 26841 - RNA, 21 nt, Artificial Sequence
  Marburg virus siRNA sense strand
ugccacccacucccucaccac

SEQ ID NO: 26842 - RNA, 21 nt, Artificial Sequence
  Marburg virus siRNA sense strand
gccacccacucccucaccaca

SEQ ID NO: 26843 - RNA, 21 nt, Artificial Sequence
  Marburg virus siRNA sense strand
ccacccacucccucaccacaa

SEQ ID NO: 26844 - RNA, 21 nt, Artificial Sequence
  Marburg virus siRNA sense strand
cacccacucccucaccacaac

SEQ ID NO: 26845 - RNA, 21 nt, Artificial Sequence
  Marburg virus siRNA sense strand
acccacucccucaccacaacc

SEQ ID NO: 26846 - RNA, 21 nt, Artificial Sequence
  Marburg virus siRNA sense strand
cccacucccucaccacaacca

SEQ ID NO: 26847 - RNA, 21 nt, Artificial Sequence
  Marburg virus siRNA sense strand
ccacucccucaccacaaccaa

SEQ ID NO: 26848 - RNA, 21 nt, Artificial Sequence
  Marburg virus siRNA sense strand
cacucccucaccacaaccaag

SEQ ID NO: 26849 - RNA, 21 nt, Artificial Sequence
  Marburg virus siRNA sense strand
acucccucaccacaaccaagc

SEQ ID NO: 26850 - RNA, 21 nt, Artificial Sequence
  Marburg virus siRNA sense strand
cucccucaccacaaccaagca

SEQ ID NO: 26851 - RNA, 21 nt, Artificial Sequence
  Marburg virus siRNA sense strand
ucccucaccacaaccaagcac

SEQ ID NO: 26852 - RNA, 21 nt, Artificial Sequence
  Marburg virus siRNA sense strand
cccucaccacaaccaagcacg

SEQ ID NO: 26853 - RNA, 21 nt, Artificial Sequence
  Marburg virus siRNA sense strand
ccucaccacaaccaagcacgc

SEQ ID NO: 26854 - RNA, 21 nt, Artificial Sequence
  Marburg virus siRNA sense strand
cucaccacaaccaagcacgcc

SEQ ID NO: 26855 - RNA, 21 nt, Artificial Sequence
  Marburg virus siRNA sense strand
ucaccacaaccaagcacgcca

SEQ ID NO: 26856 - RNA, 21 nt, Artificial Sequence
  Marburg virus siRNA sense strand
caccacaaccaagcacgccac

SEQ ID NO: 26857 - RNA, 21 nt, Artificial Sequence
  Marburg virus siRNA sense strand
accacaaccaagcacgccaca

SEQ ID NO: 26858 - RNA, 21 nt, Artificial Sequence
  Marburg virus siRNA sense strand
ccacaaccaagcacgccacag

SEQ ID NO: 26859 - RNA, 21 nt, Artificial Sequence
  Marburg virus siRNA sense strand
cacaaccaagcacgccacagc

SEQ ID NO: 26860 - RNA, 21 nt, Artificial Sequence
  Marburg virus siRNA sense strand
acaaccaagcacgccacagca

SEQ ID NO: 26861 - RNA, 21 nt, Artificial Sequence
  Marburg virus siRNA sense strand
caaccaagcacgccacagcaa

SEQ ID NO: 26862 - RNA, 21 nt, Artificial Sequence
  Marburg virus siRNA sense strand
aaccaagcacgccacagcaag

SEQ ID NO: 26863 - RNA, 21 nt, Artificial Sequence
  Marburg virus siRNA sense strand
accaagcacgccacagcaaga

SEQ ID NO: 26864 - RNA, 21 nt, Artificial Sequence
  Marburg virus siRNA sense strand
ccaagcacgccacagcaagaa

SEQ ID NO: 26865 - RNA, 21 nt, Artificial Sequence
  Marburg virus siRNA sense strand
caagcacgccacagcaagaag

SEQ ID NO: 26866 - RNA, 21 nt, Artificial Sequence
  Marburg virus siRNA sense strand
aagcacgccacagcaagaagg

SEQ ID NO: 26867 - RNA, 21 nt, Artificial Sequence
  Marburg virus siRNA sense strand
agcacgccacagcaagaagga

SEQ ID NO: 26868 - RNA, 21 nt, Artificial Sequence
  Marburg virus siRNA sense strand
gcacgccacagcaagaaggaa

SEQ ID NO: 26869 - RNA, 21 nt, Artificial Sequence
  Marburg virus siRNA sense strand
cacgccacagcaagaaggaaa

SEQ ID NO: 26870 - RNA, 21 nt, Artificial Sequence
  Marburg virus siRNA sense strand
acgccacagcaagaaggaaac

SEQ ID NO: 26871 - RNA, 21 nt, Artificial Sequence
  Marburg virus siRNA sense strand
cgccacagcaagaaggaaaca

SEQ ID NO: 26872 - RNA, 21 nt, Artificial Sequence
  Marburg virus siRNA sense strand
gccacagcaagaaggaaacaa

SEQ ID NO: 26873 - RNA, 21 nt, Artificial Sequence
  Marburg virus siRNA sense strand
ccacagcaagaaggaaacaac

SEQ ID NO: 26874 - RNA, 21 nt, Artificial Sequence
  Marburg virus siRNA sense strand
cacagcaagaaggaaacaaca

SEQ ID NO: 26875 - RNA, 21 nt, Artificial Sequence
  Marburg virus siRNA sense strand
acagcaagaaggaaacaacac

SEQ ID NO: 26876 - RNA, 21 nt, Artificial Sequence
  Marburg virus siRNA sense strand
cagcaagaaggaaacaacaca

SEQ ID NO: 26877 - RNA, 21 nt, Artificial Sequence
  Marburg virus siRNA sense strand
agcaagaaggaaacaacacag

SEQ ID NO: 26878 - RNA, 21 nt, Artificial Sequence
  Marburg virus siRNA sense strand
gcaagaaggaaacaacacaga

SEQ ID NO: 26879 - RNA, 21 nt, Artificial Sequence
  Marburg virus siRNA sense strand
caagaaggaaacaacacagac

SEQ ID NO: 26880 - RNA, 21 nt, Artificial Sequence
  Marburg virus siRNA sense strand
aagaaggaaacaacacagacc

SEQ ID NO: 26881 - RNA, 21 nt, Artificial Sequence
  Marburg virus siRNA sense strand
agaaggaaacaacacagacca

SEQ ID NO: 26882 - RNA, 21 nt, Artificial Sequence
  Marburg virus siRNA sense strand
gaaggaaacaacacagaccau

SEQ ID NO: 26883 - RNA, 21 nt, Artificial Sequence
  Marburg virus siRNA sense strand
aaggaaacaacacagaccauu

SEQ ID NO: 26884 - RNA, 21 nt, Artificial Sequence
  Marburg virus siRNA sense strand
aggaaacaacacagaccauuc

SEQ ID NO: 26885 - RNA, 21 nt, Artificial Sequence
  Marburg virus siRNA sense strand
ggaaacaacacagaccauucc

SEQ ID NO: 26886 - RNA, 21 nt, Artificial Sequence
  Marburg virus siRNA sense strand
gaaacaacacagaccauuccc

SEQ ID NO: 26887 - RNA, 21 nt, Artificial Sequence
  Marburg virus siRNA sense strand
aaacaacacagaccauuccca

SEQ ID NO: 26888 - RNA, 21 nt, Artificial Sequence
  Marburg virus siRNA sense strand
aacaacacagaccauucccaa

SEQ ID NO: 26889 - RNA, 21 nt, Artificial Sequence
  Marburg virus siRNA sense strand
acaacacagaccauucccaag

SEQ ID NO: 26890 - RNA, 21 nt, Artificial Sequence
  Marburg virus siRNA sense strand
caacacagaccauucccaagg

SEQ ID NO: 26891 - RNA, 21 nt, Artificial Sequence
  Marburg virus siRNA sense strand
aacacagaccauucccaaggu

SEQ ID NO: 26892 - RNA, 21 nt, Artificial Sequence
  Marburg virus siRNA sense strand
acacagaccauucccaaggua

SEQ ID NO: 26893 - RNA, 21 nt, Artificial Sequence
  Marburg virus siRNA sense strand
cacagaccauucccaagguac

SEQ ID NO: 26894 - RNA, 21 nt, Artificial Sequence
  Marburg virus siRNA sense strand
acagaccauucccaagguacu

SEQ ID NO: 26895 - RNA, 21 nt, Artificial Sequence
  Marburg virus siRNA sense strand
cagaccauucccaagguacug

SEQ ID NO: 26896 - RNA, 21 nt, Artificial Sequence
  Marburg virus siRNA sense strand
agaccauucccaagguacugu

SEQ ID NO: 26897 - RNA, 21 nt, Artificial Sequence
  Marburg virus siRNA sense strand
gaccauucccaagguacugug

SEQ ID NO: 26898 - RNA, 21 nt, Artificial Sequence
  Marburg virus siRNA sense strand
accauucccaagguacuguga

SEQ ID NO: 26899 - RNA, 21 nt, Artificial Sequence
  Marburg virus siRNA sense strand
ccauucccaagguacugugac

SEQ ID NO: 26900 - RNA, 21 nt, Artificial Sequence
  Marburg virus siRNA sense strand
cauucccaagguacugugacu

SEQ ID NO: 26901 - RNA, 21 nt, Artificial Sequence
  Marburg virus siRNA sense strand
auucccaagguacugugacug

SEQ ID NO: 26902 - RNA, 21 nt, Artificial Sequence
  Marburg virus siRNA sense strand
uucccaagguacugugacuga

SEQ ID NO: 26903 - RNA, 21 nt, Artificial Sequence
  Marburg virus siRNA sense strand
ucccaagguacugugacugaa

SEQ ID NO: 26904 - RNA, 21 nt, Artificial Sequence
  Marburg virus siRNA sense strand
cccaagguacugugacugaac

SEQ ID NO: 26905 - RNA, 21 nt, Artificial Sequence
  Marburg virus siRNA sense strand
ccaagguacugugacugaacc

SEQ ID NO: 26906 - RNA, 21 nt, Artificial Sequence
  Marburg virus siRNA sense strand
caagguacugugacugaaccc

SEQ ID NO: 26907 - RNA, 21 nt, Artificial Sequence
  Marburg virus siRNA sense strand
aagguacugugacugaaccca

SEQ ID NO: 26908 - RNA, 21 nt, Artificial Sequence
  Marburg virus siRNA sense strand
agguacugugacugaacccaa

SEQ ID NO: 26909 - RNA, 21 nt, Artificial Sequence
  Marburg virus siRNA sense strand
gguacugugacugaacccaac

SEQ ID NO: 26910 - RNA, 21 nt, Artificial Sequence
  Marburg virus siRNA sense strand
guacugugacugaacccaaca

SEQ ID NO: 26911 - RNA, 21 nt, Artificial Sequence
  Marburg virus siRNA sense strand
uacugugacugaacccaacaa

SEQ ID NO: 26912 - RNA, 21 nt, Artificial Sequence
  Marburg virus siRNA sense strand
acugugacugaacccaacaaa

SEQ ID NO: 26913 - RNA, 21 nt, Artificial Sequence
  Marburg virus siRNA sense strand
cugugacugaacccaacaaaa

SEQ ID NO: 26914 - RNA, 21 nt, Artificial Sequence
  Marburg virus siRNA sense strand
ugugacugaacccaacaaaac

SEQ ID NO: 26915 - RNA, 21 nt, Artificial Sequence
  Marburg virus siRNA sense strand
gugacugaacccaacaaaacc

SEQ ID NO: 26916 - RNA, 21 nt, Artificial Sequence
  Marburg virus siRNA sense strand
ugacugaacccaacaaaacca

SEQ ID NO: 26917 - RNA, 21 nt, Artificial Sequence
  Marburg virus siRNA sense strand
gacugaacccaacaaaaccaa

SEQ ID NO: 26918 - RNA, 21 nt, Artificial Sequence
  Marburg virus siRNA sense strand
acugaacccaacaaaaccaac

SEQ ID NO: 26919 - RNA, 21 nt, Artificial Sequence
  Marburg virus siRNA sense strand
cugaacccaacaaaaccaaca

SEQ ID NO: 26920 - RNA, 21 nt, Artificial Sequence
  Marburg virus siRNA sense strand
ugaacccaacaaaaccaacac

SEQ ID NO: 26921 - RNA, 21 nt, Artificial Sequence
  Marburg virus siRNA sense strand
gaacccaacaaaaccaacaca

SEQ ID NO: 26922 - RNA, 21 nt, Artificial Sequence
  Marburg virus siRNA sense strand
aacccaacaaaaccaacacaa

SEQ ID NO: 26923 - RNA, 21 nt, Artificial Sequence
  Marburg virus siRNA sense strand
acccaacaaaaccaacacaac

SEQ ID NO: 26924 - RNA, 21 nt, Artificial Sequence
  Marburg virus siRNA sense strand
cccaacaaaaccaacacaacg

SEQ ID NO: 26925 - RNA, 21 nt, Artificial Sequence
  Marburg virus siRNA sense strand
ccaacaaaaccaacacaacgg

SEQ ID NO: 26926 - RNA, 21 nt, Artificial Sequence
  Marburg virus siRNA sense strand
caacaaaaccaacacaacggc

SEQ ID NO: 26927 - RNA, 21 nt, Artificial Sequence
  Marburg virus siRNA sense strand
aacaaaaccaacacaacggca

SEQ ID NO: 26928 - RNA, 21 nt, Artificial Sequence
  Marburg virus siRNA sense strand
acaaaaccaacacaacggcac

SEQ ID NO: 26929 - RNA, 21 nt, Artificial Sequence
  Marburg virus siRNA sense strand
caaaaccaacacaacggcaca

SEQ ID NO: 26930 - RNA, 21 nt, Artificial Sequence
  Marburg virus siRNA sense strand
aaaaccaacacaacggcacaa

SEQ ID NO: 26931 - RNA, 21 nt, Artificial Sequence
  Marburg virus siRNA sense strand
aaaccaacacaacggcacaac

SEQ ID NO: 26932 - RNA, 21 nt, Artificial Sequence
  Marburg virus siRNA sense strand
aaccaacacaacggcacaacc

SEQ ID NO: 26933 - RNA, 21 nt, Artificial Sequence
  Marburg virus siRNA sense strand
accaacacaacggcacaaccg

SEQ ID NO: 26934 - RNA, 21 nt, Artificial Sequence
  Marburg virus siRNA sense strand
ccaacacaacggcacaaccgu

SEQ ID NO: 26935 - RNA, 21 nt, Artificial Sequence
  Marburg virus siRNA sense strand
caacacaacggcacaaccguc

SEQ ID NO: 26936 - RNA, 21 nt, Artificial Sequence
  Marburg virus siRNA sense strand
aacacaacggcacaaccgucc

SEQ ID NO: 26937 - RNA, 21 nt, Artificial Sequence
  Marburg virus siRNA sense strand
acacaacggcacaaccgucca

SEQ ID NO: 26938 - RNA, 21 nt, Artificial Sequence
  Marburg virus siRNA sense strand
cacaacggcacaaccguccau

SEQ ID NO: 26939 - RNA, 21 nt, Artificial Sequence
  Marburg virus siRNA sense strand
acaacggcacaaccguccaug

SEQ ID NO: 26940 - RNA, 21 nt, Artificial Sequence
  Marburg virus siRNA sense strand
caacggcacaaccguccaugc

SEQ ID NO: 26941 - RNA, 21 nt, Artificial Sequence
  Marburg virus siRNA sense strand
aacggcacaaccguccaugcc

SEQ ID NO: 26942 - RNA, 21 nt, Artificial Sequence
  Marburg virus siRNA sense strand
acggcacaaccguccaugccc

SEQ ID NO: 26943 - RNA, 21 nt, Artificial Sequence
  Marburg virus siRNA sense strand
cggcacaaccguccaugcccc

SEQ ID NO: 26944 - RNA, 21 nt, Artificial Sequence
  Marburg virus siRNA sense strand
ggcacaaccguccaugccccc

SEQ ID NO: 26945 - RNA, 21 nt, Artificial Sequence
  Marburg virus siRNA sense strand
gcacaaccguccaugcccccc

SEQ ID NO: 26946 - RNA, 21 nt, Artificial Sequence
  Marburg virus siRNA sense strand
cacaaccguccaugccccccc

SEQ ID NO: 26947 - RNA, 21 nt, Artificial Sequence
  Marburg virus siRNA sense strand
acaaccguccaugccccccca

SEQ ID NO: 26948 - RNA, 21 nt, Artificial Sequence
  Marburg virus siRNA sense strand
caaccguccaugcccccccac

SEQ ID NO: 26949 - RNA, 21 nt, Artificial Sequence
  Marburg virus siRNA sense strand
aaccguccaugcccccccaca

SEQ ID NO: 26950 - RNA, 21 nt, Artificial Sequence
  Marburg virus siRNA sense strand
accguccaugcccccccacaa

SEQ ID NO: 26951 - RNA, 21 nt, Artificial Sequence
  Marburg virus siRNA sense strand
ccguccaugcccccccacaac

SEQ ID NO: 26952 - RNA, 21 nt, Artificial Sequence
  Marburg virus siRNA sense strand
cguccaugcccccccacaaca

SEQ ID NO: 26953 - RNA, 21 nt, Artificial Sequence
  Marburg virus siRNA sense strand
guccaugcccccccacaacac

SEQ ID NO: 26954 - RNA, 21 nt, Artificial Sequence
  Marburg virus siRNA sense strand
uccaugcccccccacaacacc

SEQ ID NO: 26955 - RNA, 21 nt, Artificial Sequence
  Marburg virus siRNA sense strand
ccaugcccccccacaacacca

SEQ ID NO: 26956 - RNA, 21 nt, Artificial Sequence
  Marburg virus siRNA sense strand
caugcccccccacaacaccac

SEQ ID NO: 26957 - RNA, 21 nt, Artificial Sequence
  Marburg virus siRNA sense strand
augcccccccacaacaccacu

SEQ ID NO: 26958 - RNA, 21 nt, Artificial Sequence
  Marburg virus siRNA sense strand
ugcccccccacaacaccacug

SEQ ID NO: 26959 - RNA, 21 nt, Artificial Sequence
  Marburg virus siRNA sense strand
gcccccccacaacaccacugc

SEQ ID NO: 26960 - RNA, 21 nt, Artificial Sequence
  Marburg virus siRNA sense strand
cccccccacaacaccacugca

SEQ ID NO: 26961 - RNA, 21 nt, Artificial Sequence
  Marburg virus siRNA sense strand
ccccccacaacaccacugcaa

SEQ ID NO: 26962 - RNA, 21 nt, Artificial Sequence
  Marburg virus siRNA sense strand
cccccacaacaccacugcaau

SEQ ID NO: 26963 - RNA, 21 nt, Artificial Sequence
  Marburg virus siRNA sense strand
ccccacaacaccacugcaauc

SEQ ID NO: 26964 - RNA, 21 nt, Artificial Sequence
  Marburg virus siRNA sense strand
cccacaacaccacugcaaucu

SEQ ID NO: 26965 - RNA, 21 nt, Artificial Sequence
  Marburg virus siRNA sense strand
ccacaacaccacugcaaucuc

SEQ ID NO: 26966 - RNA, 21 nt, Artificial Sequence
  Marburg virus siRNA sense strand
cacaacaccacugcaaucucu

SEQ ID NO: 26967 - RNA, 21 nt, Artificial Sequence
  Marburg virus siRNA sense strand
acaacaccacugcaaucucua

SEQ ID NO: 26968 - RNA, 21 nt, Artificial Sequence
  Marburg virus siRNA sense strand
caacaccacugcaaucucuac

SEQ ID NO: 26969 - RNA, 21 nt, Artificial Sequence
  Marburg virus siRNA sense strand
aacaccacugcaaucucuacu

SEQ ID NO: 26970 - RNA, 21 nt, Artificial Sequence
  Marburg virus siRNA sense strand
acaccacugcaaucucuacua

SEQ ID NO: 26971 - RNA, 21 nt, Artificial Sequence
  Marburg virus siRNA sense strand
caccacugcaaucucuacuaa

SEQ ID NO: 26972 - RNA, 21 nt, Artificial Sequence
  Marburg virus siRNA sense strand
accacugcaaucucuacuaac

SEQ ID NO: 26973 - RNA, 21 nt, Artificial Sequence
  Marburg virus siRNA sense strand
ccacugcaaucucuacuaaca

SEQ ID NO: 26974 - RNA, 21 nt, Artificial Sequence
  Marburg virus siRNA sense strand
cacugcaaucucuacuaacaa

SEQ ID NO: 26975 - RNA, 21 nt, Artificial Sequence
  Marburg virus siRNA sense strand
acugcaaucucuacuaacaac

SEQ ID NO: 26976 - RNA, 21 nt, Artificial Sequence
  Marburg virus siRNA sense strand
cugcaaucucuacuaacaaca

SEQ ID NO: 26977 - RNA, 21 nt, Artificial Sequence
  Marburg virus siRNA sense strand
ugcaaucucuacuaacaacac

SEQ ID NO: 26978 - RNA, 21 nt, Artificial Sequence
  Marburg virus siRNA sense strand
gcaaucucuacuaacaacacc

SEQ ID NO: 26979 - RNA, 21 nt, Artificial Sequence
  Marburg virus siRNA sense strand
caaucucuacuaacaacaccu

SEQ ID NO: 26980 - RNA, 21 nt, Artificial Sequence
  Marburg virus siRNA sense strand
aaucucuacuaacaacaccuc

SEQ ID NO: 26981 - RNA, 21 nt, Artificial Sequence
  Marburg virus siRNA sense strand
aucucuacuaacaacaccucc

SEQ ID NO: 26982 - RNA, 21 nt, Artificial Sequence
  Marburg virus siRNA sense strand
ucucuacuaacaacaccucca

SEQ ID NO: 26983 - RNA, 21 nt, Artificial Sequence
  Marburg virus siRNA sense strand
cucuacuaacaacaccuccaa

SEQ ID NO: 26984 - RNA, 21 nt, Artificial Sequence
  Marburg virus siRNA sense strand
ucuacuaacaacaccuccaag

SEQ ID NO: 26985 - RNA, 21 nt, Artificial Sequence
  Marburg virus siRNA sense strand
cuacuaacaacaccuccaaga

SEQ ID NO: 26986 - RNA, 21 nt, Artificial Sequence
  Marburg virus siRNA sense strand
uacuaacaacaccuccaagaa

SEQ ID NO: 26987 - RNA, 21 nt, Artificial Sequence
  Marburg virus siRNA sense strand
acuaacaacaccuccaagaac

SEQ ID NO: 26988 - RNA, 21 nt, Artificial Sequence
  Marburg virus siRNA sense strand
cuaacaacaccuccaagaaca

SEQ ID NO: 26989 - RNA, 21 nt, Artificial Sequence
  Marburg virus siRNA sense strand
uaacaacaccuccaagaacaa

SEQ ID NO: 26990 - RNA, 21 nt, Artificial Sequence
  Marburg virus siRNA sense strand
aacaacaccuccaagaacaac

SEQ ID NO: 26991 - RNA, 21 nt, Artificial Sequence
  Marburg virus siRNA sense strand
acaacaccuccaagaacaacu

SEQ ID NO: 26992 - RNA, 21 nt, Artificial Sequence
  Marburg virus siRNA sense strand
caacaccuccaagaacaacuu

SEQ ID NO: 26993 - RNA, 21 nt, Artificial Sequence
  Marburg virus siRNA sense strand
aacaccuccaagaacaacuuc

SEQ ID NO: 26994 - RNA, 21 nt, Artificial Sequence
  Marburg virus siRNA sense strand
acaccuccaagaacaacuuca

SEQ ID NO: 26995 - RNA, 21 nt, Artificial Sequence
  Marburg virus siRNA sense strand
caccuccaagaacaacuucag

SEQ ID NO: 26996 - RNA, 21 nt, Artificial Sequence
  Marburg virus siRNA sense strand
accuccaagaacaacuucagc

SEQ ID NO: 26997 - RNA, 21 nt, Artificial Sequence
  Marburg virus siRNA sense strand
ccuccaagaacaacuucagca

SEQ ID NO: 26998 - RNA, 21 nt, Artificial Sequence
  Marburg virus siRNA sense strand
cuccaagaacaacuucagcac

SEQ ID NO: 26999 - RNA, 21 nt, Artificial Sequence
  Marburg virus siRNA sense strand
uccaagaacaacuucagcacc

SEQ ID NO: 27000 - RNA, 21 nt, Artificial Sequence
  Marburg virus siRNA sense strand
ccaagaacaacuucagcaccc

SEQ ID NO: 27001 - RNA, 21 nt, Artificial Sequence
  Marburg virus siRNA sense strand
caagaacaacuucagcacccu

SEQ ID NO: 27002 - RNA, 21 nt, Artificial Sequence
  Marburg virus siRNA sense strand
aagaacaacuucagcacccuc

SEQ ID NO: 27003 - RNA, 21 nt, Artificial Sequence
  Marburg virus siRNA sense strand
agaacaacuucagcacccucu

SEQ ID NO: 27004 - RNA, 21 nt, Artificial Sequence
  Marburg virus siRNA sense strand
gaacaacuucagcacccucuc

SEQ ID NO: 27005 - RNA, 21 nt, Artificial Sequence
  Marburg virus siRNA sense strand
aacaacuucagcacccucucu

SEQ ID NO: 27006 - RNA, 21 nt, Artificial Sequence
  Marburg virus siRNA sense strand
acaacuucagcacccucucug

SEQ ID NO: 27007 - RNA, 21 nt, Artificial Sequence
  Marburg virus siRNA sense strand
caacuucagcacccucucugu

SEQ ID NO: 27008 - RNA, 21 nt, Artificial Sequence
  Marburg virus siRNA sense strand
aacuucagcacccucucugua

SEQ ID NO: 27009 - RNA, 21 nt, Artificial Sequence
  Marburg virus siRNA sense strand
acuucagcacccucucuguau

SEQ ID NO: 27010 - RNA, 21 nt, Artificial Sequence
  Marburg virus siRNA sense strand
cuucagcacccucucuguauc

SEQ ID NO: 27011 - RNA, 21 nt, Artificial Sequence
  Marburg virus siRNA sense strand
uucagcacccucucuguauca

SEQ ID NO: 27012 - RNA, 21 nt, Artificial Sequence
  Marburg virus siRNA sense strand
ucagcacccucucuguaucac

SEQ ID NO: 27013 - RNA, 21 nt, Artificial Sequence
  Marburg virus siRNA sense strand
cagcacccucucuguaucacu

SEQ ID NO: 27014 - RNA, 21 nt, Artificial Sequence
  Marburg virus siRNA sense strand
agcacccucucuguaucacua

SEQ ID NO: 27015 - RNA, 21 nt, Artificial Sequence
  Marburg virus siRNA sense strand
gcacccucucuguaucacuac

SEQ ID NO: 27016 - RNA, 21 nt, Artificial Sequence
  Marburg virus siRNA sense strand
cacccucucuguaucacuaca

SEQ ID NO: 27017 - RNA, 21 nt, Artificial Sequence
  Marburg virus siRNA sense strand
acccucucuguaucacuacaa

SEQ ID NO: 27018 - RNA, 21 nt, Artificial Sequence
  Marburg virus siRNA sense strand
cccucucuguaucacuacaaa

SEQ ID NO: 27019 - RNA, 21 nt, Artificial Sequence
  Marburg virus siRNA sense strand
ccucucuguaucacuacaaaa

SEQ ID NO: 27020 - RNA, 21 nt, Artificial Sequence
  Marburg virus siRNA sense strand
cucucuguaucacuacaaaac

SEQ ID NO: 27021 - RNA, 21 nt, Artificial Sequence
  Marburg virus siRNA sense strand
ucucuguaucacuacaaaaca

SEQ ID NO: 27022 - RNA, 21 nt, Artificial Sequence
  Marburg virus siRNA sense strand
cucuguaucacuacaaaacac

SEQ ID NO: 27023 - RNA, 21 nt, Artificial Sequence
  Marburg virus siRNA sense strand
ucuguaucacuacaaaacacc

SEQ ID NO: 27024 - RNA, 21 nt, Artificial Sequence
  Marburg virus siRNA sense strand
cuguaucacuacaaaacacca

SEQ ID NO: 27025 - RNA, 21 nt, Artificial Sequence
  Marburg virus siRNA sense strand
uguaucacuacaaaacaccac

SEQ ID NO: 27026 - RNA, 21 nt, Artificial Sequence
  Marburg virus siRNA sense strand
guaucacuacaaaacaccacc

SEQ ID NO: 27027 - RNA, 21 nt, Artificial Sequence
  Marburg virus siRNA sense strand
uaucacuacaaaacaccacca

SEQ ID NO: 27028 - RNA, 21 nt, Artificial Sequence
  Marburg virus siRNA sense strand
aucacuacaaaacaccaccaa

SEQ ID NO: 27029 - RNA, 21 nt, Artificial Sequence
  Marburg virus siRNA sense strand
ucacuacaaaacaccaccaau

SEQ ID NO: 27030 - RNA, 21 nt, Artificial Sequence
  Marburg virus siRNA sense strand
cacuacaaaacaccaccaauu

SEQ ID NO: 27031 - RNA, 21 nt, Artificial Sequence
  Marburg virus siRNA sense strand
acuacaaaacaccaccaauua

SEQ ID NO: 27032 - RNA, 21 nt, Artificial Sequence
  Marburg virus siRNA sense strand
cuacaaaacaccaccaauuac

SEQ ID NO: 27033 - RNA, 21 nt, Artificial Sequence
  Marburg virus siRNA sense strand
uacaaaacaccaccaauuacg

SEQ ID NO: 27034 - RNA, 21 nt, Artificial Sequence
  Marburg virus siRNA sense strand
acaaaacaccaccaauuacga

SEQ ID NO: 27035 - RNA, 21 nt, Artificial Sequence
  Marburg virus siRNA sense strand
caaaacaccaccaauuacgac

SEQ ID NO: 27036 - RNA, 21 nt, Artificial Sequence
  Marburg virus siRNA sense strand
aaaacaccaccaauuacgaca

SEQ ID NO: 27037 - RNA, 21 nt, Artificial Sequence
  Marburg virus siRNA sense strand
aaacaccaccaauuacgacac

SEQ ID NO: 27038 - RNA, 21 nt, Artificial Sequence
  Marburg virus siRNA sense strand
aacaccaccaauuacgacaca

SEQ ID NO: 27039 - RNA, 21 nt, Artificial Sequence
  Marburg virus siRNA sense strand
acaccaccaauuacgacacac

SEQ ID NO: 27040 - RNA, 21 nt, Artificial Sequence
  Marburg virus siRNA sense strand
caccaccaauuacgacacaca

SEQ ID NO: 27041 - RNA, 21 nt, Artificial Sequence
  Marburg virus siRNA sense strand
accaccaauuacgacacacag

SEQ ID NO: 27042 - RNA, 21 nt, Artificial Sequence
  Marburg virus siRNA sense strand
ccaccaauuacgacacacaga

SEQ ID NO: 27043 - RNA, 21 nt, Artificial Sequence
  Marburg virus siRNA sense strand
caccaauuacgacacacagag

SEQ ID NO: 27044 - RNA, 21 nt, Artificial Sequence
  Marburg virus siRNA sense strand
accaauuacgacacacagagc

SEQ ID NO: 27045 - RNA, 21 nt, Artificial Sequence
  Marburg virus siRNA sense strand
ccaauuacgacacacagagca

SEQ ID NO: 27046 - RNA, 21 nt, Artificial Sequence
  Marburg virus siRNA sense strand
caauuacgacacacagagcac

SEQ ID NO: 27047 - RNA, 21 nt, Artificial Sequence
  Marburg virus siRNA sense strand
aauuacgacacacagagcaca

SEQ ID NO: 27048 - RNA, 21 nt, Artificial Sequence
  Marburg virus siRNA sense strand
auuacgacacacagagcacag

SEQ ID NO: 27049 - RNA, 21 nt, Artificial Sequence
  Marburg virus siRNA sense strand
uuacgacacacagagcacagc

SEQ ID NO: 27050 - RNA, 21 nt, Artificial Sequence
  Marburg virus siRNA sense strand
uacgacacacagagcacagcc

SEQ ID NO: 27051 - RNA, 21 nt, Artificial Sequence
  Marburg virus siRNA sense strand
acgacacacagagcacagcca

SEQ ID NO: 27052 - RNA, 21 nt, Artificial Sequence
  Marburg virus siRNA sense strand
cgacacacagagcacagccac

SEQ ID NO: 27053 - RNA, 21 nt, Artificial Sequence
  Marburg virus siRNA sense strand
gacacacagagcacagccacu

SEQ ID NO: 27054 - RNA, 21 nt, Artificial Sequence
  Marburg virus siRNA sense strand
acacacagagcacagccacug

SEQ ID NO: 27055 - RNA, 21 nt, Artificial Sequence
  Marburg virus siRNA sense strand
cacacagagcacagccacuga

SEQ ID NO: 27056 - RNA, 21 nt, Artificial Sequence
  Marburg virus siRNA sense strand
acacagagcacagccacugaa

SEQ ID NO: 27057 - RNA, 21 nt, Artificial Sequence
  Marburg virus siRNA sense strand
cacagagcacagccacugaaa

SEQ ID NO: 27058 - RNA, 21 nt, Artificial Sequence
  Marburg virus siRNA sense strand
acagagcacagccacugaaaa

SEQ ID NO: 27059 - RNA, 21 nt, Artificial Sequence
  Marburg virus siRNA sense strand
cagagcacagccacugaaaau

SEQ ID NO: 27060 - RNA, 21 nt, Artificial Sequence
  Marburg virus siRNA sense strand
agagcacagccacugaaaaug

SEQ ID NO: 27061 - RNA, 21 nt, Artificial Sequence
  Marburg virus siRNA sense strand
gagcacagccacugaaaauga

SEQ ID NO: 27062 - RNA, 21 nt, Artificial Sequence
  Marburg virus siRNA sense strand
agcacagccacugaaaaugaa

SEQ ID NO: 27063 - RNA, 21 nt, Artificial Sequence
  Marburg virus siRNA sense strand
gcacagccacugaaaaugaac

SEQ ID NO: 27064 - RNA, 21 nt, Artificial Sequence
  Marburg virus siRNA sense strand
cacagccacugaaaaugaaca

SEQ ID NO: 27065 - RNA, 21 nt, Artificial Sequence
  Marburg virus siRNA sense strand
acagccacugaaaaugaacaa

SEQ ID NO: 27066 - RNA, 21 nt, Artificial Sequence
  Marburg virus siRNA sense strand
cagccacugaaaaugaacaaa

SEQ ID NO: 27067 - RNA, 21 nt, Artificial Sequence
  Marburg virus siRNA sense strand
agccacugaaaaugaacaaac

SEQ ID NO: 27068 - RNA, 21 nt, Artificial Sequence
  Marburg virus siRNA sense strand
gccacugaaaaugaacaaacc

SEQ ID NO: 27069 - RNA, 21 nt, Artificial Sequence
  Marburg virus siRNA sense strand
ccacugaaaaugaacaaacca

SEQ ID NO: 27070 - RNA, 21 nt, Artificial Sequence
  Marburg virus siRNA sense strand
cacugaaaaugaacaaaccag

SEQ ID NO: 27071 - RNA, 21 nt, Artificial Sequence
  Marburg virus siRNA sense strand
acugaaaaugaacaaaccagu

SEQ ID NO: 27072 - RNA, 21 nt, Artificial Sequence
  Marburg virus siRNA sense strand
cugaaaaugaacaaaccagug

SEQ ID NO: 27073 - RNA, 21 nt, Artificial Sequence
  Marburg virus siRNA sense strand
ugaaaaugaacaaaccagugc

SEQ ID NO: 27074 - RNA, 21 nt, Artificial Sequence
  Marburg virus siRNA sense strand
gaaaaugaacaaaccagugcc

SEQ ID NO: 27075 - RNA, 21 nt, Artificial Sequence
  Marburg virus siRNA sense strand
aaaaugaacaaaccagugccc

SEQ ID NO: 27076 - RNA, 21 nt, Artificial Sequence
  Marburg virus siRNA sense strand
aaaugaacaaaccagugcccc

SEQ ID NO: 27077 - RNA, 21 nt, Artificial Sequence
  Marburg virus siRNA sense strand
aaugaacaaaccagugccccc

SEQ ID NO: 27078 - RNA, 21 nt, Artificial Sequence
  Marburg virus siRNA sense strand
augaacaaaccagugcccccu

SEQ ID NO: 27079 - RNA, 21 nt, Artificial Sequence
  Marburg virus siRNA sense strand
ugaacaaaccagugcccccuc

SEQ ID NO: 27080 - RNA, 21 nt, Artificial Sequence
  Marburg virus siRNA sense strand
gaacaaaccagugcccccucg

SEQ ID NO: 27081 - RNA, 21 nt, Artificial Sequence
  Marburg virus siRNA sense strand
aacaaaccagugcccccucga

SEQ ID NO: 27082 - RNA, 21 nt, Artificial Sequence
  Marburg virus siRNA sense strand
acaaaccagugcccccucgaa

SEQ ID NO: 27083 - RNA, 21 nt, Artificial Sequence
  Marburg virus siRNA sense strand
caaaccagugcccccucgaaa

SEQ ID NO: 27084 - RNA, 21 nt, Artificial Sequence
  Marburg virus siRNA sense strand
aaaccagugcccccucgaaaa

SEQ ID NO: 27085 - RNA, 21 nt, Artificial Sequence
  Marburg virus siRNA sense strand
aaccagugcccccucgaaaac

SEQ ID NO: 27086 - RNA, 21 nt, Artificial Sequence
  Marburg virus siRNA sense strand
accagugcccccucgaaaaca

SEQ ID NO: 27087 - RNA, 21 nt, Artificial Sequence
  Marburg virus siRNA sense strand
ccagugcccccucgaaaacaa

SEQ ID NO: 27088 - RNA, 21 nt, Artificial Sequence
  Marburg virus siRNA sense strand
cagugcccccucgaaaacaac

SEQ ID NO: 27089 - RNA, 21 nt, Artificial Sequence
  Marburg virus siRNA sense strand
agugcccccucgaaaacaacc

SEQ ID NO: 27090 - RNA, 21 nt, Artificial Sequence
  Marburg virus siRNA sense strand
gugcccccucgaaaacaaccc

SEQ ID NO: 27091 - RNA, 21 nt, Artificial Sequence
  Marburg virus siRNA sense strand
ugcccccucgaaaacaacccu

SEQ ID NO: 27092 - RNA, 21 nt, Artificial Sequence
  Marburg virus siRNA sense strand
gcccccucgaaaacaacccug

SEQ ID NO: 27093 - RNA, 21 nt, Artificial Sequence
  Marburg virus siRNA sense strand
cccccucgaaaacaacccugc

SEQ ID NO: 27094 - RNA, 21 nt, Artificial Sequence
  Marburg virus siRNA sense strand
ccccucgaaaacaacccugcc

SEQ ID NO: 27095 - RNA, 21 nt, Artificial Sequence
  Marburg virus siRNA sense strand
cccucgaaaacaacccugccu

SEQ ID NO: 27096 - RNA, 21 nt, Artificial Sequence
  Marburg virus siRNA sense strand
ccucgaaaacaacccugccuc

SEQ ID NO: 27097 - RNA, 21 nt, Artificial Sequence
  Marburg virus siRNA sense strand
cucgaaaacaacccugccucc

SEQ ID NO: 27098 - RNA, 21 nt, Artificial Sequence
  Marburg virus siRNA sense strand
ucgaaaacaacccugccucca

SEQ ID NO: 27099 - RNA, 21 nt, Artificial Sequence
  Marburg virus siRNA sense strand
cgaaaacaacccugccuccaa

SEQ ID NO: 27100 - RNA, 21 nt, Artificial Sequence
  Marburg virus siRNA sense strand
gaaaacaacccugccuccaac

SEQ ID NO: 27101 - RNA, 21 nt, Artificial Sequence
  Marburg virus siRNA sense strand
aaaacaacccugccuccaaca

SEQ ID NO: 27102 - RNA, 21 nt, Artificial Sequence
  Marburg virus siRNA sense strand
aaacaacccugccuccaacag

SEQ ID NO: 27103 - RNA, 21 nt, Artificial Sequence
  Marburg virus siRNA sense strand
aacaacccugccuccaacagg

SEQ ID NO: 27104 - RNA, 21 nt, Artificial Sequence
  Marburg virus siRNA sense strand
acaacccugccuccaacagga

SEQ ID NO: 27105 - RNA, 21 nt, Artificial Sequence
  Marburg virus siRNA sense strand
caacccugccuccaacaggaa

SEQ ID NO: 27106 - RNA, 21 nt, Artificial Sequence
  Marburg virus siRNA sense strand
aacccugccuccaacaggaaa

SEQ ID NO: 27107 - RNA, 21 nt, Artificial Sequence
  Marburg virus siRNA sense strand
acccugccuccaacaggaaau

SEQ ID NO: 27108 - RNA, 21 nt, Artificial Sequence
  Marburg virus siRNA sense strand
cccugccuccaacaggaaauc

SEQ ID NO: 27109 - RNA, 21 nt, Artificial Sequence
  Marburg virus siRNA sense strand
ccugccuccaacaggaaaucu

SEQ ID NO: 27110 - RNA, 21 nt, Artificial Sequence
  Marburg virus siRNA sense strand
cugccuccaacaggaaaucuu

SEQ ID NO: 27111 - RNA, 21 nt, Artificial Sequence
  Marburg virus siRNA sense strand
ugccuccaacaggaaaucuua

SEQ ID NO: 27112 - RNA, 21 nt, Artificial Sequence
  Marburg virus siRNA sense strand
gccuccaacaggaaaucuuac

SEQ ID NO: 27113 - RNA, 21 nt, Artificial Sequence
  Marburg virus siRNA sense strand
ccuccaacaggaaaucuuacc

SEQ ID NO: 27114 - RNA, 21 nt, Artificial Sequence
  Marburg virus siRNA sense strand
cuccaacaggaaaucuuacca

SEQ ID NO: 27115 - RNA, 21 nt, Artificial Sequence
  Marburg virus siRNA sense strand
uccaacaggaaaucuuaccac

SEQ ID NO: 27116 - RNA, 21 nt, Artificial Sequence
  Marburg virus siRNA sense strand
ccaacaggaaaucuuaccaca

SEQ ID NO: 27117 - RNA, 21 nt, Artificial Sequence
  Marburg virus siRNA sense strand
caacaggaaaucuuaccacag

SEQ ID NO: 27118 - RNA, 21 nt, Artificial Sequence
  Marburg virus siRNA sense strand
aacaggaaaucuuaccacagc

SEQ ID NO: 27119 - RNA, 21 nt, Artificial Sequence
  Marburg virus siRNA sense strand
acaggaaaucuuaccacagca

SEQ ID NO: 27120 - RNA, 21 nt, Artificial Sequence
  Marburg virus siRNA sense strand
caggaaaucuuaccacagcaa

SEQ ID NO: 27121 - RNA, 21 nt, Artificial Sequence
  Marburg virus siRNA sense strand
aggaaaucuuaccacagcaaa

SEQ ID NO: 27122 - RNA, 21 nt, Artificial Sequence
  Marburg virus siRNA sense strand
ggaaaucuuaccacagcaaag

SEQ ID NO: 27123 - RNA, 21 nt, Artificial Sequence
  Marburg virus siRNA sense strand
gaaaucuuaccacagcaaaga

SEQ ID NO: 27124 - RNA, 21 nt, Artificial Sequence
  Marburg virus siRNA sense strand
aaaucuuaccacagcaaagag

SEQ ID NO: 27125 - RNA, 21 nt, Artificial Sequence
  Marburg virus siRNA sense strand
aaucuuaccacagcaaagagc

SEQ ID NO: 27126 - RNA, 21 nt, Artificial Sequence
  Marburg virus siRNA sense strand
aucuuaccacagcaaagagca

SEQ ID NO: 27127 - RNA, 21 nt, Artificial Sequence
  Marburg virus siRNA sense strand
ucuuaccacagcaaagagcac

SEQ ID NO: 27128 - RNA, 21 nt, Artificial Sequence
  Marburg virus siRNA sense strand
cuuaccacagcaaagagcacu

SEQ ID NO: 27129 - RNA, 21 nt, Artificial Sequence
  Marburg virus siRNA sense strand
uuaccacagcaaagagcacua

SEQ ID NO: 27130 - RNA, 21 nt, Artificial Sequence
  Marburg virus siRNA sense strand
uaccacagcaaagagcacuaa

SEQ ID NO: 27131 - RNA, 21 nt, Artificial Sequence
  Marburg virus siRNA sense strand
accacagcaaagagcacuaac

SEQ ID NO: 27132 - RNA, 21 nt, Artificial Sequence
  Marburg virus siRNA sense strand
ccacagcaaagagcacuaaca

SEQ ID NO: 27133 - RNA, 21 nt, Artificial Sequence
  Marburg virus siRNA sense strand
cacagcaaagagcacuaacaa

SEQ ID NO: 27134 - RNA, 21 nt, Artificial Sequence
  Marburg virus siRNA sense strand
acagcaaagagcacuaacaac

SEQ ID NO: 27135 - RNA, 21 nt, Artificial Sequence
  Marburg virus siRNA sense strand
cagcaaagagcacuaacaaca

SEQ ID NO: 27136 - RNA, 21 nt, Artificial Sequence
  Marburg virus siRNA sense strand
agcaaagagcacuaacaacac

SEQ ID NO: 27137 - RNA, 21 nt, Artificial Sequence
  Marburg virus siRNA sense strand
gcaaagagcacuaacaacacg

SEQ ID NO: 27138 - RNA, 21 nt, Artificial Sequence
  Marburg virus siRNA sense strand
caaagagcacuaacaacacga

SEQ ID NO: 27139 - RNA, 21 nt, Artificial Sequence
  Marburg virus siRNA sense strand
aaagagcacuaacaacacgaa

SEQ ID NO: 27140 - RNA, 21 nt, Artificial Sequence
  Marburg virus siRNA sense strand
aagagcacuaacaacacgaaa

SEQ ID NO: 27141 - RNA, 21 nt, Artificial Sequence
  Marburg virus siRNA sense strand
agagcacuaacaacacgaaag

SEQ ID NO: 27142 - RNA, 21 nt, Artificial Sequence
  Marburg virus siRNA sense strand
gagcacuaacaacacgaaagg

SEQ ID NO: 27143 - RNA, 21 nt, Artificial Sequence
  Marburg virus siRNA sense strand
agcacuaacaacacgaaaggc

SEQ ID NO: 27144 - RNA, 21 nt, Artificial Sequence
  Marburg virus siRNA sense strand
gcacuaacaacacgaaaggcc

SEQ ID NO: 27145 - RNA, 21 nt, Artificial Sequence
  Marburg virus siRNA sense strand
cacuaacaacacgaaaggccc

SEQ ID NO: 27146 - RNA, 21 nt, Artificial Sequence
  Marburg virus siRNA sense strand
acuaacaacacgaaaggcccc

SEQ ID NO: 27147 - RNA, 21 nt, Artificial Sequence
  Marburg virus siRNA sense strand
cuaacaacacgaaaggcccca

SEQ ID NO: 27148 - RNA, 21 nt, Artificial Sequence
  Marburg virus siRNA sense strand
uaacaacacgaaaggccccac

SEQ ID NO: 27149 - RNA, 21 nt, Artificial Sequence
  Marburg virus siRNA sense strand
aacaacacgaaaggccccacc

SEQ ID NO: 27150 - RNA, 21 nt, Artificial Sequence
  Marburg virus siRNA sense strand
acaacacgaaaggccccacca

SEQ ID NO: 27151 - RNA, 21 nt, Artificial Sequence
  Marburg virus siRNA sense strand
caacacgaaaggccccaccac

SEQ ID NO: 27152 - RNA, 21 nt, Artificial Sequence
  Marburg virus siRNA sense strand
aacacgaaaggccccaccaca

SEQ ID NO: 27153 - RNA, 21 nt, Artificial Sequence
  Marburg virus siRNA sense strand
acacgaaaggccccaccacaa

SEQ ID NO: 27154 - RNA, 21 nt, Artificial Sequence
  Marburg virus siRNA sense strand
cacgaaaggccccaccacaac

SEQ ID NO: 27155 - RNA, 21 nt, Artificial Sequence
  Marburg virus siRNA sense strand
acgaaaggccccaccacaacg

SEQ ID NO: 27156 - RNA, 21 nt, Artificial Sequence
  Marburg virus siRNA sense strand
cgaaaggccccaccacaacgg

SEQ ID NO: 27157 - RNA, 21 nt, Artificial Sequence
  Marburg virus siRNA sense strand
gaaaggccccaccacaacggc

SEQ ID NO: 27158 - RNA, 21 nt, Artificial Sequence
  Marburg virus siRNA sense strand
aaaggccccaccacaacggca

SEQ ID NO: 27159 - RNA, 21 nt, Artificial Sequence
  Marburg virus siRNA sense strand
aaggccccaccacaacggcac

SEQ ID NO: 27160 - RNA, 21 nt, Artificial Sequence
  Marburg virus siRNA sense strand
aggccccaccacaacggcacc

SEQ ID NO: 27161 - RNA, 21 nt, Artificial Sequence
  Marburg virus siRNA sense strand
ggccccaccacaacggcacca

SEQ ID NO: 27162 - RNA, 21 nt, Artificial Sequence
  Marburg virus siRNA sense strand
gccccaccacaacggcaccaa

SEQ ID NO: 27163 - RNA, 21 nt, Artificial Sequence
  Marburg virus siRNA sense strand
ccccaccacaacggcaccaaa

SEQ ID NO: 27164 - RNA, 21 nt, Artificial Sequence
  Marburg virus siRNA sense strand
cccaccacaacggcaccaaau

SEQ ID NO: 27165 - RNA, 21 nt, Artificial Sequence
  Marburg virus siRNA sense strand
ccaccacaacggcaccaaaua

SEQ ID NO: 27166 - RNA, 21 nt, Artificial Sequence
  Marburg virus siRNA sense strand
caccacaacggcaccaaauau

SEQ ID NO: 27167 - RNA, 21 nt, Artificial Sequence
  Marburg virus siRNA sense strand
accacaacggcaccaaauaug

SEQ ID NO: 27168 - RNA, 21 nt, Artificial Sequence
  Marburg virus siRNA sense strand
ccacaacggcaccaaauauga

SEQ ID NO: 27169 - RNA, 21 nt, Artificial Sequence
  Marburg virus siRNA sense strand
cacaacggcaccaaauaugac

SEQ ID NO: 27170 - RNA, 21 nt, Artificial Sequence
  Marburg virus siRNA sense strand
acaacggcaccaaauaugaca

SEQ ID NO: 27171 - RNA, 21 nt, Artificial Sequence
  Marburg virus siRNA sense strand
caacggcaccaaauaugacaa

SEQ ID NO: 27172 - RNA, 21 nt, Artificial Sequence
  Marburg virus siRNA sense strand
aacggcaccaaauaugacaaa

SEQ ID NO: 27173 - RNA, 21 nt, Artificial Sequence
  Marburg virus siRNA sense strand
acggcaccaaauaugacaaau

SEQ ID NO: 27174 - RNA, 21 nt, Artificial Sequence
  Marburg virus siRNA sense strand
cggcaccaaauaugacaaaug

SEQ ID NO: 27175 - RNA, 21 nt, Artificial Sequence
  Marburg virus siRNA sense strand
ggcaccaaauaugacaaaugg

SEQ ID NO: 27176 - RNA, 21 nt, Artificial Sequence
  Marburg virus siRNA sense strand
gcaccaaauaugacaaauggg

SEQ ID NO: 27177 - RNA, 21 nt, Artificial Sequence
  Marburg virus siRNA sense strand
caccaaauaugacaaaugggc

SEQ ID NO: 27178 - RNA, 21 nt, Artificial Sequence
  Marburg virus siRNA sense strand
accaaauaugacaaaugggca

SEQ ID NO: 27179 - RNA, 21 nt, Artificial Sequence
  Marburg virus siRNA sense strand
ccaaauaugacaaaugggcau

SEQ ID NO: 27180 - RNA, 21 nt, Artificial Sequence
  Marburg virus siRNA sense strand
caaauaugacaaaugggcauu

SEQ ID NO: 27181 - RNA, 21 nt, Artificial Sequence
  Marburg virus siRNA sense strand
aaauaugacaaaugggcauuu

SEQ ID NO: 27182 - RNA, 21 nt, Artificial Sequence
  Marburg virus siRNA sense strand
aauaugacaaaugggcauuua

SEQ ID NO: 27183 - RNA, 21 nt, Artificial Sequence
  Marburg virus siRNA sense strand
auaugacaaaugggcauuuaa

SEQ ID NO: 27184 - RNA, 21 nt, Artificial Sequence
  Marburg virus siRNA sense strand
uaugacaaaugggcauuuaac

SEQ ID NO: 27185 - RNA, 21 nt, Artificial Sequence
  Marburg virus siRNA sense strand
augacaaaugggcauuuaacc

SEQ ID NO: 27186 - RNA, 21 nt, Artificial Sequence
  Marburg virus siRNA sense strand
ugacaaaugggcauuuaacca

SEQ ID NO: 27187 - RNA, 21 nt, Artificial Sequence
  Marburg virus siRNA sense strand
gacaaaugggcauuuaaccag

SEQ ID NO: 27188 - RNA, 21 nt, Artificial Sequence
  Marburg virus siRNA sense strand
acaaaugggcauuuaaccagu

SEQ ID NO: 27189 - RNA, 21 nt, Artificial Sequence
  Marburg virus siRNA sense strand
caaaugggcauuuaaccaguc

SEQ ID NO: 27190 - RNA, 21 nt, Artificial Sequence
  Marburg virus siRNA sense strand
aaaugggcauuuaaccagucc

SEQ ID NO: 27191 - RNA, 21 nt, Artificial Sequence
  Marburg virus siRNA sense strand
aaugggcauuuaaccaguccc

SEQ ID NO: 27192 - RNA, 21 nt, Artificial Sequence
  Marburg virus siRNA sense strand
augggcauuuaaccagucccu

SEQ ID NO: 27193 - RNA, 21 nt, Artificial Sequence
  Marburg virus siRNA sense strand
ugggcauuuaaccagucccuc

SEQ ID NO: 27194 - RNA, 21 nt, Artificial Sequence
  Marburg virus siRNA sense strand
gggcauuuaaccagucccucc

SEQ ID NO: 27195 - RNA, 21 nt, Artificial Sequence
  Marburg virus siRNA sense strand
ggcauuuaaccagucccuccc

SEQ ID NO: 27196 - RNA, 21 nt, Artificial Sequence
  Marburg virus siRNA sense strand
gcauuuaaccagucccucccc

SEQ ID NO: 27197 - RNA, 21 nt, Artificial Sequence
  Marburg virus siRNA sense strand
cauuuaaccagucccuccccc

SEQ ID NO: 27198 - RNA, 21 nt, Artificial Sequence
  Marburg virus siRNA sense strand
auuuaaccagucccuccccca

SEQ ID NO: 27199 - RNA, 21 nt, Artificial Sequence
  Marburg virus siRNA sense strand
uuuaaccagucccucccccac

SEQ ID NO: 27200 - RNA, 21 nt, Artificial Sequence
  Marburg virus siRNA sense strand
uuaaccagucccucccccacc

SEQ ID NO: 27201 - RNA, 21 nt, Artificial Sequence
  Marburg virus siRNA sense strand
uaaccagucccucccccaccc

SEQ ID NO: 27202 - RNA, 21 nt, Artificial Sequence
  Marburg virus siRNA sense strand
aaccagucccucccccacccc

SEQ ID NO: 27203 - RNA, 21 nt, Artificial Sequence
  Marburg virus siRNA sense strand
accagucccucccccaccccc

SEQ ID NO: 27204 - RNA, 21 nt, Artificial Sequence
  Marburg virus siRNA sense strand
ccagucccucccccaccccca

SEQ ID NO: 27205 - RNA, 21 nt, Artificial Sequence
  Marburg virus siRNA sense strand
cagucccucccccacccccaa

SEQ ID NO: 27206 - RNA, 21 nt, Artificial Sequence
  Marburg virus siRNA sense strand
agucccucccccacccccaac

SEQ ID NO: 27207 - RNA, 21 nt, Artificial Sequence
  Marburg virus siRNA sense strand
gucccucccccacccccaacc

SEQ ID NO: 27208 - RNA, 21 nt, Artificial Sequence
  Marburg virus siRNA sense strand
ucccucccccacccccaaccc

SEQ ID NO: 27209 - RNA, 21 nt, Artificial Sequence
  Marburg virus siRNA sense strand
cccucccccacccccaacccg

SEQ ID NO: 27210 - RNA, 21 nt, Artificial Sequence
  Marburg virus siRNA sense strand
ccucccccacccccaacccga

SEQ ID NO: 27211 - RNA, 21 nt, Artificial Sequence
  Marburg virus siRNA sense strand
cucccccacccccaacccgac

SEQ ID NO: 27212 - RNA, 21 nt, Artificial Sequence
  Marburg virus siRNA sense strand
ucccccacccccaacccgacc

SEQ ID NO: 27213 - RNA, 21 nt, Artificial Sequence
  Marburg virus siRNA sense strand
cccccacccccaacccgacca

SEQ ID NO: 27214 - RNA, 21 nt, Artificial Sequence
  Marburg virus siRNA sense strand
ccccacccccaacccgaccac

SEQ ID NO: 27215 - RNA, 21 nt, Artificial Sequence
  Marburg virus siRNA sense strand
cccacccccaacccgaccaca

SEQ ID NO: 27216 - RNA, 21 nt, Artificial Sequence
  Marburg virus siRNA sense strand
ccacccccaacccgaccacac

SEQ ID NO: 27217 - RNA, 21 nt, Artificial Sequence
  Marburg virus siRNA sense strand
cacccccaacccgaccacaca

SEQ ID NO: 27218 - RNA, 21 nt, Artificial Sequence
  Marburg virus siRNA sense strand
acccccaacccgaccacacaa

SEQ ID NO: 27219 - RNA, 21 nt, Artificial Sequence
  Marburg virus siRNA sense strand
cccccaacccgaccacacaac

SEQ ID NO: 27220 - RNA, 21 nt, Artificial Sequence
  Marburg virus siRNA sense strand
ccccaacccgaccacacaaca

SEQ ID NO: 27221 - RNA, 21 nt, Artificial Sequence
  Marburg virus siRNA sense strand
cccaacccgaccacacaacau

SEQ ID NO: 27222 - RNA, 21 nt, Artificial Sequence
  Marburg virus siRNA sense strand
ccaacccgaccacacaacauc

SEQ ID NO: 27223 - RNA, 21 nt, Artificial Sequence
  Marburg virus siRNA sense strand
caacccgaccacacaacaucu

SEQ ID NO: 27224 - RNA, 21 nt, Artificial Sequence
  Marburg virus siRNA sense strand
aacccgaccacacaacaucuu

SEQ ID NO: 27225 - RNA, 21 nt, Artificial Sequence
  Marburg virus siRNA sense strand
acccgaccacacaacaucuug

SEQ ID NO: 27226 - RNA, 21 nt, Artificial Sequence
  Marburg virus siRNA sense strand
cccgaccacacaacaucuugu

SEQ ID NO: 27227 - RNA, 21 nt, Artificial Sequence
  Marburg virus siRNA sense strand
ccgaccacacaacaucuugua

SEQ ID NO: 27228 - RNA, 21 nt, Artificial Sequence
  Marburg virus siRNA sense strand
cgaccacacaacaucuuguau

SEQ ID NO: 27229 - RNA, 21 nt, Artificial Sequence
  Marburg virus siRNA sense strand
gaccacacaacaucuuguaua

SEQ ID NO: 27230 - RNA, 21 nt, Artificial Sequence
  Marburg virus siRNA sense strand
accacacaacaucuuguauau

SEQ ID NO: 27231 - RNA, 21 nt, Artificial Sequence
  Marburg virus siRNA sense strand
ccacacaacaucuuguauauu

SEQ ID NO: 27232 - RNA, 21 nt, Artificial Sequence
  Marburg virus siRNA sense strand
cacacaacaucuuguauauuu

SEQ ID NO: 27233 - RNA, 21 nt, Artificial Sequence
  Marburg virus siRNA sense strand
acacaacaucuuguauauuuc

SEQ ID NO: 27234 - RNA, 21 nt, Artificial Sequence
  Marburg virus siRNA sense strand
cacaacaucuuguauauuuca

SEQ ID NO: 27235 - RNA, 21 nt, Artificial Sequence
  Marburg virus siRNA sense strand
acaacaucuuguauauuucag

SEQ ID NO: 27236 - RNA, 21 nt, Artificial Sequence
  Marburg virus siRNA sense strand
caacaucuuguauauuucaga

SEQ ID NO: 27237 - RNA, 21 nt, Artificial Sequence
  Marburg virus siRNA sense strand
aacaucuuguauauuucagaa

SEQ ID NO: 27238 - RNA, 21 nt, Artificial Sequence
  Marburg virus siRNA sense strand
acaucuuguauauuucagaaa

SEQ ID NO: 27239 - RNA, 21 nt, Artificial Sequence
  Marburg virus siRNA sense strand
caucuuguauauuucagaaag

SEQ ID NO: 27240 - RNA, 21 nt, Artificial Sequence
  Marburg virus siRNA sense strand
aucuuguauauuucagaaaga

SEQ ID NO: 27241 - RNA, 21 nt, Artificial Sequence
  Marburg virus siRNA sense strand
ucuuguauauuucagaaagaa

SEQ ID NO: 27242 - RNA, 21 nt, Artificial Sequence
  Marburg virus siRNA sense strand
cuuguauauuucagaaagaaa

SEQ ID NO: 27243 - RNA, 21 nt, Artificial Sequence
  Marburg virus siRNA sense strand
uuguauauuucagaaagaaac

SEQ ID NO: 27244 - RNA, 21 nt, Artificial Sequence
  Marburg virus siRNA sense strand
uguauauuucagaaagaaacg

SEQ ID NO: 27245 - RNA, 21 nt, Artificial Sequence
  Marburg virus siRNA sense strand
guauauuucagaaagaaacga

SEQ ID NO: 27246 - RNA, 21 nt, Artificial Sequence
  Marburg virus siRNA sense strand
uauauuucagaaagaaacgaa

SEQ ID NO: 27247 - RNA, 21 nt, Artificial Sequence
  Marburg virus siRNA sense strand
auauuucagaaagaaacgaag

SEQ ID NO: 27248 - RNA, 21 nt, Artificial Sequence
  Marburg virus siRNA sense strand
uauuucagaaagaaacgaagu

SEQ ID NO: 27249 - RNA, 21 nt, Artificial Sequence
  Marburg virus siRNA sense strand
auuucagaaagaaacgaagua

SEQ ID NO: 27250 - RNA, 21 nt, Artificial Sequence
  Marburg virus siRNA sense strand
uuucagaaagaaacgaaguau

SEQ ID NO: 27251 - RNA, 21 nt, Artificial Sequence
  Marburg virus siRNA sense strand
uucagaaagaaacgaaguauc

SEQ ID NO: 27252 - RNA, 21 nt, Artificial Sequence
  Marburg virus siRNA sense strand
ucagaaagaaacgaaguaucc

SEQ ID NO: 27253 - RNA, 21 nt, Artificial Sequence
  Marburg virus siRNA sense strand
cagaaagaaacgaaguauccu

SEQ ID NO: 27254 - RNA, 21 nt, Artificial Sequence
  Marburg virus siRNA sense strand
agaaagaaacgaaguauccuc

SEQ ID NO: 27255 - RNA, 21 nt, Artificial Sequence
  Marburg virus siRNA sense strand
gaaagaaacgaaguauccucu

SEQ ID NO: 27256 - RNA, 21 nt, Artificial Sequence
  Marburg virus siRNA sense strand
aaagaaacgaaguauccucug

SEQ ID NO: 27257 - RNA, 21 nt, Artificial Sequence
  Marburg virus siRNA sense strand
aagaaacgaaguauccucugg

SEQ ID NO: 27258 - RNA, 21 nt, Artificial Sequence
  Marburg virus siRNA sense strand
agaaacgaaguauccucugga

SEQ ID NO: 27259 - RNA, 21 nt, Artificial Sequence
  Marburg virus siRNA sense strand
gaaacgaaguauccucuggag

SEQ ID NO: 27260 - RNA, 21 nt, Artificial Sequence
  Marburg virus siRNA sense strand
aaacgaaguauccucuggagg

SEQ ID NO: 27261 - RNA, 21 nt, Artificial Sequence
  Marburg virus siRNA sense strand
aacgaaguauccucuggaggg

SEQ ID NO: 27262 - RNA, 21 nt, Artificial Sequence
  Marburg virus siRNA sense strand
acgaaguauccucuggaggga

SEQ ID NO: 27263 - RNA, 21 nt, Artificial Sequence
  Marburg virus siRNA sense strand
cgaaguauccucuggagggaa

SEQ ID NO: 27264 - RNA, 21 nt, Artificial Sequence
  Marburg virus siRNA sense strand
gaaguauccucuggagggaag

SEQ ID NO: 27265 - RNA, 21 nt, Artificial Sequence
  Marburg virus siRNA sense strand
aaguauccucuggagggaagg

SEQ ID NO: 27266 - RNA, 21 nt, Artificial Sequence
  Marburg virus siRNA sense strand
aguauccucuggagggaaggc

SEQ ID NO: 27267 - RNA, 21 nt, Artificial Sequence
  Marburg virus siRNA sense strand
guauccucuggagggaaggcg

SEQ ID NO: 27268 - RNA, 21 nt, Artificial Sequence
  Marburg virus siRNA sense strand
uauccucuggagggaaggcga

SEQ ID NO: 27269 - RNA, 21 nt, Artificial Sequence
  Marburg virus siRNA sense strand
auccucuggagggaaggcgac

SEQ ID NO: 27270 - RNA, 21 nt, Artificial Sequence
  Marburg virus siRNA sense strand
uccucuggagggaaggcgaca

SEQ ID NO: 27271 - RNA, 21 nt, Artificial Sequence
  Marburg virus siRNA sense strand
ccucuggagggaaggcgacau

SEQ ID NO: 27272 - RNA, 21 nt, Artificial Sequence
  Marburg virus siRNA sense strand
cucuggagggaaggcgacaug

SEQ ID NO: 27273 - RNA, 21 nt, Artificial Sequence
  Marburg virus siRNA sense strand
ucuggagggaaggcgacaugu

SEQ ID NO: 27274 - RNA, 21 nt, Artificial Sequence
  Marburg virus siRNA sense strand
cuggagggaaggcgacauguu

SEQ ID NO: 27275 - RNA, 21 nt, Artificial Sequence
  Marburg virus siRNA sense strand
uggagggaaggcgacauguuu

SEQ ID NO: 27276 - RNA, 21 nt, Artificial Sequence
  Marburg virus siRNA sense strand
ggagggaaggcgacauguuuc

SEQ ID NO: 27277 - RNA, 21 nt, Artificial Sequence
  Marburg virus siRNA sense strand
gagggaaggcgacauguuucc

SEQ ID NO: 27278 - RNA, 21 nt, Artificial Sequence
  Marburg virus siRNA sense strand
agggaaggcgacauguuuccu

SEQ ID NO: 27279 - RNA, 21 nt, Artificial Sequence
  Marburg virus siRNA sense strand
gggaaggcgacauguuuccuu

SEQ ID NO: 27280 - RNA, 21 nt, Artificial Sequence
  Marburg virus siRNA sense strand
ggaaggcgacauguuuccuuu

SEQ ID NO: 27281 - RNA, 21 nt, Artificial Sequence
  Marburg virus siRNA sense strand
gaaggcgacauguuuccuuuu

SEQ ID NO: 27282 - RNA, 21 nt, Artificial Sequence
  Marburg virus siRNA sense strand
aaggcgacauguuuccuuuuc

SEQ ID NO: 27283 - RNA, 21 nt, Artificial Sequence
  Marburg virus siRNA sense strand
aggcgacauguuuccuuuucu

SEQ ID NO: 27284 - RNA, 21 nt, Artificial Sequence
  Marburg virus siRNA sense strand
ggcgacauguuuccuuuucug

SEQ ID NO: 27285 - RNA, 21 nt, Artificial Sequence
  Marburg virus siRNA sense strand
gcgacauguuuccuuuucugg

SEQ ID NO: 27286 - RNA, 21 nt, Artificial Sequence
  Marburg virus siRNA sense strand
cgacauguuuccuuuucugga

SEQ ID NO: 27287 - RNA, 21 nt, Artificial Sequence
  Marburg virus siRNA sense strand
gacauguuuccuuuucuggac

SEQ ID NO: 27288 - RNA, 21 nt, Artificial Sequence
  Marburg virus siRNA sense strand
acauguuuccuuuucuggacg

SEQ ID NO: 27289 - RNA, 21 nt, Artificial Sequence
  Marburg virus siRNA sense strand
cauguuuccuuuucuggacgg

SEQ ID NO: 27290 - RNA, 21 nt, Artificial Sequence
  Marburg virus siRNA sense strand
auguuuccuuuucuggacggg

SEQ ID NO: 27291 - RNA, 21 nt, Artificial Sequence
  Marburg virus siRNA sense strand
uguuuccuuuucuggacgggu

SEQ ID NO: 27292 - RNA, 21 nt, Artificial Sequence
  Marburg virus siRNA sense strand
guuuccuuuucuggacggguu

SEQ ID NO: 27293 - RNA, 21 nt, Artificial Sequence
  Marburg virus siRNA sense strand
uuuccuuuucuggacggguua

SEQ ID NO: 27294 - RNA, 21 nt, Artificial Sequence
  Marburg virus siRNA sense strand
uuccuuuucuggacggguuaa

SEQ ID NO: 27295 - RNA, 21 nt, Artificial Sequence
  Marburg virus siRNA sense strand
uccuuuucuggacggguuaau

SEQ ID NO: 27296 - RNA, 21 nt, Artificial Sequence
  Marburg virus siRNA sense strand
ccuuuucuggacggguuaaua

SEQ ID NO: 27297 - RNA, 21 nt, Artificial Sequence
  Marburg virus siRNA sense strand
cuuuucuggacggguuaauaa

SEQ ID NO: 27298 - RNA, 21 nt, Artificial Sequence
  Marburg virus siRNA sense strand
uuuucuggacggguuaauaaa

SEQ ID NO: 27299 - RNA, 21 nt, Artificial Sequence
  Marburg virus siRNA sense strand
uuucuggacggguuaauaaau

SEQ ID NO: 27300 - RNA, 21 nt, Artificial Sequence
  Marburg virus siRNA sense strand
uucuggacggguuaauaaaug

SEQ ID NO: 27301 - RNA, 21 nt, Artificial Sequence
  Marburg virus siRNA sense strand
ucuggacggguuaauaaaugc

SEQ ID NO: 27302 - RNA, 21 nt, Artificial Sequence
  Marburg virus siRNA sense strand
cuggacggguuaauaaaugcu

SEQ ID NO: 27303 - RNA, 21 nt, Artificial Sequence
  Marburg virus siRNA sense strand
uggacggguuaauaaaugcuc

SEQ ID NO: 27304 - RNA, 21 nt, Artificial Sequence
  Marburg virus siRNA sense strand
ggacggguuaauaaaugcucc

SEQ ID NO: 27305 - RNA, 21 nt, Artificial Sequence
  Marburg virus siRNA sense strand
gacggguuaauaaaugcucca

SEQ ID NO: 27306 - RNA, 21 nt, Artificial Sequence
  Marburg virus siRNA sense strand
acggguuaauaaaugcuccaa

SEQ ID NO: 27307 - RNA, 21 nt, Artificial Sequence
  Marburg virus siRNA sense strand
cggguuaauaaaugcuccaau

SEQ ID NO: 27308 - RNA, 21 nt, Artificial Sequence
  Marburg virus siRNA sense strand
ggguuaauaaaugcuccaauu

SEQ ID NO: 27309 - RNA, 21 nt, Artificial Sequence
  Marburg virus siRNA sense strand
gguuaauaaaugcuccaauug

SEQ ID NO: 27310 - RNA, 21 nt, Artificial Sequence
  Marburg virus siRNA sense strand
guuaauaaaugcuccaauuga

SEQ ID NO: 27311 - RNA, 21 nt, Artificial Sequence
  Marburg virus siRNA sense strand
uuaauaaaugcuccaauugau

SEQ ID NO: 27312 - RNA, 21 nt, Artificial Sequence
  Marburg virus siRNA sense strand
uaauaaaugcuccaauugauu

SEQ ID NO: 27313 - RNA, 21 nt, Artificial Sequence
  Marburg virus siRNA sense strand
aauaaaugcuccaauugauuu

SEQ ID NO: 27314 - RNA, 21 nt, Artificial Sequence
  Marburg virus siRNA sense strand
auaaaugcuccaauugauuuu

SEQ ID NO: 27315 - RNA, 21 nt, Artificial Sequence
  Marburg virus siRNA sense strand
uaaaugcuccaauugauuuug

SEQ ID NO: 27316 - RNA, 21 nt, Artificial Sequence
  Marburg virus siRNA sense strand
aaaugcuccaauugauuuuga

SEQ ID NO: 27317 - RNA, 21 nt, Artificial Sequence
  Marburg virus siRNA sense strand
aaugcuccaauugauuuugau

SEQ ID NO: 27318 - RNA, 21 nt, Artificial Sequence
  Marburg virus siRNA sense strand
augcuccaauugauuuugauc

SEQ ID NO: 27319 - RNA, 21 nt, Artificial Sequence
  Marburg virus siRNA sense strand
ugcuccaauugauuuugaucc

SEQ ID NO: 27320 - RNA, 21 nt, Artificial Sequence
  Marburg virus siRNA sense strand
gcuccaauugauuuugaucca

SEQ ID NO: 27321 - RNA, 21 nt, Artificial Sequence
  Marburg virus siRNA sense strand
cuccaauugauuuugauccag

SEQ ID NO: 27322 - RNA, 21 nt, Artificial Sequence
  Marburg virus siRNA sense strand
uccaauugauuuugauccagu

SEQ ID NO: 27323 - RNA, 21 nt, Artificial Sequence
  Marburg virus siRNA sense strand
ccaauugauuuugauccaguu

SEQ ID NO: 27324 - RNA, 21 nt, Artificial Sequence
  Marburg virus siRNA sense strand
caauugauuuugauccaguuc

SEQ ID NO: 27325 - RNA, 21 nt, Artificial Sequence
  Marburg virus siRNA sense strand
aauugauuuugauccaguucc

SEQ ID NO: 27326 - RNA, 21 nt, Artificial Sequence
  Marburg virus siRNA sense strand
auugauuuugauccaguucca

SEQ ID NO: 27327 - RNA, 21 nt, Artificial Sequence
  Marburg virus siRNA sense strand
uugauuuugauccaguuccaa

SEQ ID NO: 27328 - RNA, 21 nt, Artificial Sequence
  Marburg virus siRNA sense strand
ugauuuugauccaguuccaaa

SEQ ID NO: 27329 - RNA, 21 nt, Artificial Sequence
  Marburg virus siRNA sense strand
gauuuugauccaguuccaaau

SEQ ID NO: 27330 - RNA, 21 nt, Artificial Sequence
  Marburg virus siRNA sense strand
auuuugauccaguuccaaaua

SEQ ID NO: 27331 - RNA, 21 nt, Artificial Sequence
  Marburg virus siRNA sense strand
uuuugauccaguuccaaauac

SEQ ID NO: 27332 - RNA, 21 nt, Artificial Sequence
  Marburg virus siRNA sense strand
uuugauccaguuccaaauaca

SEQ ID NO: 27333 - RNA, 21 nt, Artificial Sequence
  Marburg virus siRNA sense strand
uugauccaguuccaaauacaa

SEQ ID NO: 27334 - RNA, 21 nt, Artificial Sequence
  Marburg virus siRNA sense strand
ugauccaguuccaaauacaaa

SEQ ID NO: 27335 - RNA, 21 nt, Artificial Sequence
  Marburg virus siRNA sense strand
gauccaguuccaaauacaaag

SEQ ID NO: 27336 - RNA, 21 nt, Artificial Sequence
  Marburg virus siRNA sense strand
auccaguuccaaauacaaaga

SEQ ID NO: 27337 - RNA, 21 nt, Artificial Sequence
  Marburg virus siRNA sense strand
uccaguuccaaauacaaagac

SEQ ID NO: 27338 - RNA, 21 nt, Artificial Sequence
  Marburg virus siRNA sense strand
ccaguuccaaauacaaagacg

SEQ ID NO: 27339 - RNA, 21 nt, Artificial Sequence
  Marburg virus siRNA sense strand
caguuccaaauacaaagacga

SEQ ID NO: 27340 - RNA, 21 nt, Artificial Sequence
  Marburg virus siRNA sense strand
aguuccaaauacaaagacgau

SEQ ID NO: 27341 - RNA, 21 nt, Artificial Sequence
  Marburg virus siRNA sense strand
guuccaaauacaaagacgauc

SEQ ID NO: 27342 - RNA, 21 nt, Artificial Sequence
  Marburg virus siRNA sense strand
uuccaaauacaaagacgaucu

SEQ ID NO: 27343 - RNA, 21 nt, Artificial Sequence
  Marburg virus siRNA sense strand
uccaaauacaaagacgaucuu

SEQ ID NO: 27344 - RNA, 21 nt, Artificial Sequence
  Marburg virus siRNA sense strand
ccaaauacaaagacgaucuuu

SEQ ID NO: 27345 - RNA, 21 nt, Artificial Sequence
  Marburg virus siRNA sense strand
caaauacaaagacgaucuuug

SEQ ID NO: 27346 - RNA, 21 nt, Artificial Sequence
  Marburg virus siRNA sense strand
aaauacaaagacgaucuuuga

SEQ ID NO: 27347 - RNA, 21 nt, Artificial Sequence
  Marburg virus siRNA sense strand
aauacaaagacgaucuuugau

SEQ ID NO: 27348 - RNA, 21 nt, Artificial Sequence
  Marburg virus siRNA sense strand
auacaaagacgaucuuugaug

SEQ ID NO: 27349 - RNA, 21 nt, Artificial Sequence
  Marburg virus siRNA sense strand
uacaaagacgaucuuugauga

SEQ ID NO: 27350 - RNA, 21 nt, Artificial Sequence
  Marburg virus siRNA sense strand
acaaagacgaucuuugaugaa

SEQ ID NO: 27351 - RNA, 21 nt, Artificial Sequence
  Marburg virus siRNA sense strand
caaagacgaucuuugaugaau

SEQ ID NO: 27352 - RNA, 21 nt, Artificial Sequence
  Marburg virus siRNA sense strand
aaagacgaucuuugaugaauc

SEQ ID NO: 27353 - RNA, 21 nt, Artificial Sequence
  Marburg virus siRNA sense strand
aagacgaucuuugaugaaucu

SEQ ID NO: 27354 - RNA, 21 nt, Artificial Sequence
  Marburg virus siRNA sense strand
agacgaucuuugaugaaucuu

SEQ ID NO: 27355 - RNA, 21 nt, Artificial Sequence
  Marburg virus siRNA sense strand
gacgaucuuugaugaaucuuc

SEQ ID NO: 27356 - RNA, 21 nt, Artificial Sequence
  Marburg virus siRNA sense strand
acgaucuuugaugaaucuucu

SEQ ID NO: 27357 - RNA, 21 nt, Artificial Sequence
  Marburg virus siRNA sense strand
cgaucuuugaugaaucuucua

SEQ ID NO: 27358 - RNA, 21 nt, Artificial Sequence
  Marburg virus siRNA sense strand
gaucuuugaugaaucuucuag

SEQ ID NO: 27359 - RNA, 21 nt, Artificial Sequence
  Marburg virus siRNA sense strand
aucuuugaugaaucuucuagu

SEQ ID NO: 27360 - RNA, 21 nt, Artificial Sequence
  Marburg virus siRNA sense strand
ucuuugaugaaucuucuaguu

SEQ ID NO: 27361 - RNA, 21 nt, Artificial Sequence
  Marburg virus siRNA sense strand
cuuugaugaaucuucuaguuc

SEQ ID NO: 27362 - RNA, 21 nt, Artificial Sequence
  Marburg virus siRNA sense strand
uuugaugaaucuucuaguucu

(The sequence listing continues in the following parts.)

What is claimed is:

1. An siRNA molecule for silencing Ebola virus L-polymerase (L-pol) expression comprising a double-stranded sequence consisting of SEQ ID NO:23 and SEQ ID NO:24.

2. The siRNA molecule in accordance with claim 1, wherein said double-stranded sequence comprises a hairpin loop structure.

3. A pharmaceutical composition comprising an siRNA molecule in accordance with claim 1 and a phamaceutically acceptable carrier.

4. A nucleic acid-lipid particle comprising: an siRNA molecule in accordance with claim 1; a cationic lipid; and a non-cationic lipid.

5. The nucleic acid-lipid particle in accordance with claim 4, wherein said cationic lipid is a member selected from the group consisting of N,N-dioleyl-N,N-dimethylammonium chloride (DODAC), N,N-distearyl-N,N-dimethylammonium bromide (DDAB), N-(1-(2,3-dioleoyloxy)propyl)-N,N,N-trimethylammonium chloride (DOTAP), N-(1-(2,3-dioleyloxy)propyl)-N,N,N-trimethylammonium chloride (DOTMA), N,N-dimethyl-2,3-dioleyloxypropylamine (DODMA), 1,2-DiLinoleyloxy-N,N-dimethylaminopropane (DLinDMA), 1,2-Dilinolenyloxy-N,N-dimethylaminopropane (DLendMA), and a mixture thereof.

6. The nucleic acid-lipid particle in accordance with claim 4, wherein said cationic lipid is DLinDMA.

7. The nucleic acid-lipid particle in accordance with claim 4, wherein said non-cationic lipid is an anionic lipid.

8. The nucleic acid-lipid particle in accordance with claim 4, wherein said non-cationic lipid is a neutral lipid.

9. The nucleic acid-lipid particle in accordance with claim 4, wherein said non-cationic lipid is a member selected from the group consisting of distearoylphosphatidylcholine (DSPC), dioleoylphosphatidylethanolamine (DOPE), palmitoyloleoyl-phosphatidylcholine (POPC), palmitoyloleoyl-phosphatidylethanolamine (POPE), palmitoyloleyol-phosphatidylglycerol (POPG), dipalmitoyl-phosphatidylethanolamine (DPPE), dimyristoyl-phosphatidylethanolamine (DMPE), distearoyl-phosphatidylethanolamine (DSPE), monomethyl-phosphatidylethanolamine, dimethyl-phosphatidylethanolamine, dielaidoyl-phosphatidylethanolamine (DEPE), stearoyloleoyl-phosphatidylethanolamine (SOPE), egg phosphatidylcholine (EPC), cholesterol, and a mixture thereof.

10. The nucleic acid-lipid particle in accordance with claim 4, wherein said non-cationic lipid is DSPC.

11. The nucleic acid-lipid particle in accordance with claim 4, further comprising a conjugated lipid that inhibits aggregation of particles.

12. The nucleic acid-lipid particle in accordance with claim 11, wherein said conjugated lipid that inhibits aggregation of particles is a member selected from the group consisting of a polyethyleneglycol (PEG)-lipid conjugate, a polyamide (ATTA)-lipid conjugate, and a mixture thereof.

13. The nucleic acid-lipid particle in accordance with claim 12, wherein said PEG-lipid is a member selected from the group consisting of a PEG-diacylglycerol, a PEG dialkyloxypropyl, a PEG-phospholipid, a PEG-ceramide, and a mixture thereof.

14. The nucleic acid-lipid particle in accordance with claim 12, wherein said conjugated lipid that inhibits aggregation of particles comprises a polyethyleneglycol (PEG)-dialkyloxypropyl (PEG-DAA) conjugate.

15. The nucleic acid-lipid particle in accordance with claim 14, wherein said PEG-DAA conjugate is a member selected from the group consisting of a PEG-dilauryloxypropyl ($C_{12}$), a PEG-dimyristyloxypropyl ($C_{14}$), a PEG-dipalmityloxypropyl ($C_{16}$), and a PEG-distearyloxypropyl ($C_{18}$).

16. The nucleic acid-lipid particle in accordance with claim 14, wherein said PEG-DAA conjugate is a PEG-dimyristyloxypropyl ($C_{14}$).

17. The nucleic acid-lipid particle in accordance with claim 4, wherein said cationic lipid comprises from about 20 mol % to about 50 mol % of the total lipid present in said particle.

18. The nucleic acid-lipid particle in accordance with claim 4, wherein said cationic lipid comprises about 40 mol % of the total lipid present in said particle.

19. The nucleic acid-lipid particle in accordance with claim 4, wherein said non-cationic lipid comprises from about 5 mol % to about 90 mol % of the total lipid present in said particle.

20. The nucleic acid-lipid particle in accordance with claim 4, wherein said non-cationic lipid comprises about 20 mol % of the total lipid present in said particle.

21. The nucleic acid-lipid particle in accordance with claim 14, wherein said PEG-DAA conjugate comprises from 0 mol % to about 20 mol % of the total lipid present in said particle.

22. The nucleic acid-lipid particle in accordance with claim 14, wherein said PEG-DAA conjugate comprises about 2 mol % of the total lipid present in said particle.

23. The nucleic acid-lipid particle in accordance with claim 4, further comprising cholesterol.

24. The nucleic acid-lipid particle in accordance with claim 23, wherein the cholesterol comprises from about 10 mol % to about 60 mol % of the total lipid present in said particle.

25. The nucleic acid-lipid particle in accordance with claim 23, wherein the cholesterol comprises about 48 mol % of the total lipid present in said particle.

26. The nucleic acid-lipid particle in accordance with claim 4, wherein said siRNA molecule in said nucleic acid-lipid particle is not substantially degraded after exposure of said particle to a nuclease at 37° C. for 20 minutes.

27. The nucleic acid-lipid particle in accordance with claim 4, wherein said siRNA molecule in said nucleic acid-lipid particle is not substantially degraded after incubation of said particle in serum at 37° C. for 30 minutes.

28. The nucleic acid-lipid particle in accordance with claim 4, wherein said siRNA molecule is fully encapsulated in said nucleic acid-lipid particle.

29. The nucleic acid-lipid particle in accordance with claim 4, wherein said particle has a siRNA:lipid ratio of from about 0.01 to about 0.2.

30. The nucleic acid-lipid particle in accordance with claim 4, wherein said particle has a siRNA:lipid ratio of from about 0.02 to about 0.1.

31. The nucleic acid-lipid particle in accordance with claim 4, wherein said particle has a siRNA:lipid ratio of about 0.04.

32. The nucleic acid-lipid particle in accordance with claim 4, wherein said particle has a median diameter of from about 50 nm to about 150 nm.

33. The nucleic acid-lipid particle in accordance with claim 4, wherein said particle has a median diameter of from about 70 nm to about 90 nm.

34. A pharmaceutical composition comprising a nucleic acid-lipid particle in accordance with claim 4 and a pharmaceutically acceptable carrier.

35. The nucleic acid-lipid particle in accordance with claim 4, wherein said non-cationic lipid comprises DSPC and cholesterol.

36. The nucleic acid-lipid particle in accordance with claim 10, wherein said DSPC comprises about 10 mol % of the total lipid present in said particle.

37. The nucleic acid-lipid particle in accordance with claim 4, wherein said cationic lipid comprises from about 2 mol % to about 60 mol % of the total lipid present in said particle.

38. The nucleic acid-lipid particle in accordance with claim 4, wherein said non-cationic lipid comprises dipalmitoylphosphatidylcholine (DPPC).

39. The nucleic acid-lipid particle in accordance with claim 4, wherein said non-cationic lipid comprises DPPC and cholesterol.

40. The siRNA molecule in accordance with claim 1, wherein said siRNA molecule comprises 3' overhangs of about 1 to about 4 nucleotides on one or both sides of the double-stranded sequence.

41. The siRNA molecule in accordance with claim 1, wherein said siRNA molecule comprises at least one modified nucleotide.

42. The siRNA molecule in accordance with claim 1, wherein said siRNA molecule comprises at least one modified nucleotide in one or both strands of the double-stranded sequence.

43. The siRNA molecule in accordance with claim 1, wherein said siRNA molecule comprises at least one 2'-O-methyl (2'OMe) nucleotide.

44. The siRNA molecule in accordance with claim 1, wherein said siRNA molecule comprises at least one 2'OMe nucleotide selected from the group consisting of a 2'OMe-guanosine nucleotide, 2'OMe-uridine nucleotide, 2'OMe-adenosine nucleotide, 2'OMe-cytosine nucleotide, and mixtures thereof.

45. The nucleic acid-lipid particle in accordance with claim 11, wherein said conjugated lipid that inhibits aggregation of particles comprises from about 0.5 mol % to about 20 mol % of the total lipid present in said particle.

* * * * *